United States Patent 12,569,549 (FLAVIVIRUS VACCINE) - sequence listing, part 35

SEQ ID NO: 13548 - RNA, 9879 nt, synthetic construct
  misc_feature 1..9879: note = derived and/or modified CDS sequence (opt3) from DENV-1__EU660390__SS-prME
  source 1..9879: mol_type = other RNA
tccgtgaccatgctgctcatgcttatgcccacagcactggctttccacttgactacgcggggcggggaacctcatatgatcgtctccaagcaggaaaggggaaagtctttactgtttaagacctcagccggtgttaatatgtgcacattgattgcaatggacctcggcgagctgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccgtgctgaggaaactttgcattgaagctaagatctctaatacgaccacagatagccggtgtccaactcaaggagaggccaccctggtcgaagaacaggacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatgtgtactgggagcttcaaactggagaaggaagtcgctgagacccagcacggtacggtgcttgttcagataaagtacgagggcacagacgcgccttgcaaaatcccattctcgacccaagatgaaaagggggtgactcagaacggacgcttgattacagcaaatcccatcgtaaccgacaaagagaagcctgtcaacatagaagccgagccaccctttggcgagtcttatattgtgatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtttttacatccgtggggaaacttgtccatcagattttcggaacggcgtacggcgtgctgttttctggtgtaagctggaccatgaagatagggatcggcgtgttgctcacttggctgggattaaattcacgaagtacatccctgagcatgacctgtattgctgttggcctagtcacactctacctgggggtgatggtgcaggccgattctggatgcgtcatcaactggaaaggccgcgaacttaagtgtggttcagggatcttcgttactaatgaggtgcacacctggacggaacaatataagtttcaggcagacagtccgaaaagattgagcgccgctattggaaaggcctgggaggagggcgtgtgcggtataaggtccgcaacacggctggaaaacatcatgtggaaacagatttctaacgagctcaatcatatcctgttagaaaacgacatgaagctgaccgtaattgtcggcgatgtggctgggatccttggacagggccgcaaaatgataagacctcaacccatggagtacaagtattcgtggaaaagctgggggaaggccaagatcattggagcggacgcccagaatactaccttcatcattgatggcccaaacacacctgaatgtcccgacgatcagagggcttggaatatctgggaggttgaggactacggttttgggatattcactaccaacatttggttgaaactccgtgattcctatacacaggtgtgcgaccaccggctgatgtcagcagccatcaaggatagtaaagctgtccacgccgacatgggatactggattgaatctgagaagaatgaaacgtggaaactagcacgagcgagctttatcgaggtgaagacctgtatatggccaaagtcccatactctgtggtcaaacggcgttctcgaaagcgagatgatcattcccaaaatctatggtggccctatttctcaacacaattacagaccagggtacttcacacagaccgccggaccgtggcatctgggcaaacttgagttggatttcgacctgtgcgaagggactacagtggtagtcgatgagcactgcggaaacaggggcccctccttacgcaccacgactgtgaccggtaaaatcatacacgaatggtgttgccggagttgtacactccctccactgagatttaggggagaagacggatgctggtatggcatggagattcgccccgtgaaggaaaaagaggaaaatcttgtcaagagcatggtttctgctggttccggcgaggtggactcattcagtctggggttgctctgtatcagcatcatgattgaagaggtaatgcgatcgcggtggtcccgtaagatgctgatgaccggaactctagccgtgtttttcctgctcatcatgggccagctgacatggaacgatcttattagattgtgcataatggtcggggcaaatgcttctgacaggatgggaatgggcaccacatacctggccttaatggcaacttttaaaatgcgccctatgttcgccgtgggtctcctgtttcggagacttaccagcagggaggttctgctactcacgatcgggctgtcattggtggctagtgtcgaactgccaaactccttagaggaactcggagatggcctggcgatgggcattatgatccttaagctgttgacagacttccaatctcatcagctctgggccaccctgctaagcctgacttttattaaaaccacattctcccttcactatgcatggaagactatggctatggtgctctcaatcgttagcctgtttcccttgtgtctgagtaccacgtctcagaaaacaacctggttaccggtgctcctggggtcccttggatgcaagcctctgactatgttcttgatagccgagaataagatctggggtcgaaaaagctggccactcaacgaaggcattatggccgtcgggatcgtatcgattctgctatcatctctgcttaagaacgatgtgcccctcgctggacctctggttgcaggcggtatgttgatcgcctgttacgtgataagtgggtccagcgcggacttatctctggagaaagctgccgaggtcagctgggaagaggaagcagagcattccggagcctcacacaatattctcgtggaagtacaggatgacggcacaatgaagatcaaagatgaggagcgcgacgataccctgactatccttctgaaggctacattgctagcagtgagtggcgtctatcccctgagcattccagccaccctctttgtttggtacttctggcagaagaagaagcagcggtctggggtgctgtgggacacgccttcacccccagaagtggagagagcggtccttgatgacggaatatataggatcatgcagcgtggtttactgggccgcagccaggtgggggttggagtattccaagaaaacgtgtttcatactatgtggcacgtcacccggggcgctgtgctcatgtaccagggtaaaagattggagccgagttgggccagcgttaagaaagacctgatttcctacgggggaggctggaggctccgaggctcttggaatacaggggaggaagtgcaggtcatcgcagtggagcctggaaagaaccccaaaaatgtacagaccgccccaggtacattcaagactcccgaaggcgaggtcggggctattgccctggattttaagcctggaacctcgggcagcccaatcgtgaaccgggaaggtaaaatagttgggctttatggaaatggcgtggtcacgacatcaggcacttacgtgtccgcaatcgctcaagccaaggcgagtcaggaggggcccctgcctgagattgaagacgaggttttccgcaaaagaaacttgaccatcatggatctacacccgggatctggtaagacaaggcggtatctgccagccattgtgcgagaagcaatcaaaagaaagctccgcaccttaatactggctcccactagggtcgtggccagcgagatggctgaagcacttaagggcatgcctattcgttaccagaccacagccgtaaaatccgagcatacggggaaggagatcgtggacctgatgtgccacgccacttttaccatgcggctcttgtcaccagttagagtccccaattataacatgatcattatggatgaagctcatttcacagacccttctagcatcgcggcaaggggatacataagtacccgcgtgggcatgggtgaggccgctgccatttttatgactgcaacaccgcccgggtccgtggaagccttcccacaaagcaatgctgtcatccaggatgaggaacgagacattcctgagagatcttggaactcaggatatgagtggatcaccgattttcccggcaaaacggtatggttcgtgccatccataaagagtggcaatgacattgcgaactgtctgcggaaaaatgggaagagggttatccagctcagccgcaagacttttgatacagaataccagaaaaccaagaacaacgactgggactacgtggtcaccactgatatctcggagatgggagccaatttccgtgcagacagagtgattgatcctcggaggtgcctgaaacccgttatccttaaggacggtccagaacgcgtgattctagctggcccgatgcctgtcacagtggcctctgcagcccaacgaagagggcggataggaaggaaccacaataaagagggcgatcagtatatctacatgggtcagcccctgaacaatgacgaggatcatgctcactggaccgaagccaagatgttgttagacaacattaatacaccagaggggatcatccccgcgctgttcgaacctgagcgcgaaaagtccgcagccgtagatggcgagtatagactcaggggagaggctcggaaaacttttgtggaactgatgcgtcgcggcgaccttccagtttggctgagctacaaggtcgcctcagaggggttccagtatagtgatcgaagatggtgctttgacggagaaaggaacaatcaagtgctcgaggaaaacatggatgtggagatttggacgaaagagggtgaacggaagaaattgcgccccagatggctggacgctaggacctactctgaccctctagcactgcgggagttcaaggaatttgccgctggccgaagatccgtcagcggggatctcatacttgagatcggaaaactgccgcagcacttaacacagcgcgcccagaatgcattggacaacctggttatgctccataattcagaacaaggcggtagggcgtatcggcacgccatggaggagctgccagatactattgaaacccttatgctgctcgctttgatcgccgtgctgacagggggcgtaaccttattctttctaagtggacgtggcctggggaagactagcattggactcctttgtgtgatggcatcctctgtcctgttgtggatggctagcgtggagccccattggatcgccgcatccataatcctggagttctttctcatggttctgcttattcctgagcccgacagacagaggacgccacaggataaccagctcgcctacgtggtcatcggtctgttgttcatgattctgaccgtagctgcgaatgagatgggcttactagaaacaactaagaaagacctggggatcggacacgtggccgttgagaaccaccatcacgcagctatgctcgatgtggaccttcatcctgcctcagcctggaccctgtacgcagtcgctacaaccataattactcccatgatgcgccacacaatcgaaaacacgaccgccaatatttctttgactgcgatcgctaaccaagccgcaatactgatgggcctcgataagggttggccaatcagtaaaatggacattggggtgcctctgcttgccttaggctgctattcgcaggtcaatccgctgacactcaccgctgcagtgttgatgctggttgcccattacgcgatcattggacccggcctacaggctaaggccacccgggaggcacaaaaacgaacagccgctgggatcatgaagaacccaactgtggatggaatagtagccattgacctggatcctgtggtctatgacgcaaagtttgaaaaacagctcggccagatcatgcttctgatcttgtgtacgagccagattctgctcatgagaaccacatgggctctgtgcgagtccatcactttagccaccggtccccttacaaccctgtgggaggggtctccaggaaagttctggaatactacgatagcggtttcaatggccaacatttttaggggcagctacctcgccggtgctggcctagccttctccctgatgaaaagtctagggggaggccgccgggggacaggagcacaaggcgaaaccctgggtgagaagtggaaaagacagctcaatcagctttctaagagcgagttcaacacttataagcgttcagggatcatggaggtggacaggtccgaagctaaagagggactgaagcggggcgagaccacaaaacacgccgtcagtcgcggtactgccaagttgcgatggtttgtggaaagaaatctggtaaaacctgagggcaaggtgattgatctcgggtgtggaaggggcgggtggagctactattgcgcgggattaaagaaagttaccgaagtgaagggctacacaaaaggtgggcccggacacgaggaaccgatcccaatggctacgtacggctggaacctggtcaaacttcattctggcaaagacgtgttctttatacctcccgagaagtgtgataccctgctatgcgacatcggggagtcctcaccaaatcccactattgaagagggacggacactccgcgtcctgaaaatggtggaaccttggttgagaggtaaccagttctgtatcaagattctgaatccgtatatgcccagcgttgtagagaccctcgagcaaatgcagaggaagcacggcgggatgcttgtgcgaaacccactgtcgagaaattctactcatgaaatgtactgggtcagttgcggaacaggcaacatcgtgtccgcagttaatatgaccagccgtatgttactgaacagatttacgatggcccaccgcaaacctacctatgagagggatgtggacttgggtacagggactcggcacgtcgctgtggaacccgaggtagccaacctcgatattatcggacagagaatagaaaatattaagcatgagcacaaatcaacctggcattacgacgaggataacccttataagacatgggcataccacggctcctatgaagtgaaaccatctggcagcgccagttccatggttaatggggtcgtgaagctgctaactaagccctgggacgtgatccctatggtcacccagatcgctatgacagataccactccattcggacaacagcgcgtttttaaagagaaggtggacacgaggacacccaaagcgaagcgaggtaccgcccagattatggaagtaactgcacggtggctttggggcttcctgagcagaaacaaaaagccgaggatatgtacccgcgaggaatttacacgtaaggtgcggtctaatgctgccatcggggcagtcttcgtggacgagaaccaatggaactcagccaaagaggctgttgaagatgagagattttgggacctcgtgcatagggaacgcgagctgcacaagcagggaaaatgcgccacgtgcgtctacaacatgatgggcaagcgagagaagaagttgggtgagttcgggaaggcgaaaggaagtcgggcaatttggtacatgtggctgggcgccagatttctcgagttcgaagctcttggcttcatgaatgaggatcactggttttccagggaaaacagcctgtctggggtggagggagagggtttacataagctgggctatatcttgcgcgacatttcgaaaatccctgggggaaatatgtacgccgatgacaccgcaggctgggatactagaataacagaagacgatctccagaacgaggctaagatcaccgacattatggaaccagagcacgccctgctagctaaagccatcttcaaacttacttatcagaataaagtagttcgggtgcaaaggcccgcaaagaacggtacagtcatggatgtgatttcacgtcgagaccagcgcgggagcggacaggtgggcacctacggcctgaatacatttactaacatggaagcgcagctcatcagacaaatggagtccgaggggatattcagtccttctgaactggagaccccaaacttggccgaacgggctttagattggctggagaagtatggagtcgaaaggctcaaacgcatggccattagcggtgacgactgtgttgtgaagcccatcgatgacagatttgcaacggctcttaccgccctgaatgatatgggcaaagtacggaaggacatcccgcagtgggagccttccaaagggtggaacgattggcaacaggtgcccttctgctcacatcactttcaccaactaattatgaaggacggaagggagatagtcgtgccatgtcgaaatcaggatgaactggttggccgtgcaagagtgagtcagggtgccgggtggtctctccgcgagacagcgtgcttgggaaagagctacgctcagatgtggcaactgatgtatttccatcggagggaccttagactggccgcaaacgccatctgttccgctgtccctgtggattgggtacccacttcacgcaccacatggagcattcacgcccatcaccagtggatgactaccgaagacatgctctctgtttggaatcgggtgtggatcgaggaaaacccatggatggaggataaaacgcatatttccagttgggaggacgtcccctacttaggcaagagggaagaccagtggtgcggcagcctgatcgggttgacagcacgagctacctgggccactaatatacaagtggcgatcaaccaggttagacggctgattggaaatgagaactacctcgattatatgacatcgatgaaaaggtttaagaatgaatccgaccctgagggtgctctttggtga

SEQ ID NO: 13549 - RNA, 9879 nt, synthetic construct
  misc_feature 1..9879: note = derived and/or modified CDS sequence (opt3) from DENV-1__EU660391__SS-prME
  source 1..9879: mol_type = other RNA
agcgtgacaatgctgctaatgcttatgcccacagcactggctttccacttgactacgcgaggcggggagcctcatatgatcgtctccaagcaggaaagggggaaatctttactgtttaagacatcagccggtgttaacatgtgcacactaattgcaatggacctcggcgagttctgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaagacgcaaactttgtttgccgccgaacattcgtggatagaggctggggtaatgggtgtggactgtttggcaaaggctccttgataacttgcgctaagttcaagtgcgtaaccaaactcgaggggaagattgtgcagtacgaaaacctgaaatattcagtcatcgtgacagttcacaccggagaccagcatcaagtgggtaatgagagtactgaacacggcacgacagccaccattactccccaggcgcctagcaccgagatccagttaacagactacggggccctgaccctcgattgttctccaaggactggacttgactttaacgaaatggtcctgttgacaatgaaggagaaatcctggctagtgcataagcagtggttcctggatctcccgctgccctggacgtcaggcgcaagcaccagtcaagagacttggaatcggaaagaccttctggtaacatttaagaccgctcacgccaagaaacaggaagttgtggtcttgggttctcaggagggggctatgcacacagccctcactggcgcaaccgaaatccaaacgtccggaaccacaactattttcgccggccatctgaagtgccgtttaaaaatggataagctgaccctaaaagggatgagctatgtgatgtgtacaggatcgttcaagctcgagaaggaagtcgctgagactcagcacggtaccgtgctggttcagataaaatacgagggcacggacgcgccttgcaagatcccattttctacacaggatgaaaaaggggtgacccaaaacggacgccttattactgcaaatcccatcgtaacagacaaggagaaacctgtcaacatagaagccgagccacccttcggcgagtcctatattgtgatcggtgctggggaaaaggccttgaagctgtcatggtttaaaaagggcagtagcatcggaaaaatgttcgaggcaaccgccagaggcgctaggcggatggccattctcggggatactgcatgggactttggatccatcggtggcgttttcacctctgtggggaagctggtccatcagatttttggaacagcgtacggcgtgcttttcagcggtgtatcatggacgatgaaaatagggatcggcgtgctgttgacctggctcggactgaatagtcgatccactagcttatctatgacatgtattgctgttggcctggtcaccctatacctcggggtgatggtgcaggccgattcaggatgcgtcatcaactggaagggccgcgaactgaagtgtggtagtgggatctttgttacaaatgaggtgcacacttggaccgaacagtataaattccaagcagacagcccgaagagactttccgccgctattggaaaagcctgggaggagggcgtgtgcggtataaggtctgcaacgcggttggaaaacatcatgtggaagcagatttcgaacgagctgaatcatatcctcctggaaaacgacatgaaatttacagtagtcgtgggcgatgttgctgggattttagcccagggaaagaaaatgatccgccctcagcccatggagtacaagtatagctggaagtcctggggcaaagcgaagataatcggggccgacgtgcaaaataccactttcattatcgatggaccaaacacccctgaatgtcccgacgatcagagagcttggaatatttgggaggtcgaggactacggctttggtatcttcacaactaacatatggctgaaacttagggattcatatacccaggtgtgcgaccaccgtttgatgagtgcagccattaaggattctaaagctgttcacgccgacatggggtactggatcgaaagcgagaagaatgaaacatggaagctcgcacgggcgtccttcattgaggtgaaaacgtgtatctggccaaagtcacataccctgtggagcaacggagtactagaatctgagatgataatccccaaaatttatggcggtcctatctcccagcacaattaccgaccaggctactttactcaaacagccgggccgtggcatctgggaaagctcgagctggatttcgacctttgcgaaggcaccactgtcgtggtggatgagcactgcgggaacagaggacccagtttgaggacaaccacggtcactggcaaaattatccacgaatggtgttgccgcagctgtaccctgcctccattacggtttaagggtgaggacgggtgctggtatggaatggagataagacccgttaaggaaaaagaggaaaatctcgtgaagtctatggtatccgctggctcaggtgaggtggacagtttcagcctgggccttctgtgtatttcgatcatgatcgaagaggtcatgaggtcccgctggtctcgaaaaatgttgatgacagggaccctcgccgtgtttttcctgctaattatgggacagctgacttggaacgatctcatccggctgtgcattatggttggcgcaaatgctagcgaccgtatggggatgggaacaacctaccttgccttgatggcaacatttaagatgagacctatgttcgccgtgggcctgttatttaggcgcctcacttcacgggaggtcctgcttctgaccataggtctaagtctcgtggcttccgttgaactgccaaactctttggaggaactgggggatggattagcgatgggcatcatgattctcaaactgcttacggacttccagagccatcaactgtgggccacattgctctccctgacctttatcaagactaccttctcactacactatgcatggaagacaatggctatggtgctgagcattgtcagtctttttcccctctgtctgtctactacctcccagaaaacgacatggttgccggtactgttaggcagcctcgggtgcaagcctctgaccatgttccttatcgccgagaataaaatatggggaagaaagtcgtggccactgaacgaaggtatcatggccgtgggcattgtttcaatcttgctctctagtctgctcaagaatgatgtgcccctggctgggcctcttattgcaggaggcatgctcatcgcctgttacgtcatatccggtagctctgcggacctgagcttggagaaggctgccgaggtgtcctgggaagaggaagcagagcattcaggggccagtcacaatattttagtagaagtgcaggatgacggaactatgaaaatcaaggatgaggagagggacgatacactgaccatcctcctgaaggctactcttctggcagtcagcggcgtttatcccttgtctattccagccacactattcgtgtggtacttttggcagaaaaagaaacaacgatccggcgtgctgtgggacaccccttcacccccagaagtcgagcgcgcggtgctcgatgacgggatatatcggatcatgcagagaggactgcttggtaggagtcaggttggcgtaggggtgttccaggaaaacgtctttcatacgatgtggcacgtgactcgtggagctgttttaatgtaccaaggcaagcgcctggagccgagctgggcctccgtgaaaaaggacctcatttcttacggtgggggatggcggttgcagggctcgtggaataccggcgaggaagtccaggtgatcgcagtagagcctgggaagaaccccaaaaatgtccagacagccccaggaaccttcaagacaagcgaaggtgaggtgggcgctattgccctggattttaaacccgggacttcaggatcccctatcgttaacagagaaggcaagatagtgggtctctatgggaatggagtcgtgaccacgagtggcacatacgtttctgcaatcgctcaagccaaagcgagccaggacggcccactgcccgagattgaggatgaagtgttcaggaagcgaaaccttactatcatggacctgcaccctgggtccggaaagacccggcgctatttgccggccattgtcagagaggcaatcaaaaggaagctacggacactgatactcgctccaacccgagtggtagcctcagaaatggctgaggcattaaaaggtatgcccattagataccagactaccgccgtgaagtctgaacatacaggcaaagagatcgttgatctgatgtgccacgccacgtttactatgcgccttctgagccctgtcagggtgccaaattataacatgatcattatggacgaggctcatttcaccgatcccagttccatcgcggcacgtgggtacataagcacacgggtgggaatgggcgaagccgctgccatttttatgaccgcaactcctccgggttctgtcgaggccttcccccaatcaaatgctgtaatccaggacgaagagagagatattccagaaaggtcctggaacagtgggtatgagtggatcacagactttcctggaaagaccgtgtggttcgttcccagcataaagtcgggcaatgatattgcgaactgtctccgcaaaaatggcaagcgagtgatccagttgtctagaaaaacgttcgacactgagtaccagaagaccaagaacaacgactgggattacgtcgtgaccaccgacatctccgaaatgggggccaattttcgggcagatagggttattgacccacgccgttgcctgaagcctgtgatcctcaaggatggacccgagagagtcattctggctggtccaatgccggtgactgtagccagcgcagcccaacggaggggccgcatagggcgaaaccacaataaagaaggagaccagtatatctacatgggccagcctcttaacaatgatgaggaccatgctcactggacagaggccaagatgctactggataacattaatacccccgaaggtatcatcccagcgttgttcgagcccgaaagagagaaatcagcagccattgacggggaatatcggttaaggggcgaggctcgcaagacatttgtggagctgatgagaaggggagatctccctgtttggctgagttacaaagtcgcctctgaaggcttccagtattccgaccggcgttggtgctttgatggggagcgcaacaatcaagtgcttgaagagaacatggacgtggaaatatggactaaggagggagagaggaaaaagctgagaccaagatggctcgacgctcggacgtacagcgatcccttggcactgcgcgagttcaaggagtttgccgctggtagaaggtcagtcagtggcgacctaatcctggaaattgggaaactccctcagcaccttacccagcgggcccagaatgcactggataacttagttatgttgcataatagcgagcaaggaggccgagcgtatagacacgccatggaagaactgccggacacaatcgagactctcatgctgcttgctctgattgccgtgctcaccggtggggtaacattgttctttctgtccggccgcggattaggcaagacctctatcgggctactgtgtgtgatggcaagctccgtcctcctttggatggcttcagtggaaccacattggatagccgcatctatcattctggagttctttttgatggttctgctcatccccgaacctgataggcagcggactccccaggacaaccagctggcctacgtggtcattggacttctcttcatgatcctgacggtagctgcgaatgagatgggtttgctggagaccaccaaaaaggatttaggcatagggcacgtggccgttgaaaaccaccatcacgcagctatgctagacgtggatctgcatccagccagtgcctggactctctacgcagtcgctaccacaattatcacccctatgatgcgtcacactattgagaacacaacggccaatatctcgcttaccgcgatagctaaccaagccgcaatcctgatgggattggacaaaggctggcccattagcaagatggatatcggtgtgccactgctcgccctggggtgctattcccaggtcaatcctcttactttaacagctgcagtgctgatgctcgttgcccattacgcgattatcggcccgggattgcaggctaaggccaccagagaagcacagaaaaggaccgccgctggcataatgaagaaccccacagtggacgggattgtagccatcgatctggacccagtggtctatgacgcaaaatttgagaagcagctaggacagatcatgctgctcattctttgtacttctcagatcctgttgatgcgcacgacctgggctctgtgcgaatcaataacactcgccactggccctctgaccacattatgggagggtagccccgggaaattctggaataccactattgcggtttccatggccaacatcttccggggaagttaccttgcaggcgctggtctggccttttctctcatgaaaagcctaggcgggggacgaagaggcacgggggcacaaggagagacactgggcgaaaagtggaaaaggcagttgaatcagctgtcaaagtccgagttcaacacctataaacgcagtggtattatggaagtggatcggagcgaggctaaggaagggctcaaaagaggagagactaccaagcacgccgtctctcgtggcacagccaaacttaggtggtttgtggagcggaatctggtaaaaccagaaggtaaggtgatcgacttgggctgtgggcgcggaggctggtcctactattgcgcggggctgaaaaaggttactgaggtgaaaggatacaccaagggcggtcctgggcacgaggaacccataccgatggctacatacggatggaacctcgtcaaattacattcaggcaaggatgtgttctttatcccacctgaaaagtgtgacacgctgctttgcgatattggcgagagctcgcccaatccaaccatcgaggaagggcgaactctgagagtcctaaaaatggtggagccctggctcaggggaaaccagttctgtattaagatcctgaatccttatatgccgtctgttgtagaaacattggagcaaatgcagcggaaacacggtggcatgctggtgcgcaaccccctcagtagaaattccacccatgagatgtactgggtcagctgcgggactggaaacattgtgtcagcagttaatatgacatccaggatgcttctgaaccgatttaccatggcccaccggaagccaacgtatgaacgtgacgtggatttaggcgctggtaccagacacgtcgccgtggagcctgaagtagcaaacctggacatcatagggcagcgcattgagaatatcaaatacgaacataagtctacatggcactatgatgaggacaacccctacaagacttgggcctatcatggaagctacgaggtgaaacctagtggctccgctagctctatggttaatggcgtcgtgaagttgctcaccaaaccatgggatgtgatccccatggtcacacagattgcgatgactgacaccacacctttcgggcaacagagggtttttaaggaaaaagtggacacccggactccaaaggccaagagaggaacggcacagataatggaggtaacagctaaatggctgtggggtttcctatcacgcaacaagaaacccaggatctgtacccgagaagagtttactcggaaggtgagaagtaatgccgcaattggcgccgtcttcgtggatgaaaaccaatggaactccgctaaagaggccgttgaggacgaaaggttttgggatcttgtgcaccgcgagcgtgaactgcataagcaggggaagtgcgcgacctgcgtctacaacatgatgggaaaacgggagaagaaactcggcgagttcggtaaggcaaaagggagcagagccatctggtatatgtggctgggagctaggttcttggagtttgaggccctgggcttcatgaatgaagaccactggttttctcgcgagaactcgctctcaggcgtggaaggggagggacttcacaagctgggttacattttacgagatatcagcaaaataccgggcgggaatatgtatgcagacgatacagctggatgggacacgcggatcaccgaggatgacctgcagaacgaagccaagattactgatatcatggagcctgaacatgctttgctcgccaagtccattttcaaactgacataccagaataaggtagttagagtgcaaaggccagccaaaaacggcaccgtcatggacgtgatcagtcgcagagatcagcggggttctggacaggtgggaacttatggcctaaatacatttaccaacatggaggcgcagcttataaggcaaatggaaagcgagggcattttctccccctcagagctggaaacacctaacctcgccgggcgtgtcctggactggttggagaagcacggagttgaacgattaaaacgcatggctatcagtggtgacgattgtgtggtaaagccaatcgacgatagatttgccactgcactgaccgctctcaatgacatgggcaaggtgcggaaagatattccccagtgggagccgtctaaggggtggaacgactggcagcaggtccctttctgcagccatcactttcaccaacttataatgaaagatggaagggaaatcgtggttccctgtcgcaatcaggacgagctggtgggcagagcccgggtctcccagggtgcagggtggtcactaagggagacggcctgcctgggaaagagctacgcgcagatgtggcaactcatgtatttccatcgacgtgatttgagactggctgccaacgcaatttgttctgccgtgccagtagactgggttcctacctcccgcacaacttggagtatccacgctcatcaccagtggatgaccacagaagatatgcttagcgtgtggaatcgggtctggattgaggaaaacccctggatggaggacaaaactcatatctcgtcctgggaagacgtgccatacctgggcaagagggaggatcagtggtgcggctctctcatagggttaaccgccagagcaacgtgggctacaaatatccaagttgccattaaccaggtgcgccggctgatcggaaatgagaactacttggactatatgacctcaatgaagaggtttaaaaatgaaagcgatcccgagggtgcgctgtggtga

SEQ ID NO: 13550 - RNA, 9879 nt, synthetic construct
  misc_feature 1..9879: note = derived and/or modified CDS sequence (opt3) from DENV-1__EU660393__SS-prME
  source 1..9879: mol_type = other RNA
agcgtgaccatgctgctcatgcttatgcccacggccctggctttccacttgactacgagaggaggggaacctcatatgatcgtctccaagcaggaaagaggaaaatctttactgtttaagacctcagccggtgttaacatgtgcacactaattgccatggacctcggagaactgtgtgaagatactatgacctacaaatgcccacggataacagaaaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccggcagcttcaaactggagaaggaagtcgccgagacgcagcacggtacagtgcttgttcagataaagtacgagggcaccgacgctccttgcaaaatcccattctcgactcaagatgaaaaggggattacacagtctggacgcttgatcaccgcgaaccccatagtgactgacaaagagaagcctgtaaatattgaagcagagccaccctttggcgagtcctatatcatcattggtgccggggaaaaagctctgaagctctcatggttcaagaaaggcagtagcatcggaaagatgtttgaggccaccgcaagaggcgccaggcggatggctattctgggggatacagcctgggacttcggatccataggtggcgtctttacgtctgtggggaaacttgttcatcagatcttcggaaccgcatacggcgtgctgtttagcggtgtctcatggactatgaagattgggatcggcgtgttgctcacatggctgggattaaacagtcgatccaccagcctgtctatgacatgtatcgcggtaggcctagtgactctctacctgggggttatggtccaggctgattcaggatgcgtgattaattggaaaggccgcgaacttaagtgtggtagtgggatattcgtgaccaacgaggtccacacgtggacagaacaatataagtttcaggccgacagcccgaaaagattgtccgcagccatcggaaaggcttgggaggagggcgtttgcggtattaggtctgccacccggctggaaaatatcatgtggaaacagatttcgaacgagctcaaccatatcctgttagaaaatgacatgaagttcactgtggtggtaggcgatgtcgcagggatactggctcagggcaaaaagatgatccgccctcaacccatggagtacaaatatagctggaagtcctggggcaaggccaaaattatcggggcggacgtgcagaacaccacatttattatcgatggaccaaatactcctgaatgtcccgacgatcagagagcctggaacatatgggaggttgaggactacggcttcggtatttttaccacaaatatctggcttaagttgagggattcatatacacaggtgtgcgaccaccgtctcatgagtgctgcaattaaagattctaaggccgtccacgctgacatggggtactggatcgaaagcgagaaaaacgaaacctggaagctggcccgggcatccttcatagaggtgaagacttgtatctggccaaaatcacatacactatggagcaatggagttctggaatctgagatgattatccccaagatttatggcggtcctatctcccaacacaactaccgaccaggctacttcacccagactgcggggccgtggcatctcggaaaactggagcttgattttgacttgtgcgaaggcacaaccgtggtagtcgatgagcactgcgggaatagaggacccagtctgaggacgactaccgtgacaggcaagataattcacgaatggtgttgccgcagctgtaccttacctccactccggttcagaggtgaggacgggtgctggtatggaatggagatcaggcccgtgaaagaaaaggaggaaaacctggtcaagtctatggtttccgccggctcaggtgaggtggacagttttagccttggcctgttgtgtatctcgattatgatcgaagaggtaatgcgctcccgatggtctcggaaaatgctcatgactgggacactggctgtgttctttctactgattatgggacagctcacctggaatgatctgatacgtctttgcatcatggtcggcgccaacgcaagcgacagaatggggatgggaacaacttacttggctctgatggccaccttcaagatgaggcctatgtttgcagtgggcttactcttccgccggctgacgtcaagagaggttcttctgctaacaattggtctcagtctggtggcctccgtcgaattgccaaattctctggaggaattaggggatggactcgctatgggcatcatgattctgaaacttctgaccgactttcaaagccatcagttgtgggcgactctcctgtccctaaccttcatcaagacaactttttcactgcactatgcctggaaaaccatggcaatggtgcttagcatagttagtctcttccccctgtgtttgtctacgacatcccagaagaccacttggctgccggtgttactcggcagcctggggtgcaagcctcttacaatgtttctgatcgctgagaacaaaatttggggaaggcgatcgtggccattgaatgaaggtatcatggccgtcggcattgtatcaatcctcctgtctagtctactgaagaacgatgtgccccttgccgggcctctcatagctggaggcatgctgattgcatgttacgttatctccggtagctctgccgacttgagcttagagaaagcggctgaggtgtcctgggaagaggaagccgagcattcaggggcaagtcacaacatcctggtcgaagtgcaggatgacggaaccatgaagattaaagatgaggagcgcgacgatactctcacaatactgcttaaggccaccctgttggctgtaagcggcgtgtatcccctatctatcccagcaacgctgttcgtctggtacttctggcagaaaaagaagcagcggtccggcgttctctgggacactccttcacccccagaagtggagagagccgtgctggatgacgggatttataggatcatgcagcgtggacttttaggtcgcagtcaggtcggcgtgggggtttttcaagaaaatgtattccataccatgtggcacgtgacacggggagcggtcctgatgtaccagggcaaaagactcgagccgagctgggcttccgtgaagaaagacttgatttcttacggtgggggatggaggctgcagggctcgtggaacaccggcgaggaagttcaggtgatcgccgtcgagcctgggaagaatcccaaaaacgtgcaaacagcaccaggaacttttaagacccccgaaggtgaggtaggcgccatagctctcgatttcaagcctgggacgagcggatcaccaatcgtcaatcgagaaggcaaaattgtgggtctgtatgggaacggagttgtgacaacttccggcacctacgtcagtgccatcgcacaggctaaggcctctcaggagggcccccttcctgagattgaagacgaggtgtttcggaaacgcaatctgacaatcatggatttgcacccggggagcggaaagaccagaaggtatctaccagcgatagttcgggaagccattaaacgaaagctgagaactctcatcttagcacccacccgcgtggtcgcttccgagatggccgaagctctgaagggtatgcctatcaggtaccaaacaacggcagtgaaatcagagcatactggcaaggagattgtagaccttatgtgccacgccaccttcacaatgcgtctgctctctccagtgcgggttcccaactataatatgatcataatggatgaagcccattttaccgaccctagcagtattgctgcgagagggtacatctccactagggtcggaatgggcgaggcagccgctattttcatgacagccaccccgcccggtagcgtggaagcatttccacagtctaacgccgtgatccaggatgaggaacgcgacatacctgagcgatcatggaactccgggtatgagtggattacggatttccccggaaaaactgtctggtttgtaccaagtatcaagagcggcaacgacatcgctaattgtttgaggaaaaatggcaagcgggtgattcagctgtcgaggaagacattcgataccgaataccagaaaaccaagaataacgactgggactacgttgtgactacagatatctctgagatgggggcgaacttccgcgccgaccgtgtcattgatcctagacggtgcctcaaacccgtgatactgaaggacggaccagaaagggttatccttgcaggtccgatgcctgtgaccgtcgcttccgccgcacagcgccgaggcagaattgggcggaatcacaacaaagagggagatcagtatatctacatgggccagcccctaaataacgacgaggatcatgcccactggacagaagctaagatgctgttggacaatatcaacactccagagggtattatacccgccttatttgaacctgagagggaaaagagcgcggcaatcgatggggagtatcgcctgagaggcgaggccaggaaaacgttcgtggaactcatgcggcgtggagacctgccagtatggctttcatacaaggtggctagtgagggctttcaatattctgatcgccgatggtgcttcgacggggaaagaaataaccaggttctggaggaaaatatggatgtcgagatttggaccaaagagggagaaaggaagaaactccggccccgctggttggacgccagaacatactccgaccctctggctctaagggagtttaaggagttcgcagccggtcggcgaagcgtgtcaggcgatctgatcctcgagattgggaaacttccgcagcacctgactcagagagctcaaaacgccttagacaatttggtgatgctgcataacagtgaacagggaggccgcgcatataggcacgcgatggaggagctcccagataccatcgaaacactgatgcttctggccctcatagctgtcttgaccggtggggttactctgtttttcttaagcggccggggactaggcaagacgtccatcgggctgctctgtgtgatggcctctagcgtacttctgtggatggcatccgtggagccccattggattgctgcctcaatcattttggaatttttcctgatggtcctcctgatccctgagcccgaccgtcagagaaccccacaggataatcaacttgcatacgtggttataggactcctgtttatgattttgacagtggccgctaacgagatgggtctgttagaaactaccaagaaagacctaggcatcgggcacgtcgcggtagagaatcaccatcacgccgcaatgctggatgtggacctccatcctgcttctgcctggacactttacgccgttgcaaccactattatcacacccatgatgaggcacacgatagaaaacaccactgctaacatcagtctgacagccattgcgaatcaggctgccatcttgatgggactggataagggctggccaatttcgaaaatggacatcggtgtgcctctcctggcacttgggtgctatagccaggtcaacccgttaaccctgaccgccgctgtgctcatgttggtcgcacattacgccataattggccccggactgcaagcgaaggctacacgcgaggcccagaaacggactgcagccggcatcatgaagaatccaacggtggatgggatcgttgctattgacctagatcctgtggtatatgacgccaagttcgaaaaacagctgggacagatcatgctccttatactgtgtacctcccaaattttgctgatgcgaacaacttgggcactctgcgagtctatcaccctggctacaggccccttaaccactctttgggagggttcaccagggaagttttggaacacgacaattgccgtgagcatggcgaatatcttcagaggatcctacctggccggcgcaggtctcgctttcagtctaatgaaatctctgggcgggggaaggcgcggcaccggggcccagggagaaactttgggcgagaagtggaaacggcagctgaaccagctcagcaagtcagaatttaatacctatagacgttccggtataatggaggtcgacaggagtgaagcaaaggaggggcttaaacggggagagacaactaagcacgctgttagccgcggcaccgccaaactgcgatggttcgtggaaagaaacttggtcaagcctgagggtaaagtgatcgatctgggctgtgggaggggaggctggtcttactattgcgccgggctcaagaaggtaacagaagtgaaaggatacacgaagggcggtcccgggcacgaggaaccgattccaatggcgacctacggatggaatttagttaaactgcattccggcaaggacgtgtttttcatccctcccgagaaatgtgatactcttctgtgcgacattggcgagtcaagcccaaaccccacaatcgaagaggggcggaccctacgcgtcctcaagatggtggaaccttggctgagaggaaatcaattttgtattaaaatcttgaacccgtatatgccctcggtcgtggagactctggagcagatgcagaggaagcacggtggcatgctcgttcgaaatccactttctcggaacagtacacatgaaatgtactgggtatcctgcgggaccggaaatatagtgagcgctgtcaacatgacgtcacgtatgctgttaaatagattcaccatggcacaccgcaagcctacatatgagagggatgtggacctgggcgccggtactcggcacgttgctgtggaacccgaggtcgccaacttggatattatcgggcagagaatcgaaaacattaaacatgagcacaagtccacctggcattacgacgaggataatccttataaaacatgggcataccacggatcttatgaagtgaagccaagcggcagtgcctccagcatggtaaacggcgtggttaaactcctgactaagccctgggacgtcatacctatggtgacccaaatcgctatgacagataccactccatttgggcagcagcgcgtgttcaaggagaaagtcgacacgaggacacccaaggcgaaacgaggaaccgcccaaattatggaagttactgcaaagtggctatggggttttctttctcggaataaaaagccgagaatctgtaccagggaggagttcacacgcaaggtgcgttcaaacgctgccattggcgcagtatttgtggacgagaatcagtggaacagtgccaaagaggctgtcgaagatgagcggttctgggacctggtgcatagagaaagggagctccacaagcaggggaaatgcgccacgtgcgtttacaatatgatgggaaagcgcgagaaaaagctgggcgagtttggtaaggcgaaagggtcccgagcaatctggtacatgtggttgggagcccggttcctggagttcgaagctctcggctttatgaacgaggatcactggttcagcagagaaaattctctttcgggcgtggagggggagggactgcataagttaggttatatactgagggacatctcaaaaattcctggcgggaacatgtacgccgatgacaccgcaggatgggatactcgcatcacagaagacgatttgcagaatgaggctagaattaccgacatcatggaaccagagcacgccctcctggctaagagcatatttaaactaacttatcaaaacaaggtcgtgcgggtacagaggcccgccaaaaatggcacagttatggatgtgatttcccgtcgagaccagcgcggtagtgggcaggtcggaacctacggccttaacacattcactaatatggaagcacaactgatcagacagatggagtctgagggcatctttagcccttccgaactcgagaccccaaacctggcggaacgggtgttggattggttagagaagtatggggtggaaaggctgaagcgcatggccatttcaggagacgactgtgtcgttaaacccatagatgacagattcgctacggccctcaccgcacttaacgatatgggtaaggtgcggaaagacatcccgcagtgggagcctagtaagggctggaatgattggcagcaagtacccttttgctctcatcacttccaccagctgattatgaaagacgggagggagatcgtggtcccatgtcgaaaccaggatgagctagtgggacgtgctagagttagccagggcgccggttggtccctgcgcgagacagcatgcctcgggaagtcatacgcccaaatgtggcagttgatgtattttcatcggagggacctgagacttgcggctaatgccatttgtagcgcagtgcctgtcgattggatccccacttctcgcaccacatggtccatacacgcccatcaccagtggatgactaccgaagacatgctgagtgtgtggaaccgggtatggatcgaggaaaatccatggatggaggataagacgcatattagctcgtggggagacgttccctacctcggcaaaagggaggaccaatggtgcggctccttaatcgggctgacagctcgagccacctgggcaactaacattcaggtggctatcaatcaggtcagacggttgattggaaacgaaaattacctggattatatgacatctatgaagaggttcaaaaacgagtcagaccctgaaggtgccctctggtga

SEQ ID NO: 13551 - RNA, 9879 nt, synthetic construct
  misc_feature 1..9879: note = derived and/or modified CDS sequence (opt3) from DENV-1__EU660401__SS-prME
  source 1..9879: mol_type = other RNA
agcgtgaccatgctgctcatgcttatgcccacagccctggctttccacttgactacgagaggaggggaacctcatatgatcgtctccaagcaggaaagaggaaaatctttactgtttaagacctcagccggtgttaatatgtgcacactaattgccatggacctcggcgaactgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccgggtcgttcaaactggagaaggaagtcgccgagacgcagcacggtacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattatcatcggtgccggggaaaaagctctgaagctctcctggttcaagaaaggctcaagtattggaaagatgtttgaggccaccgcaagaggcgccaggcggatggctatcctgggggatacagcctgggacttcggaagcattggtggcgtgtttacgtccgttgggaaacttgtgcatcagatattcggaaccgcatacggcgtcctgttttctggtgtgagctggactatgaagatcgggattggcgtattgctcacatggctgggattaaattcacgaagtacctccctgagcatgacatgtatcgcggtgggcctagttactctctacctgggggtcatggtgcaggctgattctggatgcgtgatcaactggaaaggccgcgaacttaagtgtggttcagggattttcgtcaccaatgaggttcacacgtggacagaacaatataagtttcaggccgacagtccgaaaagattgagcgcagccataggaaaggcttgggaggagggcgtgtgcggtatcaggtccgccacccggctggaaaacattatgtggaaacagatctctaacgagctcaatcatattctgttagaaaacgacatgaagttcactgtggtagtcggcgatgtggcagggatcctggctcagggcaaaaagatgatacgccctcaacccatggagtacaaatattcgtggaaaagctggggcaaggccaagatcattggggcggacgttcagaataccacatttatcattgatggaccaaacactcctgaatgtcccgacgatcagagagcctggaatatctgggaggtggaggactacggcttcggtatatttaccacaaacatttggcttaagttgagggattcccacacgcaggtctgcgaccaccgtctcatgtcagctgcaatcaaagatagtaaggccgtgcatgctgacatggggtattggattgaatctgagaaaaatgaaacctggaagctggcccgggcatccttcatcgaggttaagacttgtatatggccaaaatcccacacactatggtcaaacggagtgctggaaagcgagatgatcattcccaagatctacggcggtcctatttctcaacataattatcgaccaggctacttcacccagactgcggggccgtggcacctcggaaaactggagcttgattttgacttgtgcgaaggcacaaccgtagtcgtggatgagcactgcgggaacagaggaccctccctgaggacgactaccgtgacaggcaagatcatacatgaatggtgttgccgcagttgtaccttacctccactccggttcagaggtgaggacgggtgctggtacggaatggagattaggcccgtcaaagaaaaggaggaaaatctggttaagagcatggtgtctgccggctccggtgaggtagactcatttagtcttggcctgttgtgtatcagcatcatgattgaagaggtgatgcgctcgcgatggtcccggaaaatgctcatgactgggacactggctgtcttctttctactgatcatgggacagctcacctggaacgatctgattcgtctttgcataatggtgggcgccaatgcatctgacagaatggggatgggaacaacttatttggctctgatggccaccttcaagatgaggcctatgtttgcagttggcttactcttccgccggctgacgagcagagaggtgcttctgctaacaatcggtctctcactggtcgccagtgtggaattgccaaactccctggaggaattaggggatggactcgctatgggcattatgatcctgaaacttctgaccgactttcaatctcaccagttgtgggcgactctcctgagcctaaccttcattaagacaactttttccctgcattacgcctggaaaaccatggcaatggttctttcaatcgtgagcctcttccccctgtgtttgagtacgacatctcagaagaccacttggctgccggtcttactcggctccctggggtgcaagcctcttacaatgtttctgatagctgagaataaaatctggggaaggcgaagctggccattgaacgaaggtattatggccgtaggcatcgtgtcgattctcctgtcatctctactgaagaacgatgttccccttgccgggcctctcatcgctggaggcatgctgatagcatgttatgtgattagtggttccagcgccgacttgtctttagagaaagcggctgaggtcagctgggaagaggaagccgagcactccggggcatcacataatatcctggtggaagtacaggatgacggaaccatgaagatcaaagatgaggagcgcgacgatactctcacaattctgcttaaggccaccctgttggctgtgagtggcgtctaccccctaagcataccagcaacgctgttcgtttggtatttctggcagaaaaagaagcagcggtctggcgtgctctgggacactccttcacccccagaagtggagagagccgtcctggatgacgggatctacaggattatgcagcgtggacttttaggtcgcagccaggtgggcgttggggtatttcaagaaaacgtgttccacaccatgtggcacgtcacacggggagcggtgctgatgtatcagggcaaaagactcgagccgagttgggctagcgttaagaaagacttgatctcctacggtgggggatggaggctgcagggctcttggaataccggcgaggaagtgcaggtcattgccgtggagcctgggaagaaccccaaaaatgtacaaacagcaccaggaacttttaagacccccgaaggtgaggtcggcgccatcgctctcgatttcaagcctgggacgtcgggaagcccaatagtgaaccgagaaggcaaaatcgttggtctgtacgggaatggagtggtcacaacttcaggcacctatgtgtccgccattgcacaggctaaggccagtcaggagggcccccttcctgagatcgaagacgaggtttttcggaaacgcaacctgacaattatggatttgcatccggggtctggaaagaccagaaggtacctaccagcgatcgtgcgggaagccataaaacgaaagctgagaactctcattttagcacccacccgcgtcgtggctagcgagatggccgaagctctgaagggtatgcctatcaggtatcaaacaacggcagtaaaatccgagcacactggcaaggagatcgtggaccttatgtgccatgccaccttcacaatgcgtctgctctcaccagttcgggtccccaattacaacatgattatcatggatgaagcccactttaccgacccttctagcatagctgcgagagggtatattagtactagggtgggaatgggcgaggcagccgctatcttcatgacagccaccccgcccggttccgtggaagcatttccacagagcaatgccgtcattcaggatgaggaacgcgacatccctgagcgatcttggaactcagggtacgagtggataacggatttccccggaaaaactgtatggtttgtgccatccattaagagtggcaatgacatcgctaactgtttgaggaaaaatggcaagcgggttatccagctgagcaggaagacattcgataccgaatatcagaaaaccaagaacaacgactgggactacgtggtcactacagatatttcggagatgggggcgaatttccgcgccgaccgtgtgatcgatcctagacggtgcctcaaacccgttattctgaaggacggaccagaaagggtgatacttgcaggtccgatgcctgtcaccgtggcttctgccgcacagcgccgaggcagaatcgggcggaaccataataaagagggagatcagtacatttatatgggccagcccctaaacaatgacgaggatcacgcccactggacagaagctaagatgctgttggacaacatcaatactccagagggtatcattcccgccttatttgaacctgagagggaaaagtccgcggcaatagatggggagtaccgcctgagaggcgaggccaggaaaacgttcgtagaactcatgcggcgtggagacctgccagtgtggcttagctataaggttgcttcagagggctttcaatacagtgatcgccgatggtgcttcgacggggaaagaaacaatcaggtcctggaggaaaacatggatgtggagatctggaccaaagagggagaaaggaagaaactccggccccgctggttggacgccagaacatattctgaccctctggctctaagggagtttaaggagttcgcagccggtcggcgatccgtgagcggcgatctgattctcgagatcgggaaacttccgcagcatctgactcagagagctcaaaatgccttagacaacttggtcatgctgcacaattcagaacagggaggccgcgcatacaggcatgcgatggaggagctcccagataccattgaaacactgatgcttctggccctcatcgctgttttgaccggtggggtgactctgtttttcttaagtggccggggactaggcaagacgagcatagggctgctctgtgtaatggcctcctctgtgcttctgtggatggcaagcgtcgagccccactggatcgctgcctccattatcttggaatttttcctgatggtgctcctgattcctgagcccgaccgtcagagaaccccacaggataaccaacttgcatatgttgtgatcggactcctgtttatgatattgacagtcgccgctaatgagatgggtctgttagaaactaccaagaaagacctaggcattgggcacgtagcggtggagaaccatcaccatgccgcaatgctggatgttgacctccaccctgcttcagcctggacactttacgccgtggcaaccactatcattacacccatgatgaggcatacgatcgaaaacaccactgctaatatatctctgacagccatcgcgaaccaggctgccattttgatgggactggataagggctggccaatcagtaaaatggacattggtgtccctctcctggcacttgggtgctacagccaggtgaatccgttaaccctgaccgccgctgtcctcatgttggtggcacactatgccatcataggccccggactgcaagcgaaggctacacgcgaggcccagaaacggactgcagccggcattatgaagaacccaacggttgatgggatcgtggctatcgacctagatcctgtagtgtacgacgccaagttcgaaaaacagctgggacagattatgctccttatcctgtgtaccagccaaatattgctgatgcgaacaacttgggcactctgcgagtccattaccctggctacaggccccttaaccactctttgggagggttctccagggaagttttggaatacgacaatcgccgtctcaatggcgaacattttcagaggaagctatctggccggcgcaggtctcgctttctccctaatgaaaagtctgggcgggggaaggcgcggcaccggggcccagggagaaactttgggcgagaagtggaaacggcagctgaatcagctctctaagagcgaatttaacacctacaagagatcaggtatcatggaggttgaccgttccgaagcaaaagaggggcttaagaggggagagacaactaaacacgctgtgagtcggggcaccgccaagctgcgctggttcgtcgaacgaaatttggtgaaacctgagggtaaggtaatagatctgggctgtgggagaggaggctggagctattactgcgccgggctcaagaaagtgacagaagttaagggatatacgaaaggcggtcccgggcatgaggaaccgatcccaatggcgacctacggatggaacttagtgaagctgcactctggcaaagacgtctttttcattcctcccgagaagtgtgatactcttctgtgcgacatcggcgagtcctcaccaaatcccacaattgaagaggggaggaccctacgggtgctcaaaatggtcgaaccttggctgcgcggaaaccaattttgtatcaagattttgaatccgtacatgcccagcgtggttgagactctggagcagatgcagagaaagcatggtggcatgctcgtaaggaacccactttcgcgaaattctacacacgaaatgtattgggtgagttgcgggaccggaaacatcgtctccgctgtgaatatgacgagccggatgctgttaaaccgtttcaccatggcacacagaaaacctacatacgagcgcgatgttgacctgggcgccggtactaggcatgtggctgtcgaacccgaggtggccaacttggatataattgggcagcggatcgaaaatatcaagcacgagcataaatcaacctggcactatgacgaggataacccttacaagacatgggcatatcatggatcctacgaagtaaaaccatctggcagcgccagttccatggtgaatggcgttgtcaagctcctgactaagccctgggacgtgattcctatggtgacccaaatagctatgacagataccactccatttgggcagcagagagtcttcaaagagaaggttgacacgcgcacacccaaagcgaagaggggaaccgcccaaatcatggaagtgactgcaaaatggctatggggttttcttagccgaaacaagaagccgcggatttgtaccagagaggagttcacaaggaaagtacgctctaatgctgccatcggcgcagtgtttgtcgacgagaaccagtggaactcagccaaggaggctgtggaagatgagcgtttctgggacctggttcaccgggaaagagagctccacaaacaggggaagtgcgccacgtgcgtgtataacatgatgggaaaaagggaaaagaagctgggcgagtttggtaaagcgaaggggagtcgcgcaatttggtacatgtggttgggagcccgattcctggagttcgaagctctcggctttatgaatgaggatcattggttctcccgggaaaacagcctttctggcgtcgagggggagggactgcacaaattaggttacatcctgagagacatatcgaagatccctggcgggaatatgtatgccgatgacaccgcaggatgggatactaggattacagaagacgatttgcagaacgaggctcgcatcaccgacattatggaaccagagcatgccctcctggctaaatcaatctttaagctaacttaccaaaataaagtggtaagagttcagcggcccgccaagaacggcacagtgatggatgtcataagcaggcgtgaccagcgaggttccggacaggtgggaacctatggccttaatacattcactaacatggaagcacaactgattcgccagatggagagtgagggcatcttttctcctagcgaactcgagaccccaaacctggcggaaagagtgttggattggttagagaagtacggggtcgaacggctgaaaaggatggccatctccggagacgactgtgttgtgaagcccattgatgaccgcttcgctacggccctcaccgcacttaatgatatgggtaaagtaagaaaggacataccgcagtgggagccttcaaaaggctggaacgattggcagcaagtgcccttttgcagtcaccacttccatcagctgatcatgaaggacgggcgggagattgtcgtgccatgtaggaatcaggatgagctagttggacgagctcgtgtgtctcagggcgccggttggagcctgagagagacagcatgcctcgggaagtcctatgcccaaatgtggcagttgatgtactttcaccgccgggacctgaggcttgcggctaacgccatctgttcagcagtccctgtggattggattcccactagcagaaccacatggtctatccatgcccaccatcagtggatgactaccgaagacatgctgtccgtatggaatcgcgtttggatagaggaaaacccatggatggaggataaaacgcacatcagtagctggggagacgtgccctatctcggcaagcgggaggaccaatggtgcggctcgttaattgggctgacagctagggccacctgggcaactaatatccaggtcgctattaaccaggtgcgaagattgatcggaaatgaaaactacctggattacatgacatccatgaaacggttcaagaatgagggtgaccctgaaggcgccctctggtga

SEQ ID NO: 13552 - RNA, 9879 nt, synthetic construct
  misc_feature 1..9879: note = derived and/or modified CDS sequence (opt3) from DENV-1__FJ373305__SS-prME
  source 1..9879: mol_type = other RNA
agcgtgaccatgctgctcatgcttatgcccacagccctggctttccacttgactacgagaggaggggaacctcatatgatcgtctccaagcaggaaagagggaaatctttactgtttaagacctcagccggtgttaatatgtgcacactaattgccatggacctcggagagctgtgtgaagatactatgacctacaaatgcccacggataacagagaccgaaccggacgatgtggactgttggtgcaatgcgactgatacatgggtaacctatgggacgtgtagtcaaactggggagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccggcagcttcaaactggagaaggaagtcgccgagacgcagcacggtacagtgcttgttcagataaagtacgagggcaccgacgctccttgcaaaatcccattcttgactcaagatgaaaagggggtgacacagaacggacgcctgattaccgcgaatcccatcgtaactgacaaagagaagcctgtcaacatagaagcagagccaccctttggcgagtcgtatattatcatcggtgccggggaaaaagctctcaagctgtcttggttcaagaaaggctcctcaattggaaagatgtttgaggccaccgcaagaggcgccaggcggatggctatccttggggatacagcctgggacttcggaagtattggtggcgtgtttacgagcgttgggaaactggtgcatcagatattcggaaccgcatacggcgtcttgttttccggtgtgtcttggactatgaagatcgggattggcgtactcctgacatggttaggactgaatagccgatcaaccagtctatccatgacatgtatcgcggtgggcctcgttactctgtaccttggggtcatggtgcaggctgatagcggatgcgtgatcaactggaaaggccgcgaattgaagtgtggttctgggattttcgtcaccaatgaggttcacacgtggacagaacaatataagtttcaggccgactcaccgaaaagactgagtgcagccataggaaaggcttgggaggagggcgtgtgcggtatcaggagcgccacccggctcgaaaacattatgtggaaacagatctccaacgagctgaatcatattttactggaaaacgacatgaagttcactgtggtagtcggcgatgtggcagggatccttgctcagggcaagaagatgatacgccctcaacccatggagtacaaatattcttggaagtcgtggggcaaggccaaaatcattggggcggacgttcagaataccacatttatcattgatggaccaaacactcctgaatgtcccgacgatcagagagcctggaatatctgggaggtggaggactacggcttcggtatatttaccacaaacatttggttgaagctcagggatagctatacgcaggtctgcgaccaccgtctgatgtccgctgcaatcaaagattcaaaggccgtgcacgctgacatggggtactggattgaaagtgagaaaaatgaaacctggaagctagcccgggcatctttcatcgaggttaagacttgtatatggccaaaaagccatacactgtggtccaacggagtgctcgaatcagagatgatcattcccaagatctatggcggtcctattagccaacacaattaccgaccaggctacttcacccagactgcggggccgtggcatctgggaaaacttgagttggattttgacctgtgcgaaggcacaaccgtagtcgtggatgagcactgcgggaacagaggaccctctttaaggacgactaccgtgacaggcaagatcatacacgaatggtgttgccgctcctgtaccctccctccactgcggttcagaggtgaggacgggtgctggtatggaatggagattaggcccgtcaaagaaaaggaggaaaatcttgttaagagtatggtgagcgccggctctggtgaggtagactccttttcactgggcttgctctgtatcagtatcattatcgaagaggtgatgcgcagccgatggtcgcggaaaatgctgatgactgggacactagctgtcttctttctgctcattatgggacagctgacctggaacgatcttatacgtttgtgcatcatggtgggcgccaatgcatccgacagaatggggatgggaacaacttacctggctttaatggccaccttcaagatgaggcctatgtttgcagttggcctcctgttccgccggcttacgtctagagaggtgctgctactcacaattggtctgagcttggtcgcctcagtggaactgccaaacagtttagaggaactcggggatggactggctatgggcatcatgattcttaaactgttgaccgactttcaatcccatcagctctgggcgactctgctatctctgaccttcatcaagacaactgttagccttcactatgcctggaaaaccatggcaatggtgctctccatagtctcactgtttcccttgtgtctgagcacgacaagtcagaagaccacttggttaccggtactcctgggctctcttgggtgcaagcctctgacaatgttcttgatcgctgagaataaaatttggggaaggcgatcctggccactcaacgaaggtatcatggccgtgggcattgttagcatcctgctatcgtcactgcttaagaacgatgtgcccctcgccgggcctctgatagctggaggcatgttgattgcatgttacgtcatctctggtagttccgccgacttaagcctggagaaagcggctgaggtgtcttgggaagaggaagccgagcatagcggggcatcccacaatatcctcgtagaagtgcaggatgacggaaccatgaagattaaagatgaggagcgcgacgatactctgacaatacttctgaaggccaccttgctagctgtctcaggcgtttatcccctgagtatcccagcaacgctctttgtgtggtacttctggcagaagaagaagcagcggagcggcgtgctgtgggacactccttctcccccagaagtcgagagagccgtgcttgatgacgggatttataggatcatgcagcgtggattactgggtcgctcccaggttggcgtaggggtgttccaagaaaacgtctttcataccatgtggcacgtgacacggggagcggttctcatgtaccagggcaaaagattggagccgtcatgggctagtgtgaagaaagacctgattagctacggtgggggatggaggctccagggctcctggaataccggcgaggaagtccaggtgatcgccgtagagcctgggaagaaccccaaaaatgtccaaacagcaccaggaactttcaagacccccgaaggtgaggtgggcgccatagctctggattttaagcctgggacgtctggatcgccaatcgttaaccgagaaggcaaaattgtgggtctttatgggaatggagtcgtgacaactagcggcacctacgtttcagccatcgcacaggctaaggcctcccaggagggccccctgcctgagattgaagacgaggtgttccggaaacgcaacttgacaatcatggatctacacccggggagtggaaagaccagaaggtatctgccagcgatagtccgggaagccattaaacgaaagctcagaactttaatcctggcacccacccgcgtggtagcttctgagatggccgaagctcttaagggtatgcctatcaggtaccaaacaacggcagtgaaaagcgagcatactggcaaggagattgttgacctgatgtgccacgccacctttacaatgcgtctcttgtccccagtccgggtgcccaattataacatgatcataatggatgaagcccatttcaccgacccttcatctattgctgcgagagggtacatcagcactagggtgggaatgggcgaggcagccgctatttttatgacagccaccccgcccggtagtgtcgaagcattcccacagtccaatgccgtaatccaggatgaggaacgcgacatacctgagcgaagctggaactctgggtatgagtggattacggattttcccggaaaaactgtgtggttcgttccatcaatcaagtccggcaatgacatcgctaactgtctgaggaaaaatggcaagcgggtgattcagctcagtaggaagacatttgataccgaataccagaaaaccaagaacaacgactgggactacgtcgtgactacagatatcagcgagatgggggcgaatttccgcgccgaccgtgttattgatcctagacggtgcctgaaacccgtgatacttaaggacggaccagaaagggtcatcctagcaggtccgatgcctgtgaccgtagcttcggccgcacagcgccgaggcagaattgggcggaaccacaataaagagggagatcagtatatctacatgggccagcccctgaacaatgacgaggatcatgcccactggacagaagctaagatgttgttagacaacatcaatactccagagggtattatacccgccctgttcgaacctgagagggaaaagtctgcggcaatcgatggggagtatcgcctcagaggcgaggccaggaaaacgtttgtggaactgatgcggcgtggagaccttccagtttggctgtcctacaaggtcgctagcgagggcttccaatattcagatcgccgatggtgctttgacggggaaagaaacaatcaggtgctcgaggaaaacatggatgtggagatttggaccaaagagggagaaaggaagaaattgcggccccgctggctggacgccagaacatacagtgaccctctagctctgagggagttcaaggaatttgcagccggtcggcgatctgtctccggcgatctcatccttgagattgggaaactgccgcagcacttaactcagagagctcaaaatgccttggacaacctggttatgctccataatagcgaacagggaggccgcgcatataggcacgcgatggaggagctgccagataccatcgaaacacttatgctgctcgccttgatagctgtgctgaccggtggggtaactttattctttctatcaggccggggactgggcaagacgagtatcgggctcctttgtgtgatggccagctccgtcctgttgtggatggcatctgtggagccccattggattgctgccagcatcattctggagttctttctcatggttctgcttatccctgagcccgaccgtcagagaaccccacaggataaccaactcgcatacgtggtcataggactgttgttcatgattctgacagtagccgctaatgagatgggtttactagaaactaccaagaaagacctgggcatcgggcacgtggcggttgagaaccaccatcacgccgcaatgctcgatgtggaccttcatcctgcttccgcctggacactgtacgccgtcgcaaccactattatcacacccatgatgaggcacacgatagaaaacaccactgctaatatctcattgacagccattgcgaaccaggctgccatcctgatgggactcgataagggctggccaatttctaaaatggacatcggtgtgcctctgcttgcattagggtgctatagtcaggtcaatccgctgaccctcaccgccgctgtgttgatgctggttgcacattacgccataattggccccggactacaagcgaaggctacacgcgaggcccagaaacggactgcagccggcatcatgaagaacccaacggtggatgggatcgtagctattgacctggatcctgtggtctatgacgccaagtttgaaaaacagctcggacagatcatgcttctgatattgtgtacctcgcaaattctgctcatgcgaacaacttgggcactgtgcgagagcatcaccttagctacaggcccccttaccactctgtgggagggttccccagggaagttctggaatacgacaattgccgtttctatggcgaacatctttagaggatcatacctcgccggcgcaggtctagctttcagcctgatgaaatccttgggcgggggaaggcgcggcaccggggcccagggagaaactctgggcgagaagtggaaacggcagctcaatcagcttagtaagtctgagttcaacacctataagagaagcggtataatggaggtggaccgttcagaagcaaaagaggggctgaagaggggagagacaactaaacacgctgtctcccggggcaccgccaagttgcgctggtttgtggaacgaaatctggtaaaacctgagggtaaggtgatcgatctcggctgtgggagaggaggctggagttactattgcgccgggttaaagaaagttacagaagtgaagggatacacgaaaggcggtcccgggcacgaggaaccgattccaatggcgacctacggatggaacctggtcaaacttcatagcggcaaagacgtgttctttatccctcccgagaagtgtgatactctgctatgcgacattggcgagtcttccccaaatcccacaatcgaagaggggaggaccctccgggtcctgaaaatggtggaaccttggttgcgcggaaaccaattctgtattaagatcctgaatccgtatatgccctcagttgtagagactctcgagcagatgcagagaaagcacggtggcatgcttgtgaggaacccactgagccgaaattcgacacatgaaatgtactgggtctcttgcgggaccggaaacatagtgagtgctgttaatatgacgtcccggatgttactgaaccgttttaccatggcacacagaaaacctacatatgagcgcgatgtggacttgggcgccggtactaggcacgtcgctgtggaacccgaggtagccaacctcgatattatcgggcagcggatcgaaaatattaagcatgagcacaaaagcacctggcattacgacgaggataacccttataagacatgggcataccacggatcatatgaagtgaaaccatccggctctgccagcagtatggttaatggcgtcgtgaagctgctaactaagccctgggacgtgatacctatggtcacccaaatcgctatgacagataccactccattcgggcagcagagagtttttaaagagaaggtggacacgcgcacacccaaagcgaagaggggaaccgcccaaattatggaagtaactgcaaaatggctttggggtttcctgtcccgaaacaagaagccgcggatctgtaccagagaggaatttacaaggaaagtgcgcagcaatgctgccattggcgcagtcttcgtggacgagaaccagtggaactctgccaaggaggctgttgaagatgagcgtttttgggacctcgtgcatcgggaaagagagctgcacaaacaggggaagtgcgccacgtgcgtctacaacatgatgggaaaaagggaaaagaagttgggcgagttcggtaaagcgaaggggtcacgcgcaatctggtacatgtggctgggagcccgatttctcgagttcgaagctcttggcttcatgaatgaggatcactggtttagtcgggaaaactccctgagcggcgtggagggggagggattacataaactgggttatatattgagagacatctctaagattcctggcgggaatatgtacgccgatgacaccgcaggatgggatactaggatcacagaagacgatctccagaacgaggctcgcattaccgacatcatggaaccagagcacgccctgctagctaaatcgatattcaaacttacttatcaaaataaagtagttagagtgcagcggcccgccaagaacggcacagtcatggatgtgatttcaaggcgtgaccagcgaggtagcggacaggtgggaacctacggcctgaatacatttactaacatggaagcacaactcatccgccagatggagtccgagggcatcttcagtccttctgaactggagaccccaaacttggcggaaagagtcttagattggctggagaagtatggggttgaacggctcaaaaggatggccattagcggagacgactgtgtggtaaagcccatagatgaccgctttgctacggcccttaccgcactgaatgatatgggtaaagtgagaaaggacatcccgcagtgggagccttccaaaggctggaacgattggcagcaagtccccttctgctcacatcactttcaccagctaattatgaaggacgggcgggagatcgtggttccatgtaggaatcaggatgaactggtgggacgagctcgtgtcagtcagggcgccggttggtctctcagagagacagcatgcttgggaaagagctacgcccaaatgtggcagctgatgtatttccatcgccgggaccttaggctggcggctaacgccatttgttccgcagtgcctgtagattggatccccacttcaagaaccacatggagcatacacgcccatcaccagtggatgactaccgaagacatgctctctgtttggaatcgcgtgtggatcgaggaaaacccatggatggaggataaaacgcatatttccagttggggagacgtcccctacttaggcaagcgggaggaccaatggtgcggcagcctgatcgggttgacagctagggccacctgggcaactaatattcaggtggctatcaaccaggttcgaagactgattggaaatgaaaactacctcgattatatgacatcgatgaaacggtttaagaatgagggtgaccctgaaggcgccctttggtga

SEQ ID NO: 13553 - RNA, 9879 nt, synthetic construct
  misc_feature 1..9879: note = derived and/or modified CDS sequence (opt3) from DENV-1__EU660402__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagttctgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagagcaggacgcaaactttgtttgccgccgaacattcgtggatagaggctggggtaatgggtgtggactgtttggcaaaggctccttgataacttgcgctaagttcaagtgcgtaaccaaactcgaggggaagattgtgcagtacgaaaacctgaaatattcagtcatcgtgacagttcacaccggagaccagcatcaagtgggtaatgagagtactgaacacggcacgacagccaccattactccccaggcgcctagcaccgagatccagttaacagactacggggccctgaccctcgattgttctccaaggactggacttgactttaacgaaatggtcctgttgacaatgaaggagaaatcctggctagtgcataagcagtggttcctggatctcccgctgccctggacgtcaggcgcaagcaccagtcaagagacttggaatcggcaggaccttctggtaacatttaaaaccgctcacgccaagaagcaggaagttgtggtcttgggttctcaagagggggctatgcacacagccctcactggcgcaaccgaaatccagacgtccggaaccacaactattttcgccggccatctgaaatgccgtttaaagatggataaactgaccctaaaggggatgagctatgtgatgtgtacaggatcgttcaaactcgagaaggaagtcgctgagactcagcacggtaccgtgctggttcagataaagtacgagggcatcgacgcgccttgcaaaattccattttctacgcaagatgaaaagggggtgacacagaacggacgccttatcaccgcaaatcccatagtaactgacaaagagaagcctgtcaacattgaagccgagccacccttcggcgagtcctatatcgtgatcggtgctggggaaaaagccttgaagctgtcatggtttaagaaaggcagtagcattggaaagatgttcgaggcaacagccagaggcgctaggcggatggccatcctcggggataccgcatgggactttggatccattggtggcgttttcacttctgtggggaaactggtccatcagatatttggaaccgcgtacggcgtgcttttcagcggtgtatcatggacaatgaagatcgggattggcgtgctgttgacgtggctcggactgaatagtcgatccaccagcttatctatgacttgtatcgctgttggcctggtcacactatacctcggggtgatggtgcaggccgattcaggatgcgtcatcaactggaaaggccgcgaactgaagtgtggtagtgggatttttgttaccaatgaggtgcacacatggactgaacaatataagttccaggcagacagcccgaaaagactttccgccgctataggaaaggcctgggaggagggcgtgtgcggtatcaggtctgcaacccggttggaaaacattatgtggaaacagatctcgaacgagctgaatcatattctcctggaaaacgacatgaagttaacggtagtcgtgggcgatgttgctgggatcctggcccagggaaaaaagatgatacgccctcaacccatggagtacaaatatagctggaagatctggggcaaggcgaaaattatcggggccgacgtgcagaatacaacctttattatcgatggaccaaacactcctgaatgtcccgacgatcagagagcttggaatatatgggaggtcgaggactacggcttcggtatttttaccacaaacatctggcttaagttgagggattcctatactcaggtgtgcgaccaccgtctcatgtcagcagccattaaagatagtaaggctgttcacgccgacatggggtactggatcgaatctgagaaaaatgaaacctggaagctggcacgggcgagcttcatagaggtgaagacatgtatctggccaaaatcccatacgctatggtcaaacggagtactggaaagcgagatgattatccccaagatttatggcggtcctatctctcaacacaattaccgaccaggctacttcacccagactgccgggccgtggcatctcggaaaactggagcttgattttgacttgtgcgaaggcacaaccgtcgtggtggatgagcactgcgggaacagaggaccctccctgaggactacaaccgtcacgggcaagataattcacgaatggtgttgccgcagttgtactttacctccactccggttcaaaggtgaggacgggtgctggtatggaatggagatcagacccgttaaggaaaaggaggaaaatctggtgaaaagcatggtatctgctggctccggtgaggtggactcatttagtcttggcctgttgtgtatcagcattatgatcgaagaggtcatgaggtcgcgctggtcccgaaagatgctcatgaccgggacactggccgtgttctttctactgattatgggacagctcacctggaacgatctgatacggctttgcatcatggttggcgcaaatgcttacgaccgtatggggatgggaactacatatttggccctgatggcaaccttcaaaatgagacctatgtttgccgtgggcttactcttcaggcgcctgacatctcgggaggtccttctgctaactattggtctcagcctggtggcttcagttgaattgccaaacagtctggaggaattaggggatggactcgcgatgggcatcatgattctgaagcttctgaccgactttcaatcccatcagttgtgggccacgctcctgtctctaacattcatcagaaccacttttagcctgcactacgcatggaaaaccatggctatggtgctttccatagtctcactcttccccctgtgtttgagcacaactagtcagaagaccacgtggctgccggtattactcggctctctggggtgcaagcctcttacaatgtttctgatcgccgagaataaaatttggggaaggaagtcctggccattgaacgaaggtatcatggccgtgggcattgttagcatcctcctgtcgtcactactgaaaaacgatgtgccccttgctgggcctctcatagcaggaggcatgctgattgcctgttatgtcatctctggtagttccgcggacttgagcttagagaaggctgccgaggtgtcttgggaagaggaagcagagcatagcggggcctcccacaatatcctggtagaagtgcaggatgacggaaccatgaaaattaaggatgaggagcgagacgatactctcacaatactgcttaaagctaccctgttggcagtctcaggcgtttaccccctaagtatcccagccactctgttcgtgtggtatttctggcaaaagaagaaacagcgcagcggcgtgctctgggacacaccttctcccccagaagtcgagcgggcggtgctggatgacgggatttacagaatcatgcagaggggacttttaggtcgttcccaggttggcgtaggggtgtttcaagaaaacgtcttccataccatgtggcacgtgacgcgcggagctgttctgatgtaccagggcaagcggctcgagccgtcatgggccagtgtgaaaaaggacttgattagctatggtgggggatggagactgcagggctcctggaatactggcgaggaagtccaggtgatcgcagtagagcctgggaaaaaccccaagaatgtccaaaccgccccaggaacatttaagacctctgaaggtgaggtgggcgctatagccctcgatttcaaacccgggacatcgggaagccctatcgttaacagggaaggcaagattgtgggtctgtacgggaatggagtcgtgactacctcaggcacgtatgtttccgcaatcgctcaggccaaagcgagtcaggagggcccacttcccgagattgaagacgaggtgtttcgaaagcggaacctgacaatcatggatttgcaccctgggtctggaaaaactcgcagatacctaccggccatagtcagggaagcaattaagcggcgactgagaaccctcatcttagctccaacacgcgtggtagccagcgagatggctgaagcactgaagggtatgcccatcaggtatcaaaccactgccgtgaaatccgagcataccggcaaggagattgttgaccttatgtgccacgccacattcacgatgcgtctgctctcacctgtccgggtgccaaattacaacatgatcataatggatgaagctcattttactgacccctctagcattgcggcaagagggtatatcagtaccagggtgggaatgggcgaggccgctgccattttcatgacagcaacccctccgggttccgtcgaagcctttccccagagcaatgctgtaatccaggatgaggaacgcgacataccagagcgatcttggaactcagggtacgagtggattactgatttccctggaaaaacagtgtggtttgttccctccatcaagagtggcaatgacatcgcgaactgtttgagaaaaaatggcaagcgggtgattcagctgagcaggaagaccttcgatacggaataccaaaaaactaagaacaacgactgggactatgtcgtgacaaccgatatctcggagatgggggccaatttccgcgcagaccgtgttattgatccaagacggtgcctcaaacctgtgatactgaaggacggacccgaaagggtcatccttgctggtccaatgccggtgaccgtagcctctgcagcccagcgccgaggcagaattgggcggaaccacaataaagagggagatcagtacatctatatgggccagcctctaaacaatgacgaggatcatgctcactggactgaagccaagatgctgttggacaacatcaatacacccgagggtattataccagcgttatttgaacccgagagggaaaagtccgcagccatcgatggggagtaccgcctgagaggcgaggctaggaaaaccttcgtggaactcatgcggcgtggagacctgcctgtttggcttagccacaaggtcgcctcagagggctttcaatatagtgatcgccgatggtgcttcgacggggaaagaaacaatcaggtgctggaggaaaacatggatgtggagatttggacaaaagagggagaaaggaagaaactccggccacgctggttggacgctagaacttactctgaccccctggcactaagggagtttaaggaattcgccgctggtcggcgatccgtcagcggcgatctgatcctcgagattgggaaacttcctcagcatctgacgcagagagcccaaaatgcattagacaacttggttatgctgcacaattcagaacagggaggccgcgcgtataggcatgccatggaggagctcccggataccatcgaaacactgatgcttctggctctcatagccgtgttgactggtggggtaatgctgtttttcttaagtggccggggactaggcaagaccagcatcgggctgctctgtgtgatggcatcctctgtccttctgtggatggctagcgtggagccacactggattgccgcatccatcattttggaatttttcctgatggttctcctgatccccgagcctgaccgtcagagaacaccccaggataaccaacttgcctacgtggtcataggactcctgtttatgattttgaccgtagctgcgaatgagatgggtctgttagaaactacgaagaaagacctaggcatcgggcacgtggccgttgagaaccatcaccatgcagctatgctggatgtggacctccacccagcctcagcctggaccctttacgcagtcgctacaactattatcacccctatgatgaggcatacaatagaaaacaccactgccaatatctctctgacagcgattgctaaccaggccgcaatcttgatgggactggataagggctggcccattagtaaaatggacatcggtgtgccactcctggcccttgggtgctattcgcaggtcaatcctttaacgctgaccgctgcagtgctcatgttggttgcccactacgcgataattggcccgggactgcaagctaaggccactcgcgaggcacagaaacggacagccgctggcatcatgaagaaccccaccgtggatgggatcgtagccattgacctagatccagtggtctatgacgcaaagttcgaaaaacagctgggacagatcatgctccttatactgtgtaccagccaaattttgctgatgcgaacaacttgggctctctgcgagtccatcacgctggccaccggccctttaacaactctttgggagggttctcccgggaagttttggaataccacaattgcggtttcaatggccaacatcttcagaggaagctacctggcaggcgctggtctcgccttctccctaatgaaaagtctgggcgggggaaggcgcggcaccggggcacagggagaaactttgggcgagaagtggaaacggcagctgaatcagctctctaagagcgaatttaacacgtataagagatcaggtataatggaggtggaccgttccgaagctaaagaggggcttaagaggggagagacaaccaaacacgccgtcagtcggggcactgccaagctgcgctggttcgtggaacgaaatttggtaaaaccagagggtaaggtgatcgatctgggctgtgggagaggaggctggagctactattgcgcggggctcaagaaagttaccgaagtgaagggatacacaaaaggcggtcctgggcatgaggaacccattccgatggctacttacggatggaacttagtcaagctgcactctggcaaagacgtgtttttcatcccacctgagaagtgtgatacccttctgtgcgacattggcgagtcctcacccaatccaacaatcgaagaggggaggacgctacgggtcctcaaaatggtggaaccctggctgcgcggaaaccaattttgtattaagatcttgaatccttatatgccgagcgttgtagagaccctggagcagatgcagagaaagcatggtggcatgctcgtgaggaaccccctttcgcgaaattctactcacgaaatgtactgggtcagttgcgggacaggaaacatagtgtccgcagttaatatgaccagccggatgctgttaaaccgtttcactatggcccacagaaaaccaacatatgagcgcgatgtggacctgggcgctggtaccaggcatgtcgccgtggaacctgaggtagcaaacttggatattatcgggcagcggatcgaaaatattaagcacgagcataaatcaacgtggcactacgacgaggataacccctataagacctgggcctaccatggatcctatgaagtgaaaccttctggcagcgctagttccatggttaatggcgtcgtgaagctcctgacaaagccatgggacgtgatacccatggtcactcaaatcgcgatgaccgatacaactccttttgggcagcagagagttttcaaagagaaggtggacacccgcacaccaaaagccaagaggggaaccgcacaaattatggaagtaactgctaaatggctatggggttttcttagccgaaacaagaagccccggatctgtacgagagaggaattcacaaggaaagtgcgctctaatgccgcaattggcgccgtctttgtggacgagaaccagtggaattcagctaaggaggccgttgaagatgagcgtttctgggacctggtgcaccgggaaagagagctccacaaacaggggaagtgcgcgacctgcgtctacaacatgatgggaaaaagggaaaagaagctgggcgagtttggtaaagcaaaggggagtcgcgccatctggtacatgtggttgggagctcgattcctggagttcgaagccctcggctttatgaatgaggatcattggttctcccgggaaaacagcctttctggcgtggagggggagggactgcacaaattaggttatatactgagagacatctcgaagattccgggcgggaatatgtacgcagatgacactgctggatgggataccaggatcacagaagacgatttgcagaacgaggccaaaattacggacatcatggaacctgagcatgctctcctggccaagtcaatatttaaactaacctatcaaaataaggtagttcgcgtgcagagaccagcaaagaacggcactgtcatggatgtgattagccggagggaccagcgtggttccgggcaggtgggaacatacggccttaataccttcactaacatggaagcgcaactgatccgacagatggagagtgagggcatcttttctcccagcgaactcgagacacctaacctggccgggcgcgtcttggattggttagaaaaacacggagttgagagactgaagcggatggctatttccggtgacgactgtgtggtaaaaccaatagatgacaggttcgccaccgcactcacagctcttaatgatatgggcaaggtgcgcaaagacatcccccagtgggaaccgtcaaaggggtggaacgattggcagcaagtccctttttgcagtcaccatttccaccagctgattatgaaggacggaagagagatcgtggttccctgtcggaatcaggatgagctagtgggcagggcccgagtctctcagggtgcagggtggagcctgcgtgaaactgcctgcctcggaaaatcctatgcgcaaatgtggcagttgatgtactttcatagacgcgacctgcggcttgctgccaacgcaatttgttcagccgtgccagtagattgggttcctaccagcaggacgacctggtctatccacgctcatcaccagtggatgacaactgaggacatgctgtccgtgtggaatagagtctggatagaagagaacccctggatggaagataagacccacgtgagtagctggggcgacgttccatatctcggcaaacgcgaggaccaatggtgcgggtcgttaatcggactgacagcccgggcaacttgggctaccaatattcaggtggccatcaaccaggtcaggcgattgctgggtaatgagaactacctcgattacatgacgtccatgaagagattcaaaaatgaatctgaccccgagggcgcgctttggtga

SEQ ID NO: 13554 - RNA, 9879 nt, synthetic construct
  misc_feature 1..9879: note = derived and/or modified CDS sequence (opt3) from DENV-1__EU660403__SS-prME
  source 1..9879: mol_type = other RNA
agcgtgaccatgctgctcatgcttatgcccacggccctggctttccacttgactacgagaggaggggaacctcatatgatcgtctccaagcaggaaagagggaaatctttactgtttaagacctcagccggtgttaatatgtgcacactaattgccatggacctcggagagctgtgtgaagatactatgacctacaaatgcccacggataacagagaccgaaccggacgatgtggactgttggtgcaatgcgactgatacatgggtaacctatgggacgtgtagtcaaactggggagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccggcagcttcaaactggagaaggaagtcgccgagacgcagcacggtacagtgcttgttcagataaagtacgagggcaccgacgctccttgcaaaatcccattcttgactcaagatgaaaagggggtgacacagaacggacgcctgattaccgcgaatcccatcgtaactgacaaagagaagcctgtcaacatagaagcagagccaccctttggcgagtcgtatattatcatcggtgccggggaaaaagctctcaagctgtcttggttcaagaaaggctcctcaattggaaagatgtttgaggccaccgcaagaggcgccaggcggatggctatccttggggatacagcctgggacttcggaagtattggtggcgtgtttacgagcgttgggaaactggtgcatcagatattcggaaccgcatacggcgtcttgttttccggtgtgtcttggactatgaagatcgggattggcgtactcctgacatggttaggactgaatagccgatcaaccagtctatccatgacatgtatcgcggtgggcctcgttactctgtaccttggggtcatggtgcaggctgatagcggatgcgtgatcaactggaaaggccgcgaattgaagtgtggttctgggattttcgtcaccaatgaggttcacacgtggacagaacaatataagtttcaggccgactcaccgaaaagactgagtgcagccataggaaaggcttgggaggagggcgtgtgcggtatcaggagcgccacccggctcgaaaacattatgtggaaacagatctccaacgagctgaatcatattttactggaaaacgacatgaagttcactgtggtagtcggcgatgtggcagggatccttgctcagggcaagaagatgatacgccctcaacccatggagtacaaatattcttggaagtcgtggggcaaggccaaaatcattggggcggacgttcagaataccacatttatcattgatggaccaaacactcctgaatgtcccgacgatcagagagcctggaatatctgggaggtggaggactacggcttcggtatatttaccacaaacatttggttgaagctcagggatagctatacgcaggtctgcgaccaccgtctgatgtccgctgcaatcaaagattcaaaggccgtgcacgctgacatggggtactggattgaaagtgagaaaaatgaaacctggaagctagcccgggcatctttcatcgaggttaagacttgtatatggccaaaaagccatacactgtggtccaacggagtgctcgaatcagagatgatcattcccaagatctatggcggtcctattagccaacacaattaccgaccaggctacttcacccagactgcggggccgtggcatctgggaaaacttgagttggattttgacctgtgcgaaggcacaaccgtagtcgtggatgagcactgcgggaacagaggaccctctttaaggacgactaccgtgacaggcaagatcatacacgaatggtgttgccgctcctgtaccctccctccactgcggttcagaggtgaggacgggtgctggtatggaatggagattaggcccgtcaaagaaaaggaggaaaatcttgttaagagtatggtgagcgccggctctggtgaggtagactccttttcactgggcttgctctgtatcagtatcattatcgaagaggtgatgcgcagccgatggtcgcggaaaatgctgatgactgggacactagctgtcttctttctgctcattatgggacagctgacctggaacgatcttatacgtttgtgcatcatggtgggcgccaatgcatccgacagaatggggatgggaacaacttacctggctttaatggccaccttcaagatgaggcctatgtttgcagttggcctcctgttccgccggcttacgtctagagaggtgctgctactcacaattggtctgagcttggtcgcctcagtggaactgccaaacagtttagaggaactcggggatggactggctatgggcatcatgattcttaaactgttgaccgactttcaatcccatcagctctgggcgactctgctatctctgaccttcatcaagacaacttttagccttcactatgcctggaaaaccatggcaatggttctctccatagtgtcactgttccccttgtgtctgagcacgacaagtcagaagaccacttggttaccggtcctcctgggctctcttgggtgcaagcctctgacaatgtttttgatcgctgagaataaaatttggggaaggcgatcctggccactcaacgaaggtatcatggccgtaggcattgtgagcatcctgctatcgtcactgcttaagaacgatgttcccctcgccgggcctctgatagctggaggcatgttgattgcatgttacgtgatctctggtagttccgccgacttaagcctggagaaagcggctgaggtctcttgggaagaggaagccgagcatagcggggcatcccacaatatcctcgtggaagtacaggatgacggaaccatgaagattaaagatgaggagcgcgacgatactctgacaatacttctgaaggccaccttgctagctgtgtcaggcgtctatcccctgagtatcccagcaacactcttcgtttggtacttctggcagaagaagaagcagcggagcggcgtgctgtgggacactccttctcccccagaagtggagagagccgtccttgatgacgggatttataggatcatgcagcgtggattactgggtcgctcccaggtgggcgttggggtatttcaagaaaacgtgttccataccatgtggcacgtcacacggggagcggtgctcatgtaccagggcaaaagattggagccgtcatgggctagtgttaagaaagacctgattagctacggtgggggatggaggctccagggctcctggaataccggcgaggaagtgcaggtcatcgccgtggagcctgggaagaaccccaaaaatgtacaaacagcaccaggaacttttaagacccccgaaggtgaggtcggcgccatagctctggatttcaagcctgggacgtctggatcgccaatcgtgaaccgagaaggcaaaattgttggtctttatgggaatggagtggtcacaactagcggcacctacgtgtcagccatcgcacaggctaaggcctcccaggagggccccctgcctgagattgaagacgaggtttttcggaaacgcaacttgacaatcatggatctacacccggggagtggaaagaccagaaggtatctgccagcgatagtgcgggaagccattaaacgaaagctcagaactttaatcctggcacccacccgcgtcgtggcttctgagatggccgaagctcttaagggtatgcctatcaggtaccaaacaacggcagtaaaaagcgagcatactggcaaggagattgtggacctgatgtgccacgccaccttcacaatgcgtctcttgtccccagttcgggtccccaattataacatgatcataatggatgaagcccattttaccgacccttcatctattgctgcgagagggtacatcagcactagggtgggaatgggcgaggcagccgctattttcatgacagccaccccgcccggtagtgtggaagcatttccacagtccaatgccgtcatccaggatgaggaacgcgacatacctgagcgaagctggaactctgggtatgagtggattacggatttccccggaaaaactgtatggtttgtgccatcaatcaagtccggcaatgacatcgctaactgtctgaggaaaaatggcaagcgggttattcagctcagtaggaagacattcgataccgaataccagaaaaccaagaacaacgactgggactacgtggtcactacagatatcagcgagatgggggcgaatttccgcgccgaccgtgtgattgatcctagacggtgcctgaaacccgttatacttaaggacggaccagaaagggtgatcctagcaggtccgatgcctgtcaccgtggcttcggccgcacagcgccgaggcagaattgggcggaaccacaataaagagggagatcagtatatctacatgggccagcccctgaacaatgacgaggatcatgcccactggacagaagctaagatgttgttagacaacatcaatactccagagggtattatacccgccctgtttgaacctgagagggaaaagtctgcggcaatcgatggggagtatcgcctcagaggcgaggccaggaaaacgttcgtagaactgatgcggcgtggagaccttccagtgtggctgtcctacaaggttgctagcgagggctttcaatattcagatcgccgatggtgcttcgacggggaaagaaacaatcaggtcctcgaggaaaacatggatgtggagatttggaccaaagagggagaaaggaagaaattgcggccccgctggctggacgccagaacatacagtgaccctctagctctgagggagtttaaggagttcgcagccggtcggcgatctgtgtccggcgatctcatccttgagattgggaaactgccgcagcacttaactcagagagctcaaaatgccttggacaacctggtcatgctccataatagcgaacagggaggccgcgcatataggcacgcgatggaggagctgccagataccatcgaaacacttatgctgctcgccttgatagctgttctgaccggtggggtgactttatttttcctatcaggccggggactgggcaagacgagtatcgggctcctttgtgtaatggccagctccgtgctgttgtggatggcatctgtcgagccccattggattgctgccagcatcattctggaatttttcctcatggtgctgcttatccctgagcccgaccgtcagagaaccccacaggataaccaactcgcatacgttgtgataggactgttgtttatgattctgacagtcgccgctaatgagatgggtttactagaaactaccaagaaagacctgggcatcgggcacgtagcggtggagaaccaccatcacgccgcaatgctcgatgttgaccttcatcctgcttccgcctggacactgtacgccgtggcaaccactattatcacacccatgatgaggcacacgatagaaaacaccactgctaatatctcattgacagccattgcgaaccaggctgccatcctgatgggactcgataagggctggccaatttctaaaatggacatcggtgtccctctgcttgcattagggtgctatagtcaggtgaatccgctgaccctcaccgccgctgtcttgatgctggtggcacattacgccataattggccccggactacaagcgaaggctacacgcgaggcccagaaacggactgcagccggcatcatgaagaacccaacggttgatgggatcgtggctattgacctggatcctgtagtgtatgacgccaagttcgaaaaacagctcggacagatcatgcttctgatattgtgtacctcgcaaattctgctcatgcgaacaacttgggcactgtgcgagagcatcaccttagctacaggcccccttaccactctgtgggagggttccccagggaagttttggaatacgacaattgccgtctctatggcgaacatcttcagaggatcatacctcgccggcgcaggtctagctttcagcctgatgaaatccttgggcgggggaaggcgcggcaccggggcccagggagaaactctgggcgagaagtggaaacggcagctcaatcagcttagtaagtctgaatttaacacctataagagaagcggtataatggaggttgaccgttcagaagcaaaagaggggctgaagaggggagagacaactaaacacgctgtgtcccggggcaccgccaagttgcgctggttcgtcgaacgaaatctggtgaaacctgagggtaaggtaatcgatctcggctgtgggagaggaggctggagttactattgcgccgggttaaagaaagtgacagaagttaagggatacacgaaaggcggtcccgggcacgaggaaccgattccaatggcgacctacggatggaacctggtgaaacttcatagcggcaaagacgtctttttcatccctcccgagaagtgtgatactctgctatgcgacattggcgagtcttccccaaatcccacaatcgaagaggggaggaccctccgggtgctgaaaatggtcgaaccttggttgcgcggaaaccaattttgtattaagatcctgaatccgtatatgccctcagtggttgagactctcgagcagatgcagagaaagcacggtggcatgcttgtaaggaacccactgagccgaaattcgacacatgaaatgtactgggtgtcttgcgggaccggaaacatagtcagtgctgtgaatatgacgtcccggatgttactgaaccgtttcaccatggcacacagaaaacctacatatgagcgcgatgttgacttgggcgccggtactaggcacgtggctgtcgaacccgaggtggccaacctcgatattatcgggcagcggatcgaaaatattaagcatgagcacaaaagcacctggcattacgacgaggataacccttataagacatgggcataccacggatcatatgaagtaaaaccatccggctctgccagcagtatggtgaatggcgttgtcaagctgctaactaagccctgggacgtgatacctatggtgacccaaatcgctatgacagataccactccatttgggcagcagagagtcttcaaagagaaggttgacacgcgcacacccaaagcgaagaggggaaccgcccaaattatggaagtgactgcaaaatggctttggggttttctgtcccgaaacaagaagccgcggatctgtaccagagaggagttcacaaggaaagtacgcagcaatgctgccattggcgcagtgtttgtcgacgagaaccagtggaactctgccaaggaggctgtggaagatgagcgtttctgggacctcgttcatcgggaaagagagctgcacaaacaggggaagtgcgccacgtgcgtgtacaacatgatgggaaaaagggaaaagaagttgggcgagtttggtaaagcgaaggggtcacgcgcaatctggtacatgtggctgggagcccgattcctcgagttcgaagctcttggctttatgaatgaggatcactggttcagtcgggaaaactccctgagcggcgtcgagggggagggattacataaactgggttatatattgagagacatctctaagattcctggcgggaatatgtacgccgatgacaccgcaggatgggatactaggatcacagaagacgatctccagaacgaggctcgcattaccgacatcatggaaccagagcacgccctgctagctaaatcgatatttaaacttacttatcaaaataaagtggtaagagttcagcggcccgccaagaacggcacagtgatggatgtcatttcaaggcgtgaccagcgaggtagcggacaggtgggaacctacggcctgaatacattcactaacatggaagcacaactcatccgccagatggagtccgagggcatctttagtccttctgaactggagaccccaaacttggcggaaagagtgttagattggctggagaagtatggggtcgaacggctcaaaaggatggccattagcggagacgactgtgttgtgaagcccatagatgaccgcttcgctacggcccttaccgcactgaatgatatgggtaaagtaagaaaggacatcccgcagtgggagccttccaaaggctggaacgattggcagcaagtgcccttttgctcacatcacttccaccagctaattatgaaggacgggcgggagatcgtcgtgccatgtaggaatcaggatgaactggttggacgagctcgtgtgagtcagggcgccggttggtctctcagagagacagcatgcttgggaaagagctacgcccaaatgtggcagctgatgtattttcatcgccgggaccttaggctggcggctaacgccatttgttccgcagtccctgtggattggatccccacttcaagaaccacatggagcatacacgcccatcaccagtggatgactaccgaagacatgctctctgtatggaatcgcgtttggatcgaggaaaacccatggatggaggataaaacgcatatttccagttggggagacgtgccctacttaggcaagcgggaggaccaatggtgcggcagcctgatcgggttgacagctagggccacctgggcaactaatattcaggtcgctatcaaccaggtgcgaagactgattggaaatgaaaactacctcgattatatgacatcgatgaaacggttcaagaatgagggtgaccctgaaggcgccctttggtga

SEQ ID NO: 13555 - RNA, 9879 nt, synthetic construct
  misc_feature 1..9879: note = derived and/or modified CDS sequence (opt3) from DENV-1__EU660397__SS-prME
  source 1..9879: mol_type = other RNA
agcgtgaccatgctgctcatgcttatgcccaccgccctggctttccacttgactacgcggggcggggaacctcatatgatcgtctccaagcaggaaaggggaaagtctttactgtttaagacctcagccggtgttaatatgtgcacgctaattgccatggacctcggcgaactgtgtgaagatactatgacctacaaatgcccacggattacagaaaccgaaccggacgatgtggactgttggtgcaatgcgactgatacatgggtgacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaggacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaggcccctacaaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctccgcgggatgtcctatgtgatgtgtaccgggagcttcaagctggagaaagaagtcgccgagacgcagcacggtacagtgcttgttcagataaagtacgagggcaccgacgctccttgcaagatcccattctcgactcaagatgaaaaaggggtgacacagaacggaagattgattaccgcgaatcccatcgtaactgacaaggagaaacctgtcaacatagaagcagagccaccctttggcgagtcttatattgtgatcggtgccggggaaaaggctctgaaactctcctggttcaagaagggctcaagtatcggaaaaatgtttgaggccaccgcaaggggcgcccggcgaatggctattctgggggatacagcctgggacttcggaagcatcggtggcgtttttacgtccgtggggaaacttgtccatcagattttcggaaccgcatacggcgtgctgttttctggtgtaagctggactatgaaaatagggatcggcgtgttgctcacatggctgggattaaattcacgcagtacctccctgagcatgacatgtattgcggttggcctagtcactctctacctgggggtgatggtgcaggctgattctggatgcgtcatcaactggaagggcagagaacttaaatgtggttcagggatcttcgttaccaatgaggtgcacacgtggacagaacaatataagtttcaggccgacagtccgaagaggttgagcgcagccattggaaaggcttgggaggagggcgtgtgcggtatacggtccgccacccgcctggaaaacatcatgtggaagcagatttctaacgagctcaatcatatcctgttagaaaacgacatgaaattcactgtagtcgtgggcgatgttgcagggattctggctcagggaaagaaaatgatcagacctcaacccatggagtacaagtattcgtggaaaagctggggcaaggccaagataatcggggcggacgtgcagaataccacatttattatcgatggaccaaacactcctgaatgtcccgacgatcagagggcctggaatatttgggaggtcgaggactacggcttcggtatctttaccacaaacatatggcttaaattgcgtgattcctatacacaggtgtgcgaccaccggctcatgtcagctgcaattaaggatagtaaagccgttcacgctgacatggggtactggatcgaatctgagaagaatgaaacctggaaactggcccgagcatccttcattgaggtgaagacttgtatctggccaaagtcccatacactatggtcaaacggagtactggaaagcgagatgataatccccaaaatttatggcggtcctatctctcaacacaattacagaccaggctacttcacccagactgcggggccgtggcatctcggaaagctggagcttgattttgacttgtgcgaaggcacaaccgtcgtggtggatgagcactgcgggaacaggggaccctccctgcgcacgactaccgtcacaggcaaaattatccacgaatggtgttgccggagttgtaccttacctccactcagattcaggggtgaggacgggtgctggtatggaatggagatacgccccgttaaggaaaaagaggaaaatctggtaaagagcatggtatctgccggctccggtgaggtggactcatttagtcttggcctgttgtgtattagcatcatgatcgaagaggtcatgcgatcgcggtggtcccgtaagatgctcatgactgggacactggctgtgttctttctactgattatgggacagctcacctggaacgatctgatcagactttgcattatggttggcgccaatgcatctgacaggatggggatgggaacaacttacttggctctgatggccaccttcaaaatgcgccctatgtttgcagtgggcttactcttccggagactgacgagcagggaggtccttctgctaacaataggtctctcactggtggccagtgttgaattgccaaactccctggaggaattaggggatggactcgctatgggcatcatgattctgaaacttctgaccgactttcaatctcatcagttgtgggcgactctcctgagcctaaccttcatcaaaacaactttttccctgcactatgcctggaagaccatggcaatggtgctttcaattgtcagcctcttccccctgtgtttgagtacgacatctcagaaaaccacttggctgccggtattactcggctccctggggtgcaagcctcttacaatgtttctgatcgctgagaataagatatggggacgacgcagctggccattgaacgaaggtatcatggccgtgggcattgtttcgatcctcctgtcatctctactgaaaaacgatgtgccccttgccgggcctctcattgctggaggcatgctgatcgcatgttacgtcataagtggttccagcgccgacttgtctttagagaaggcggctgaggtgagctgggaagaggaagccgagcattccggggcatcacacaatattctggtagaagtgcaggatgacggaaccatgaaaatcaaggatgaggagcgggacgatactctcacaatcctgcttaaagccaccctgttggctgtcagtggcgtttatcccctaagcattccagcaacgctgttcgtgtggtacttctggcaaaagaaaaagcagagatctggcgtgctctgggacactccttcacccccagaagtcgagagggccgtgctggatgacgggatatatcgtatcatgcagcgcggacttttaggtcggagccaggttggcgtaggggtgtttcaagaaaacgtcttccataccatgtggcacgtgacaagaggagcggttctgatgtaccagggcaagaggctcgagccgagttgggctagcgtgaaaaaggacttgatttcctacggtgggggatggcgactgcagggctcttggaataccggcgaggaagtccaggtgatcgccgtagagcctgggaaaaaccccaagaatgtccaaacagcaccaggaacttttaaaacccccgaaggtgaggtgggcgccattgctctcgatttcaagcctgggacgtcgggaagcccaatcgttaaccgggaaggcaagatagtgggtctgtatgggaatggagtcgtgacaacttcaggcacctacgtttccgccatcgcacaggctaaagccagtcaggagggcccccttcctgagattgaagacgaggtgtttcgcaagagaaacctgacaatcatggatttgcacccggggtctggaaaaaccaggcggtatctaccagcgattgtccgagaagccatcaagagaaaactgcgcactctcatattagcacccaccagggtggtagctagcgagatggccgaagctctgaagggtatgcctattcgttaccaaacaacggcagtgaagtccgagcatactggcaaagagatcgttgaccttatgtgccacgccaccttcacaatgcggctgctctcaccagtcagagtgcccaattataacatgatcattatggatgaagcccattttaccgacccttctagcatcgctgcgagggggtacataagtactcgcgtgggaatgggcgaggcagccgctattttcatgacagccaccccgcccggttccgtcgaagcatttccacagagcaatgccgtaatccaggatgaggaacgagacattcctgagagatcttggaactcagggtatgagtggatcacggatttccccggaaagactgtgtggtttgttccatccataaaaagtggcaatgacattgctaactgtttgcggaagaatggcaaaagggtgatccagctgagccgcaagacattcgataccgaataccaaaagaccaaaaacaacgactgggactacgtcgtgactacagatatctcggagatgggggcgaatttccgtgccgacagagttattgatcctcggaggtgcctcaagcccgtgatcctgaaagacggaccagaacgcgtcattcttgcaggtccgatgcctgtgaccgtagcttctgccgcacagcgaagaggccggatagggaggaaccacaataaggagggagatcagtatatctacatgggccagcccctaaacaatgacgaggatcatgcccactggacagaagctaaaatgctgttggacaacattaatactccagagggtatcatccccgccttatttgaacctgagcgcgaaaagtccgcggcaattgatggggagtatagactgaggggcgaggcccggaagacgttcgtggaactcatgcgtcgcggagacctgccagtttggcttagctacaaagtcgcttcagagggctttcaatatagtgatcgaagatggtgcttcgacggggaaaggaacaatcaggtgctggaggaaaacatggatgtggagatatggaccaaggagggagaacggaaaaagctccgccccagatggttggacgccaggacatactctgaccctctggctctacgggagtttaaagagttcgcagccggtcgaagatccgtcagcggcgatctgatcctcgagattgggaaacttccgcagcacctgactcagcgcgctcaaaatgccttagacaacttggttatgctgcataattcagaacagggaggcagggcatatcggcacgcgatggaggagctcccagataccatcgaaacactgatgcttctggccctcattgctgtgttgaccggtggggtaactctgtttttcttaagtggccgtggactaggcaaaacgagcatcgggctgctctgtgtgatggcctcctctgtccttctgtggatggcaagcgtggagccccattggatagctgcctccatcattttggaatttttcctgatggttctcctgatccctgagcccgacagacagaggaccccacaggataaccaacttgcatacgtggtcattggactcctgtttatgatcttgacagtagccgctaatgagatgggtctgttagaaactaccaagaaggacctaggcatagggcacgtggcggttgagaaccaccatcacgccgcaatgctggatgtggacctccatcctgcttcagcctggacactttacgccgtcgcaaccactattatcacacccatgatgcgccacacgattgaaaacaccactgctaatatctctctgacagccatagcgaaccaggctgccatcttgatgggactggataaaggctggccaattagtaagatggacatcggtgtgcctctcctggcacttgggtgctattcgcaggtcaatccgttaaccctgaccgccgctgtgctcatgttggttgcacattacgccattatcggccccggactgcaagcgaaagctacacgggaggcccagaagcgaactgcagccggcataatgaaaaacccaacggtggatgggattgtagctatcgacctagatcctgtggtctatgacgccaagttcgaaaagcagctgggacagatcatgctccttattctgtgtaccagccaaatcttgctgatgagaacaacttgggcactctgcgagtccataaccctggctacaggccccttaaccactctttgggagggttctccagggaaattttggaatacgacaattgccgtttcaatggcgaacatcttcaggggaagctacctggccggcgcaggtctcgctttctccctaatgaagagtctgggcgggggacgccggggcaccggggcccagggagaaactttgggcgagaaatggaagagacagctgaatcagctctctaaaagcgaatttaacacctataagcgttcaggtattatggaggtggacaggtccgaagcaaaggaggggcttaaacggggagagacaactaagcacgctgtcagtcgcggcaccgccaaactgcgatggttcgtggaaagaaatttggtaaagcctgagggtaaagtgatcgatctgggctgtgggaggggaggctggagctactattgcgccgggctcaagaaggttacagaagtgaaaggatacacgaagggcggtcccgggcacgaggaaccgataccaatggcgacctacggatggaacttagtcaaactgcattctggcaaggacgtgtttttcatccctcccgagaaatgtgatactcttctgtgcgacattggcgagtcctcaccaaatcccacaatcgaagaggggcggaccctacgcgtcctcaagatggtggaaccttggctgagaggaaaccaattttgtattaaaatcttgaatccgtatatgcccagcgttgtagagactctggagcagatgcagaggaagcacggtggcatgctcgtgcgaaacccactttcgagaaattctacacatgaaatgtactgggtcagttgcgggaccggaaacattgtgtccgctgttaatatgacgagccgtatgctgttaaacagattcaccatggcacaccgcaagcctacatatgagagggatgtggacctgggcgccggtactcggcacgtcgctgtggaacccgaggtagccaacttggatatcatagggcagagaattgaaaatatcaaacatgagcacaagtcaacctggcattacgacgaggataacccttataaaacatgggcataccacggatcctatgaagtgaagccatctggcagcgccagttccatggttaatggcgtcgtgaaactcctgactaagccctgggacgtgatccctatggtcacccaaattgctatgacagataccactccatttgggcagcagcgcgttttcaaggagaaagtggacacgaggacacccaaggcgaaacgaggaaccgcccaaataatggaagtaactgcaaagtggctatggggttttcttagccggaacaaaaagccgagaatctgtaccagggaggagttcacacgcaaggtgcgttctaatgctgccattggcgcagtctttgtggacgagaaccagtggaactcagccaaagaggctgttgaagatgagcggttctgggacctggtgcatagagaaagggagctccacaagcaggggaaatgcgccacgtgcgtctacaacatgatgggaaagcgcgagaagaagctgggcgagtttggtaaggcgaaagggagtcgagcaatctggtacatgtggttgggagcccggttcctggagttcgaagctctcggctttatgaatgaggatcactggttctccagagaaaacagcctttctggcgtggagggggagggactgcataagttaggttatattctgagggacatctcgaaaatacctggcgggaatatgtacgccgatgacaccgcaggatgggatactcgcatcacagaagacgatttgcagaacgaggctagaattaccgacatcatggaaccagagcacgccctcctggctaagtcaatttttaaactaacttatcaaaataaggtagttcgggtgcagaggcccgccaaaaacggcacagtcatggatgtgatcagccgtcgagaccagcgcggttccggacaggtgggaacctacggccttaatacattcactaacatggaagcacaactgataagacagatggagagtgagggcatattttctcctagcgaactcgagaccccaaacctggcggaacgggtcttggattggttagagaagtatggggttgaaaggctgaagcgcatggccatctccggagacgactgtgtggtaaaacccatcgatgacagattcgctacggccctcaccgcacttaatgatatgggtaaggtgcggaaagacattccgcagtgggagccttcaaagggctggaacgattggcagcaagtccccttttgcagtcatcacttccaccagctgataatgaaagacgggagggagatcgtggttccatgtcgaaatcaggatgagctagtgggacgtgctagagtctctcagggcgccggttggagcctgcgcgagacagcatgcctcgggaagtcctacgcccaaatgtggcagttgatgtattttcatcggagggacctgagacttgcggctaacgccatttgttcagcagtgcctgtagattggatccccactagccgcaccacatggtctattcacgcccatcaccagtggatgactaccgaagacatgctgtccgtttggaatcgggtgtggatcgaggaaaacccatggatggaggataagacgcatataagtagctggggagacgtcccctacctcggcaaaagggaggaccaatggtgcggctcgttaatcgggctgacagctcgagccacctgggcaactaatattcaggtggctatcaaccaggttagacggttgattggaaatgaaaactacctggattatatgacatccatgaagaggttcaaaaatgagtctgaccctgaaggtgccctctggtga

SEQ ID NO: 13556 - RNA, 9879 nt, synthetic construct
  misc_feature 1..9879: note = derived and/or modified CDS sequence (opt3) from DENV-1__EU687247__SS-prME
  source 1..9879: mol_type = other RNA
tccgtgaccatgctgctcatgcttatgcccacagcactggctttccacttgactacgagaggaggggaacctcatatgatcgtctccaagcaggaaagggggaaatctttactgtttaagacctcagccggtgttaacatgtgcacactaattgccatggacctcggcgagttctgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaagacgcaaactttgtttgccgccgaacattcgtggatagaggctggggtaatgggtgtggactgtttggcaaaggctccttgataacttgcgctaagttcaagtgcgtaaccaaactcgaggggaagattgtgcagtacgaaaacctgaaatattcagtcatcgtgacagttcacaccggagaccagcatcaagtgggtaatgagagtactgaacacggcacgacagccaccattactccccaggcgcctagcaccgagatccagttaacagactacggggccctgaccctcgattgttctccaaggactggacttgactttaacgaaatggtcctgttgacaatgaaggagaaatcctggctagtgcataagcagtggttcctggatctcccgctgccctggacgtcaggcgcaagcaccagtcaagagacttggaatcggcaggaccttctggtaacatttaaaaccgctcacgccaagaagcaggaagttgtggtcttgggttctcaagagggggctatgcacacagccctcactggcgcaaccgaaatccagacgtccggaaccacaactattttcgccggccatctgaaatgccgtttaaagatggataaactgaccctaaaggggatgagctatgtgatgtgtacaggatcgttcaaactcgagaaggaagtcgctgagactcagcacggtaccgtgctggttcagataaagtacgagggcacggacgcgccttgcaaaatcccattttctacacaagatgaaaagggggtgacccagaacggacgccttattactgcaaatcccatcgtaacagacaaagagaagcctgtcaacatagaagccgagccacccttcggcgagtcctatattgtgatcggtgctggggaaaaagccttgaagctgtcatggtttaagaaaggcagtagcatcggaaagatgttcgaggcaaccgccagaggcgctaggcggatggccattctcggggatactgcatgggactttggatccatcggtggcgttttcacctctgtggggaaactggtccatcagatttttggaacagcgtacggcgtgcttttcagcggtgtatcatggacgatgaagatagggatcggcgtgctgttgacctggctcggactgaatagtcgatccactagcttatctatgacatgtattgctgttggcctggtcaccctatacctcggggtgatggtgcaggccgattcaggatgcgtcatcaactggaaaggccgcgaactgaagtgtggtagtgggatctttgttacaaatgaggtgcacacttggaccgaacaatataagttccaggcagacagcccgaaaagactttccgccgctattggaaaggcctgggaggagggcgtgtgcggtataaggtctgcaacgcggttggaaaacatcatgtggaaacagatttcgaacgagctgaatcatatcctcctggaaaacgacatgaagttaacagtagtcgtgggcgatgttgctgggattctggcccagggcaagaagatgatccgccctcaacccatggagtacaaatatagctggaagatatggggcaaggcgaaaatcattggggccgacgtgcagaataccacttttatcattgatggaccaaacacccctgaatgtcccgacgatcagagagcttggaatatctgggaggtcgaggactacggcttcggtatatttacaactaacatttggcttaagttgagggattcctatacccaggtgtgcgaccaccgtctcatgtcagcagccatcaaagatagtaaggctgttcacgccgacatggggtactggattgaatctgagaaaaatgaaacatggaagctggcacgggcgagcttcatcgaggtgaagacgtgtatatggccaaaatcccataccctatggtcaaacggagtactggaaagcgagatgatcattcccaagatctatggcggtcctatttctcaacacaattaccgaccaggctacttcactcagacagccgggccgtggcatctcggaaaactggagcttgattttgacttgtgcgaaggcaccactgtcgtggtggatgagcactgcgggaacagaggaccctccctgaggacaaccacggtcactggcaagatcatacacgaatggtgttgccgcagttgtaccttacctccactccggttcaaaggtgaggacgggtgctggtatggaatggagattagacccgttaaggaaaaggaggaaaatctggtgaaaagcatggtatctgctggctccggtgaggtggactcatttagtcttggcctgttgtgtatcagcatcatgattgaagaggtcatgaggtcgcgctggtcccgaaagatgctcatgacagggaccctggccgtgttctttctactgatcatgggacagctcacttggaacgatctgattcggctttgcataatggttggcgcaaatgcttctgaccgtatggggatgggaacaacctacttggccctgatggcaacattcaaaatgagacctatgtttgccgtgggcttactcttcaggcgcctgactagccgggaggtccttctgctaaccatcggtctctcactggtggctagtgttgaattgccaaactccctggaggaattaggggatggactcgcgatgggcattatgatcctgaaacttctgacggactttcaatctcatcagttgtgggccacactcctgagcctaaccttcattagaactaccttttccctgcactatgcatggaaaacaatggctatggtgctttcaatcgtcagcctcttccccctgtgtttgagtactacctctcagaagacgacatggctgccggtattactcggctccctggggtgcaagcctcttaccatgtttctgatagccgagaataaaatctggggaagaaagagctggccattgaacgaaggtattatggccgtgggcatcgtttcgattctcctgtcatctctactgaaaaacgatgtgccccttgctgggcctctcatcgcaggaggcatgctgatagcctgttacgtcattagtggttccagcgcggacttgtctttagagaaggctgccgaggtgagctgggaagaggaagcagagcattccggggcctcacacaatatcctggtagaagtgcaggatgacggaactatgaaaatcaaggatgaggagcgagacgatacactcaccattctgcttaaagctactctgttggcagtcagtggcgtttatcccctaagcataccagccacactgttcgtgtggtacttctggcaaaagaagaaacagcgctctggcgtgctctgggacaccccttcacccccagaagtcgagcgggcggtgctggatgacgggatctatagaattatgcagaggggacttttaggtcgtagccaggttggcgtaggggtgtttcaagaaaacgtcttccatacgatgtggcacgtgactcgcggagctgttctgatgtaccagggcaagcggctcgagccgagttgggccagcgtgaaaaaggacttgatctcctacggtgggggatggagactgcagggctcttggaataccggcgaggaagtccaggtgattgcagtagagcctgggaaaaaccccaagaatgtccaaacagccccaggaacctttaagacatcggaaggtgaggtgggcgctatcgccctcgatttcaaacccgggactagcggatcacctatagttaacagggaaggcaagatcgtgggtctgtatgggaatggagtcgtgaccacgtccggcacatacgttagtgcaattgctcaggccaaagcgtctcaggagggcccacttcccgagatcgaagacgaggtgtttcgaaagcggaacctgactattatggatttgcaccctgggagcggaaaaacccgcagatatctaccggccatcgtcagggaagcaataaagcggcgactgagaacactcattttagctccaacccgcgtggtagcctccgagatggctgaagcactgaagggtatgcccatcaggtaccaaactaccgccgtgaaatcagagcatacaggcaaggagatcgttgaccttatgtgccacgccacgttcactatgcgtctgctctctcctgtccgggtgccaaattataacatgattatcatggatgaagctcattttaccgaccccagcagtatagcggcaagagggtacatttccacaagggtgggaatgggcgaggccgctgccatcttcatgaccgcaactcctccgggtagcgtcgaagcctttccccagtctaatgctgtaattcaggatgaggaacgcgacatcccagagcgatcatggaactccgggtatgagtggataacagatttccctggaaaaaccgtgtggtttgttcccagtattaagagcggcaatgacatcgcgaactgtttgaggaaaaatggcaagcgggtgatccagctgtcgaggaagacgttcgatactgaataccagaaaacaaagaacaacgactgggactacgtcgtgaccaccgatatttctgagatgggggccaatttccgcgcagaccgtgttatcgatccaagacggtgcctcaaacctgtgattctgaaggacggacccgaaagggtcatacttgctggtccaatgccggtgactgtagcctccgcagcccagcgccgaggcagaatcgggcggaaccacaataaagagggagatcagtatatttacatgggccagcctctaaacaatgacgaggatcatgctcactggacagaagccaagatgctgttggacaacatcaatacccccgagggtatcattccagcgttatttgaacccgagagggaaaagagcgcagccatagatggggagtatcgcctgagaggcgaggctaggaaaacattcgtggaactcatgcggcgtggagacctgcctgtttggctttcatacaaggtcgccagtgagggctttcaatattctgatcgccgatggtgcttcgacggggaaagaaacaatcaggtgctggaggaaaacatggatgtggagatctggactaaagagggagaaaggaagaaactccggccacgctggttggacgctagaacgtactccgaccccctggcactaagggagtttaaggagttcgccgctggtcggcgaagcgtctcaggcgatctgattctcgagatcgggaaacttcctcagcacctgacccagagagcccaaaatgcattagacaacttggttatgctgcataatagtgaacagggaggccgcgcgtataggcacgccatggaggagctcccggatacaattgaaactctgatgcttctggctctcatcgccgtgttgaccggtggggtaacactgtttttcttaagcggccggggactaggcaagacctccatagggctgctctgtgtgatggcatctagcgtccttctgtggatggcttccgtggagccacattggatcgccgcatcaattatcttggaatttttcctgatggttctcctgattcccgagcctgaccgtcagagaactccccaggataaccaacttgcctacgtggtcatcggactcctgtttatgatattgacggtagctgcgaatgagatgggtctgttagaaaccacaaagaaagacctaggcattgggcacgtggccgttgagaaccaccatcacgcagctatgctggatgtggacctccatccagcctctgcctggactctttacgcagtcgctaccacaatcattacccctatgatgaggcacactatcgaaaacacaacggccaatataagtctgaccgcgatcgctaaccaggccgcaattttgatgggactggataagggctggcccatctcgaaaatggacattggtgtgccactcctggcccttgggtgctatagccaggtcaatcctttaactctgacagctgcagtgctcatgttggttgcccattacgcgatcataggcccgggactgcaagctaaggccacccgcgaggcacagaaacggaccgccgctggcattatgaagaaccccacagtggatgggatcgtagccatcgacctagatccagtggtctatgacgcaaagttcgaaaaacagctgggacagattatgctccttatcctgtgtacttcccaaatattgctgatgcgaacgacctgggctctctgcgagtctattacactggccactggccctttaaccacactttgggagggttcacccgggaagttttggaataccactatcgcggttagcatggccaacattttcagaggatcctacctggcaggcgctggtctcgccttcagtctaatgaaatctctgggcgggggaaggcgcggcacgggggcacagggagaaacattgggcgagaagtggaaacggcagctgaatcagctcagcaagtcagaatttaacacctataagagatccggtatcatggaggtggaccgtagtgaagctaaagaggggcttaagaggggagagactaccaaacacgccgtcagccggggcacagccaagctgcgctggttcgtggaacgaaatttggtaaaaccagagggtaaggtgatagatctgggctgtgggagaggaggctggtcttactattgcgcggggctcaagaaagttactgaagtgaagggatacaccaaaggcggtcctgggcacgaggaacccatcccgatggctacatacggatggaacttagtcaagctgcattccggcaaagacgtgtttttcattccacctgagaagtgtgatacgcttctgtgcgacatcggcgagtcaagccccaatccaaccattgaagaggggaggactctacgggtcctcaaaatggtggaaccctggctgcgcggaaaccaattttgtatcaagattttgaatccttatatgccgtcggttgtagagacactggagcagatgcagagaaagcacggtggcatgctcgtgaggaaccccctttctcgaaatagtacccatgaaatgtactgggtctcctgcgggactggaaacatcgtgagcgcagttaatatgacatcacggatgctgttaaaccgtttcaccatggcccacagaaaaccaacgtatgagcgcgatgtggacctgggcgctggtaccaggcacgtcgccgtggaacctgaggtagcaaacttggatataattgggcagcggatcgaaaatatcaagcatgagcacaaatccacatggcattacgacgaggataacccctataagacttgggcctaccacggatcttatgaagtgaaacctagcggcagtgcttccagcatggttaatggcgtcgtgaagctcctgaccaagccatgggacgtgattcccatggtcacacaaatagcgatgactgataccacaccttttgggcagcagagagttttcaaagagaaggtggacacccgcactccaaaagccaagaggggaacggcacaaatcatggaagtaacagctaaatggctatggggttttctttctcgaaacaagaagccccggatttgtaccagagaggagttcactaggaaagtgcgctcaaatgccgcaatcggcgccgtctttgtggacgagaaccagtggaatagtgctaaggaggccgttgaagatgagcgtttctgggacctggtgcatcgggaaagagagctccacaaacaggggaagtgcgcgacctgcgtctacaacatgatgggaaaaagggaaaagaagctgggcgagtttggtaaagcaaaggggtcccgcgccatttggtacatgtggttgggagctcgattcctggagttcgaagccctcggctttatgaatgaggatcactggttcagccgggaaaactctctttcgggcgtggagggggagggactgcataaattaggttatatcctgagagacatatcaaagatcccgggcgggaatatgtacgcagatgacacagctggatgggatacgaggattaccgaagacgatttgcagaacgaggccaaaatcactgacattatggaacctgagcacgctctcctggccaagagcatctttaaactaacatatcaaaataaggtagttcgcgtgcagagaccagcaaagaacggcaccgtcatggatgtgatatcccggagggaccagcgtggtagtggacaggtgggaacttacggccttaatacattcaccaacatggaagcgcaactgattcgacagatggagtctgagggcatctttagcccctccgaactcgagacacctaacctggccgggcgcgtcttgaattggttagaaaaacatggagttgagagactgaagcggatggctatctcaggtgatgactgtgtggtaaaaccaattgacgataggttcgccactgcactcaccgctcttaacgacatgggcaaggtgcgcaaagatataccccagtgggaaccgagtaaggggtggaatgactggcagcaagtccctttttgctctcaccacttccatcagctgatcatgaaggatggaagagagattgtggttccctgtcggaaccaggacgagctagtgggcagggcccgagtcagccagggtgcagggtggtccctgcgtgaaacggcctgcctcggaaaatcatatgcgcaaatgtggcagttgatgtactttcacagacgcgatctgcggcttgctgccaatgcaatctgtagcgccgtgccagtagactgggttcctacctctaggacaacttggtccattcatgctcaccatcagtggatgaccacagaggatatgctgagtgtgtggaacagagtctggatcgaagagaatccctggatggaagacaagactcacgtgagctcgtggggcgatgttccatatctcggcaaacgcgaggaccaatggtgcgggtccttaataggactgaccgcccgggcaacgtgggctacaaacatccaggtggccattaatcaggtcaggcgattgctgggtaacgagaattacctcgactacatgacctctatgaagagattcaaaaacgaatcagatcccgagggcgcgctttggtga

SEQ ID NO: 13557 - RNA, 9879 nt, synthetic construct
  misc_feature 1..9879: note = derived and/or modified CDS sequence (opt3) from DENV-1__EU660412__SS-prME
  source 1..9879: mol_type = other RNA
agcgtgaccatgctgctcatgcttatgcccacagcactggctttccacttgactacgagaggaggggaacctcatatgatcgtctccaagcaggaaaggggaaaatctttactgtttaagacctcagccggtgttaacatgtgcacattaattgccatggacctcggcgagctgtgtgaagatactatgacctacaaatgcccacggataacagaggcggaaccggacgatgtggactgttggtgcaatgctaccgatacttgggtaacatatgggacctgtagtcagacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaattgctcaagacagaggtgaccaaccctgccgtgctgaggaaactttgcattgaagctaagatctctaatacgaccacagatagccggtgtccaactcaaggagaggccaccctggtcgaagaacaggacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatgtgtactggtagcttcaaactggagaaggaagtcgctgagacccagcacggtacggtgcttgttcagataaagtacgagggcacagacgcgccttgcaaaatcccattctcgacccaagatgaaaagggggtgactcagaacggacgcttgattacagcaaatcccatcgtaaccgacaaagagaagcctgtcaacatagaagccgagccaccctttggcgagtcttatattgtgatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtttttacatccgtggggaaacttgtccatcagattttcggaacggcgtacggcgtgctgttttctggtgtaagctggaccatgaagatagggatcggcgtgttgctcacttggctgggattaaattcacgaagtacatccctgagcatgacctgtattgctgttggcctagtcacactctacctgggggtgatggtgcaggccgattctggatgcgtcatcaactggaaaggccgcgaacttaagtgtggttcagggatcttcgttactaatgaggtgcacacctggacggaacaatataagtttcaggcagacagtccgaaaagattgagcgccgctattggaaaggcctgggaggagggcgtgtgcggtataaggtccgcaacacggctggaaaacatcatgtggaaacagatttctaacgagctcaatcatatcctgttagaaaacgacatgaagctgaccgtagtcgtgggcgatgttgctgggattcttggacagggcaaaaagatgatccgccctcaacccatggagtacaaatattcgtggaaaagctgggggaaggccaaaataatcggagcggacgcccagaatactaccttcattatcgatggcccaaacacacctgaatgtcccgacgatcagagagcttggaatatttgggaggtggaggactacggttttgggatcttcactaccaacatatggttgaagctcagggattcctatacacaggtctgcgaccaccgtctgatgtcagcagccattaaagatagtaaggctgtgcacgccgacatgggatactggatcgaatctgagaaaaatgaaacgtggaagctagcacgggcgagctttattgaggttaagacctgtatctggccaaaatcccatactctgtggtcaaacggcgtgctcgaaagcgagatgataatccccaagatttatggtggccctatctctcaacacaattaccgaccagggtacttcacacagaccgccggaccgtggcatctgggcaaacttgagttggatttcgacctgtgcgaagggactacagtagtcgtggatgagcactgcggaaacagaggcccctccttaaggaccacgactgtgaccggtaagattatccacgaatggtgttgccgcagttgtacactccctccactgcggtttagaggggaggacggatgctggtatggcatggagataaggcccgtcaaagaaaaggaggaaaatcttgttaagagcatggtgtctgctggttccggcgaggtagactcattcagtctggggttgctctgtattagcatcatgatcgaagaggtgatgcgctcgcgatggtcccggaaaatgctgatgaccggaactctagccgtctttttcctgctcattatgggccagctgacatggaacgatcttatccgtttgtgcattatggtgggggcaaatgcttctgacagaatgggaatgggcaccacatacctggccttaatggcaacttttaagatgaggcctatgttcgccgttggtctcctgtttcgccggcttaccagcagagaggtgctgctactcacgatagggctgtcattggtcgctagtgtggaactgccaaactccttagaggaactcggagatggcctggcgatgggcatcatgattcttaaactgttgacagacttccaatctcatcagctctgggccaccctgctaagcctgacttttatcaagaccacattctcccttcactatgcatggaaaactatggctatggttctctcaattgtgagcctgtttcccttgtgtctgagtaccacgtctcagaagacaacctggttaccggtcctcctggggtcccttggatgcaagcctctgactatgttcttgatcgccgagaataaaatatggggtaggaagtcctggccactcaacgaaggcatcatggccgtagggattgtgtcgatcctgctatcatctctgcttaaaaacgatgttcccctcgctggacctctgattgcaggcggtatgttgatcgcctgttacgtgataagtgggtccagcgcggacttatctctggagaaggctgccgaggtcagctgggaagaggaagcagagcattccggagcctcacacaatattctcgtggaagtacaggatgacggcacaatgaaaatcaaggatgaggagcgagacgataccctgactatccttctgaaagctacattgctagcagtgagtggcgtctatcccctgagcattccagccaccctctttgtttggtacttctggcaaaagaagaaacagcgctctggggtgctgtgggacacgccttcacccccagaagtggagcgggcggtccttgatgacggaatatatagaatcatgcagaggggtttactgggccgtagccaggtgggggttggagtattccaagaaaacgtgtttcatactatgtggcacgtcacccgcggcgctgtgctcatgtaccagggtaagcggttggagccgagttgggccagcgttaaaaaggacctgatttcctacgggggaggctggagactcaggggctcttggaatacaggggaggaagtgcaggtcatcgcagtggagcctggcaaaaatcccaagaatgtacagaccgccccaggtacattcaagactcccgaaggcgaggtcggggctattgccctggattttaaacctggaacctcgggcagcccaatcgtgaaccgagaaggtaagatagttgggctttatggaaatggcgtggtcacgacatcaggcacttacgtgtccgcaatcgctcaagccaaagcgagtcaggaggggcccctgcctgagattgaagacgaggttttccggaagcgcaacttgaccatcatggatctacacccgggatctggtaaaacaagaaggtatctgccagccattgtgcgggaagcaatcaagcgaaagctcagaaccttaatactggctcccactcgcgtcgtggccagcgagatggctgaagcacttaaaggcatgcctattaggtaccagaccacagccgtaaagtccgagcatacggggaaagagatcgtggacctgatgtgccacgccacttttaccatgcgtctcttgtcaccagttcgggtccccaattataacatgatcattatggatgaagctcatttcacagacccttctagcatcgcggcaagaggatacataagtaccagggtgggcatgggtgaggccgctgccatttttatgactgcaacaccgcccgggtccgtggaagccttcccacaaagcaatgctgtcatccaggatgaggaacgcgacattcctgagcgatcttggaactcaggatatgagtggatcaccgattttcccggcaagacggtatggttcgtgccatccataaaaagtggcaatgacattgcgaactgtctgagaaagaatgggaagcgggttatccagctcagcaggaaaacttttgatacagaataccagaagaccaaaaacaacgactgggactacgtggtcaccactgatatctcggagatgggagccaatttccgcgcagaccgtgtgattgatcctagacggtgcctgaagcccgttatccttaaagacggtccagaaagggtgattctagctggcccgatgcctgtcacagtggcctctgcagcccaacgccgagggagaataggacggaaccacaataaggagggcgatcagtatatctacatgggtcagcccctgaacaatgacgaggatcatgctcactggaccgaagccaagatgttgttagacaacattaatacaccagaggggatcatccccgcgctgttcgaacctgagagggaaaaatccgcagccgtagatggcgagtatcgcctcagaggagaggctaggaagacttttgtggaactgatgcggcgtggcgaccttccagtttggctgagctacaaagtcgcctcagaggggttccagtatagtgatcgccgatggtgctttgacggagaaagaaacaatcaagtgctcgaggaaaacatggatgtggagatttggacgaaggagggtgaaaggaaaaagttgcggccccgctggctggacgctagaacctactctgaccctctagcactgagggagttcaaagaatttgccgctggccggcgatccgtcagcggggatctcatacttgagatcggaaagctgccgcagcacttaacacagagagcccagaatgcattggacaacctggttatgctccataattcagaacaaggcggtcgcgcgtataggcacgccatggaggagctgccagatactattgaaacccttatgctgctcgctttgatcgccgtgctgacagggggcgtaaccttattctttctaagtggacggggcctggggaagactagcattggactcctttgtgtgatggcatcctctgtcctgttgtggatggctagcgtggagccccattggatcgccgcatccataatcctggagttctttctcatggttctgcttattcctgagcccgaccgtcagagaacgccacaggataaccagctcgcctacgtggtcatcggtctgttgttcatgattctgaccgtagctgcgaatgagatgggcttactagaaacaactaaaaaggacctggggatcggacacgtggccgttgagaaccaccatcacgcagctatgctcgatgtggaccttcatcctgcctcagcctggaccctgtacgcagtcgctacaaccataattactcccatgatgaggcacacaatcgaaaacacgaccgccaatatttctttgactgcgatcgctaaccaagccgcaatactgatgggcctcgataaaggttggccaatcagtaagatggacattggggtgcctctgcttgccttaggctgctattcgcaggtcaatccgctgacactcaccgctgcagtgttgatgctggttgcccattacgcgatcattggacccggcctacaggctaaagccacccgcgaggcacaaaagcggacagccgctgggatcatgaagaacccaactgtggatggaatagtagccattgacctggatcctgtggtctatgacgcaaaatttgaaaagcagctcggccagatcatgcttctgatcttgtgtacgagccagattctgctcatgcgaaccacatgggctctgtgcgagtccatcactttagccaccggtccccttacaaccctgtgggaggggtctccaggaaaattctggaatactacgatagcggtttcaatggccaacatttttagaggcagctacctcgcaggagctggcctagccttctccctgatgaagagtctagggggaggcaggcgcgggacaggagcacaaggcgaaaccctgggtgagaaatggaagcggcagctcaatcagctttctaagagcgagttcaacacttataaaagatcagggatcatggaggtggaccgttccgaagctaaggagggactgaaaaggggcgagaccacaaagcacgccgtcagtcggggtactgccaaattgcgctggtttgtggaacgaaatctggtaaagcctgagggcaaggtgattgatctcgggtgtggaagaggcgggtggagctactattgcgcgggactaaagaaggttaccgaagtgaaaggctacacaaagggtgggcccggacacgaggaaccgatcccaatggctacgtacggctggaacctggtcaaacttcattctggcaaggacgtgttctttatacctcccgagaaatgtgataccctgctatgcgacatcggggagtcctcaccaaatcccactattgaagagggaaggacactccgggtcctgaagatggtggaaccttggttgcgcggtaaccagttctgtatcaagattctgaatccgtatatgcccagcgttgtagaggcactcgagcaaatgcagagaaaacacggcgggatgcttgtgaggaacccactgtcgcgaaattctacccatgaaatgtactgggtcagttgcggaactggcaacatcgtgtccgccgttaatatgacaagccggatgttactgaaccgttttaccatggctcacagaaagcctacgtatgagcgcgatgtggacttgggtaccgggacaaggcacgtcgccgtggaacccgaggtagcaaacctcgatattatcggacagcggatagaaaatattaaacatgagcacaagtcaacttggcattacgacgaggataacccttataaaacctgggcctaccacggctcctatgaagtgaagccatctggcagcgctagttccatggttaatggggtcgtgaagctgctaacaaaaccctgggacgtgatccctatggtcactcagatcgcgatgaccgatacaaccccattcggacaacagagagtttttaaggagaaagtggacactcgcacgcccaaggccaaaaggggtacagcacagattatggaagtaaccgctcgatggctttggggcttcctgagccggaacaagaagccgagaatatgtactagggaggaatttacccgcaaagtgcgttctaatgccgcaatcggggccgtcttcgtggacgagaaccaatggaactcagctaaggaggccgttgaagatgagcggttttgggacctcgtgcatagagaaagggagctgcacaaacagggaaagtgcgcgacatgcgtctacaacatgatgggcaaacgcgaaaagaagttgggtgagttcgggaaagcaaagggaagtcgagccatttggtacatgtggctgggcgctcggtttctcgagttcgaagcccttggcttcatgaatgaggatcactggttttccagagaaaacagcctgtctggggtggagggagagggtttacataaactgggctatatcttgagggacatttcgaagatccctgggggaaatatgtacgcagatgacacggctggctgggatacccgcataactgaagacgatctccagaacgaggccaaaatcacagacattatggaaccagagcacgctctgctagccaaggcaatcttcaaacttacctatcagaataaggtagttagagtgcaacggcccgcgaagaacggtactgtcatggatgtgatttcaaggcgtgaccagcgagggagcggacaggtgggcacatacggcctgaatacctttacaaacatggaagcccagctcatccgccaaatggagtccgaggggatattcagtccttctgaactggagactccaaacttggctgaaagagccttagattggctggagaaatatggagtcgaacggctcaagaggatggcaattagcggtgacgactgtgttgtgaaacccatcgatgaccgctttgctaccgcccttacggcactgaatgatatgggcaaggtaagaaaagacatcccgcagtgggagccttccaaggggtggaacgattggcaacaggtgcccttctgctcacatcactttcaccaactaattatgaaggacggacgggagatagtcgtgccatgtaggaatcaggatgaactggttggccgagcccgtgtgagtcagggtgcggggtggtctctcagagagaccgcttgcttgggaaaaagctacgcccagatgtggcaactgatgtatttccatcgccgggaccttaggctggcagccaacgctatctgttccgccgtccctgtggattgggtacccacatcaagaactacctggagcattcacgcacatcaccagtggatgacaactgaagacatgctctctgtttggaatcgcgtgtggatcgaggaaaacccatggatggaggataagacccatatttccagttgggaggacgtcccctacttaggcaaacgggaagaccagtggtgcggcagcctgatcgggttgacggctagggccacatgggcgaccaatatacaagtggctatcaaccaggttcgaagactgattggaaatgagaactacctcgattatatgatctcgatgaagcggtttaaaaatgaatccgaccctgagggtgccctttggtga

SEQ ID NO: 13558 - RNA, 9879 nt, synthetic construct
  misc_feature 1..9879: note = derived and/or modified CDS sequence (opt3) from DENV-1__EU660418__SS-prME
  source 1..9879: mol_type = other RNA
agcgtgaccatgctgctcatgcttatgcccacggccctggctttccacttgactacgagaggaggggagcctcatatgatcgtctccaagcaggaaagaggaaaatctttactgtttaagacctcagccggtgttaatatgtgcacactgattgccatggacctcggcgagctgtgtgaagatactatgacctacaaatgcccacggattacagagaccgaaccggacgatgtggactgttggtgcaatgcgactgatacatgggtgacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccggtagcttcaaactggagaaggaagtcgccgagacgcagcacggaacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattgtgatcggtgccggggaaaaagctctgaagctctcctggttcaagaaaggctcaagtatcggaaagatgtttgaggccaccgcaagaggcgccaggcggatggctattctgggggatacagcctgggacttcggaagcatcggtggcgtttttacgtccgtggggaaacttgtccatcagattttcggaaccgcatacggcgtgctgttttctggtgtaagctggactatgaagatagggatcggcgtgttgctcacatggctgggattaaattcacgaagtacctccctgagcatgacatgtattgcggttggcctagtcactctctacctgggggtgatggtgcaggctgattctggatgcgtcatcaactggaaaggccgcgaacttaagtgtggttcagggatcttcgttaccaatgaggtgcacacgtggacagaacaatataagtttcaggccgacagtccgaaaagattgagcgcagccattggaaaggcttgggaggagggcgtgtgcggtataaggtccgccacccggctggaaaacatcatgtggaaacagatttctaacgagctcaatcatatcctgttagaaaacgacatgaagttcactgtagtcgtgggcgatgttgcagggattctggctcagggcaaaaagatgatccgccctcaacccatggagtacaaatattcgtggaaaagctggggcaaggccaagataatcggggcggacgtgcagaataccacatttattatcgatggaccaaacactcctgaatgtcccgacgatcagagagcctggaatatttgggaggtcgaggactacggcttcggtatctttaccacaaacatatggcttaagttgagggattcctatacacaggtgtgcgaccaccgtctcatgtcagctgcaattaaagatagtaaggccgttcacgctgacatggggtactggatcgaatctgagaaaaatgaaacctggaagctggcccgggcatccttcattgaggtgaagacttgtatctggccaaaatcccatacactatggtcaaacggagtactggaaagcgagatgataatccccaagatttatggcggtcctatctctcaacacaattaccgaccaggctacttcacccagactgcggggccgtggcatctcggaaaactggagcttgattttgacttgtgcgaaggcacaaccgtcgtggtggatgagcactgcgggaacagaggaccctccctgaggacgactaccgtcacaggcaagattatccacgaatggtgttgccgcagttgtaccttacctccactccggttcagaggtgaggacgggtgctggtatggaatggagataaggcccgttaaagaaaaggaggaaaatctggtaaagagcatggtatctgccggctccggtgaggtggactcatttagtcttggcctgttgtgtattagcatcatgatcgaagaggtcatgcgctcgcgatggtcccggaaaatgctcatgactgggacactggctgtgttctttctactgattatgggacagctcacctggaacgatctgatccgtctttgcattatggttggcgccaatgcatctgacagaatggggatgggaacaacttacttggctctgatggccaccttcaagatgaggcctatgtttgcagtgggcttactcttccgccggctgacgagcagagaggtccttctgctaacaataggtctctcactggtggccagtgttgaattgccaaactccctggaggaattaggggatggactcgctatgggcatcatgattctgaaacttctgaccgactttcaatctcatcagttgtgggcgactctcctgagcctaaccttcatcaagacaactttttccctgcactatgcctggaaaaccatggcaatggtgctttcaattgtcagcctcttccccctgtgtttgagtacgacatctcagaagaccacttggctgccggtattactcggctccctggggtgcaagcctcttacaatgtttctgatcgctgagaataaaatatggggaaggcgaagctggccattgaacgaaggtatcatggccgtgggcattgtttcgatcctcctgtcatctctactgaagaacgatgtgccccttgccgggcctctcattgctggaggcatgctgatcgcatgttacgtcataagtggttccagcgccgacttgtctttagagaaagcggctgaggtgagctgggaagaggaagccgagcattccggggcatcacacaatattctggtagaagtgcaggatgacggaaccatgaagatcaaagatgaggagcgcgacgatactctcacaatcctgcttaaggccaccctgttggctgtcagtggcgtttatcccctaagcattccagcaacgctgttcgtgtggcatttctggcagaaaaagaagcagcggtctggcgtgctctgggacactccttcacccccagaagtcgggagagccgtgctggatgacggaatatacaggatcatgcagcgtggtcttttaggccgcagccaggttggggtaggagtgtttcaagagaacgtcttccacaccatgtggcacgtgacacggggcgcggttctgatgtatcagggtaaaagactcgaaccgagttgggctagcgtgaagaaagacttgatttcctacgggggaggctggaggctgcagggctcttggaataccggggaggaggtccaggtgatcgccgtagaacctggaaagaaccccaaaaatgtccaaacagcaccaggtacttttaagacccccgagggcgaagtgggggccattgctctcgatttcaagcctggaacgtcgggcagcccaatcgttaaccgagagggtaaaatagtggggctgtacggaaatggcgtcgtgacaacttcaggcacctatgtttccgccatcgcacaggctaaggccagtcaggaagggccccttcctgagattgaggacgaagtgtttcggaaacgcaacctgacaatcatggatttgcatccgggatctggtaagaccagaaggtacctaccagcgattgtccgggaggccatcaaacgaaagctgagaactctcatattagcacccacccgcgtggtagctagcgaaatggccgaggctctgaagggcatgcctattaggtatcaaacaacggcagtgaaatccgaacacactgggaaggagatcgttgaccttatgtgccatgccaccttcacaatgcgtctgctctcaccagtccgggtgcccaattacaacatgatcattatggatgaggcccactttaccgacccttctagcatcgctgcgagaggatatataagtactagggtgggcatgggtgaagcagccgctattttcatgacagccaccccgcccgggtccgtcgaggcatttccacagagcaatgccgtaatccaggatgaggaacgcgacattcctgaacgatcttggaactcaggatacgagtggatcacggatttccccggcaaaactgtgtggtttgttccatccataaagagtggcaatgacattgctaactgtttgaggaaaaatgggaagcgggtgatccagctgagcaggaagacattcgataccgagtatcagaaaaccaagaacaacgactgggactacgtcgtgactacagatatctcggaaatgggagcgaatttccgcgccgaccgtgttattgatcctagacggtgcctcaaacccgtgatcctgaaggacggtccagagagggtcattcttgcaggcccgatgcctgtgaccgtagcttctgccgcacagcgccgagggagaataggacggaaccataataaagaaggcgatcagtacatctatatgggtcagcccctaaacaatgacgaggatcacgcccactggacagaggctaagatgctgttggacaacattaatactccagaagggatcatccccgccttatttgagcctgaaagggagaagtccgcggcaattgatggcgaataccgcctgagaggagaggccaggaaaacgttcgtggagctcatgcggcgtggcgacctgccagtttggcttagctataaggtcgcttcagaagggtttcaatacagtgatcgccgatggtgcttcgacggagagagaaacaatcaggtgctggaagagaacatggatgtggaaatatggaccaaagagggtgagaggaagaaactccggccccgctggttggacgccagaacatattctgaccctctggctctaagggaatttaaggagttcgcagccggccggcgatccgtcagcggggatctgatcctcgaaattggaaaacttccgcagcatctgactcagagagctcaaaatgccttagacaacttggttatgctgcacaattcagagcagggcggtcgcgcatacaggcatgcgatggaggaactcccagataccatcgagacactgatgcttctggccctcattgctgtgttgaccgggggcgtaactctgtttttcttaagtggacggggcctagggaagacgagcatcggactgctctgtgtgatggcctcctctgtccttctgtggatggcaagcgtggaaccccactggatagctgcctccatcattttggagtttttcctgatggttctcctgatccctgaacccgaccgtcagagaaccccacaggataaccaacttgcatatgtggtcattggtctcctgtttatgatcttgacagtagccgctaatgagatgggcctgttagagactaccaagaaagacctagggataggacacgtggcggttgaaaaccatcaccatgccgcaatgctggatgtggacctccaccctgcttcagcctggacactttacgccgtcgcaaccactattatcacacccatgatgaggcatacgattgagaacaccactgctaatatctctctgacagccatagcgaaccaggctgccatcttgatgggcctggataagggttggccaattagtaaaatggacatcggggtgcctctcctggcacttggctgctactcgcaggtcaatccgttaaccctgaccgccgctgtgctcatgttggttgcacactatgccattatcggacccggcctgcaagcgaaggctacacgcgaagcccagaaacggactgcagccgggataatgaagaacccaacggtggatggaattgtagctatcgacctagatcctgtggtctacgacgccaagttcgagaaacagctgggccagatcatgctccttattctgtgtaccagccaaatcttgctgatgcgaacaacttgggcactctgcgaatccataaccctggctacaggtcccttaaccactctttgggaggggtctccaggaaagttttggaatacgacaattgccgtttcaatggcgaacatcttcagaggcagctatctggccggtgcaggcctcgctttctccctaatgaaaagtctagggggaggcaggcgcgggaccggagcccagggcgagactttgggtgaaaagtggaaacggcagctgaatcagctctctaagagcgagtttaacacctacaagagatcagggattatggaagtggaccgttccgaggcaaaagaaggacttaagaggggcgagacaactaaacacgctgtcagtcggggtaccgccaagctgcgctggttcgtggagcgaaatttggtaaaacctgaaggcaaggtgatcgatctggggtgtggaagaggcgggtggagctattactgcgccggactcaagaaagttacagaggtgaagggctatacgaaaggtgggcccggacatgaggagccgataccaatggcgacctacggctggaacttagtcaagctgcactctggcaaagacgtgtttttcatccctcccgaaaagtgtgatactcttctgtgcgacattggggagtcctcaccaaatcccacaatcgaggaaggaaggaccctacgggtcctcaaaatggtggagccttggctgcgcggtaaccaattttgtattaagatcttgaatccgtacatgcccagcgttgtagaaactctggagcagatgcagagaaagcatggcgggatgctcgtgaggaacccactttcgcgaaattctacacacgagatgtattgggtcagttgcggaaccggcaacattgtgtccgctgttaatatgacgagccggatgctgttaaaccgtttcaccatggcacacagaaaacctacatacgaacgcgatgtggacctgggtgccgggactaggcatgtcgctgtggagcccgaagtagccaacttggatatcataggacagcggattgagaatatcaagcacgaacataaatcaacctggcactatgacgaggataacccttacaagacatgggcatatcatggctcctacgaggtgaaaccatctggcagcgccagttccatggttaatggggtcgtgaagctcctgactaagccctgggacgtgatccctatggtcacccaaattgctatgacagataccactccatttggacagcagagagttttcaaagaaaaggtggacacgcgcacacccaaagcgaagaggggtaccgcccaaataatggaggtaactgcaaaatggctatggggctttcttagccgaaacaagaagccgcggatctgtaccagagaagagttcacaaggaaagtgcgctctaatgctgccattggggcagtctttgtggacgaaaaccagtggaactcagccaaggaggctgttgaggatgaacgtttctgggacctggtgcaccgggagagagaactccacaaacagggaaagtgcgccacgtgcgtctataacatgatgggcaaaagggagaagaagctgggtgaatttgggaaagcgaagggaagtcgcgcaatctggtacatgtggttgggcgcccgattcctggagttcgaggctctcggctttatgaatgaagatcattggttctcccgggagaacagcctttctggggtggaaggagagggtctgcacaaattaggctacattctgagagacatctcgaatatacctgggggaaacatgtatgccgatgacaccgcaggctgggatactaggatcacagaggacgatttgcagaatgaagctcgcattaccgacatcatggagccagaacatgccctcctggctaagtcaatttttaaactaacttaccaaaacaaggtagttagagtgcagcggcccgccaaaaatggtacagtcatggatgtgatcagcaggcgtgaccagcgagggtccggacaggtgggcacctatggccttaacacattcactaacatggaggcacaactgatacgccagatggaaagtgaggggatattttctcctagcgagctcgaaaccccaaatctggcggagagagtcttggattggttagaaaagtacggagttgagcggctgaagaggatggccatctccggtgacgactgtgtggtaaaacccatcgatgaccgcttcgctacggccctcaccgcacttaacgatatgggcaaggtgagaaaagacattccgcagtgggaaccttcaaaggggtggaatgattggcagcaagtccccttttgcagtcaccacttccatcagctgataatgaaagacggacgggagatcgtggttccatgtaggaaccaggatgagctagtgggccgagctcgtgtctctcagggtgccgggtggagcctgagagaaacagcatgcctcggaaagtcctatgcccaaatgtggcagttgatgtactttcaccgccgggacctgaggcttgcggctaatgccatttgttcagcagtgcctgtagattggatccccactagcagaaccacatggtctattcatgcccaccatcagtggatgactaccgaggacatgctgtccgtttggaaccgcgtgtggatcgaagagaatccatggatggaagataagacgcacataagtagctggggcgacgtcccctatctcggcaaacgggaggaccaatggtgcgggtcgttaatcggactgacagctagggccacctgggcaactaacattcaggtggctatcaatcaggttcgaagattgattggtaacgagaattacctggattacatgacatccatgaagcggttcaaaaacgaatctgaccctgagggcgccctctggtga

SEQ ID NO: 13559 - RNA, 9879 nt, synthetic construct
  misc_feature 1..9879: note = derived and/or modified CDS sequence (opt3) from DENV-1__EU677151__SS-prME
  source 1..9879: mol_type = other RNA
agcgtgaccatgctgctcatgcttatccccacagccctggctttccacttgactacgagaggcggggagcctcatatgattgtctccaagcaggaaaggggaaaatctttactgtttaagacctcagcaggtgttaacatgtgcacactaatagccatggacctcggcgagctgtgtgaagatactatgacctacaaatgcccacggatcacagaggtggaaccggacgatgtagactgttggtgcaataccactgatacatgggtgacctatgggacgtgtagtcaaactggagagcaccgccgagacaagcgtagcgtcgcgcttgctccccatgtgggcctgggtttggagaccagagccgaaacatggatgtcctctgagggggcatggaaacagattcagaaggttgaaacttgggccctcaggcaccctggattcaccgtgatcgctctgtttctggcacatgccattggcacatcgatcacccagaagggcataatcttcattctcttaatgctggtcacgccatcaatggctatgcggtgcgtggggatcggaagccgcgattttgtagagggtcttagtggcgccacttgggttgacgtggtcttggagcacgggtcctgtgtgacaaccatggcgaaagataagcccactctggacattgaactactcaaaacagaggtgaccaaccctgcagtcctgagaaagctttgcatcgaagccaaaatatctaatacgaccacagatagcaggtgtccaactcaaggagaggctaccctggttgaagagcaggacgccaacttcgtgtgccggcgcacatttgtagatcgaggctggggtaatgggtgtggattgttcggcaagggctccctcattacttgcgcaaagtttaaatgcgtgaccaagctggaggggaaaatcgtccagtacgaaaacttaaagtattcagtgattgttacagtgcacaccggagaccagcatcaagtcggtaatgagagtactgaacacggcacgacagctaccatcactccccaggcccctaccagcgagatccagctgacagactacggggcgctcacccttgattgttctccaagaactggactggacttcaacgaaatggtgttgctaacaatgaaagagaagtcctggctggtacataaacagtggtttctcgatctgccgcttccctggacgtcaggcgccagcaccagtcaagagacttggaataggcaggacctgttggttacattcaagaccgcacacgctaagaaacaggaagtggtcgtgctcggttctcaagagggggccatgcacacagctctgactggcgccaccgaaattcagacgtccggaaccacaactatatttgcaggccatttaaagtgccggctgaaaatggataagctaaccctcaaagggatgagctatgtcatgtgtacaggatcgttcaagctggagaaggaagtggccgagactcagcacggtaccgttcttgtgcagatcaaatacgagggcacggacgctccttgcaagattccattctctacacaagatgaaaaaggggtaacccagaacggacgtttgatcactgcgaatcccatagtcacagacaaggagaaacctgtgaacattgaagcagagccaccctttggcgagtcctatatcgttatcggtgccggggaaaaggctctgaagctctcatggttcaaaaagggcagtagcattggaaaaatgtttgaggccaccgcacgcggcgccagaaggatggctatcctgggggatactgcctgggacttcggatccattggtggcgtgtttacctctgtcgggaagcttgtgcatcagatattcggaacagcatacggcgtactgtttagcggtgtgtcatggacgatgaaaatcgggattggcgttttgctcacctggctgggattaaatagtcggtccactagcctgtctatgacatgtatcgcggtcggcctagtgaccctctacctgggggtgatggtccaggctgattcaggatgcgttatcaactggaagggccgagaacttaagtgtggtagtgggattttcgtgacaaatgaggtgcacacttggaccgaacaatataaatttcaggccgacagcccgaagcgcttgtccgcagccataggaaaagcttgggaggagggcgtatgcggtatcagatctgccacgaggctggaaaacattatgtggcggcagatctcgaacgagctcaatcatattctgttagaaaacgacatgaagttcacagtcgtggttggcgatgtggtcgggatcctggcacagggaaaaaagatgatacgccctcaacccatggagcacaaatacagctggaagtcctggggcaaggctaaaatcattggggccgacgtgcagaataccacttttatcattgatggaccaaacacccctgaatgtcccgacgatcagagagcgtggaatatctgggaggttgaggactatggcttcggtatatttacaactaacatttggcttaagttgagggattcatacacccaggtgtgcgaccaccgtctcatgagtgccgctatcaaagattctaaggcagtacatgccgacatggggtattggattgaaagcgagaaaaatgaaacatggaagctggctcgggcctccttcatcgaggtcaagacgtgtatatggccaaaatcacacaccctatggagcaacggagtgctggaatctgagatgatcattcccaagatctacggcggtcctatttcccaacataattatcgaccaggctacttcactcagacagcagggccgtggcacctcggaaaactggagcttgattttgacttgtgcgaaggcaccactgtggtcgttgatgagcactgcgggaacagaggagcgagtctgaggacaaccacggtgactggcaagatcatacatgaatggtgttgccgcagctgtaccttaccccctctccggttcaaaggtgaggacgggtgctggtacggaatggagattagaccagtaaaggaaaaggaggaaaatctggtgaaatctatggtctccgccggctcaggtgaggtggacagttttagccttggcctgttgtgtatctcgatcatgattgaagaggttatgaggtcccgctggtctcgaaagatgctcatgacagggaccctggctgtgttctttctactgatcatgggacagctcacttggaacgatctgattcggagctgcataatggtcggcgccaatgcatcagaccgtatggggatgggaacaacctatcttgctttgatggccacattcaaaatgagacccatggtggcagttggcctgttatttaggcgcctcactagtcgggaggtgctgcttctgaccatcggtctatccctcgtcgcctctgtagaactgcctaacagcttggaggaactgggggatggattagctatgggcattatgatcctcaagctgcttacggacttccaatcctaccagctgtgggcgacattgctctcactgacctttattaaaactaccttcagcctacactatgcctggaagacaatggcaatggtgctgagtatcgtttctcttctcccactgtgtttgtccactaccagccagaagacgacatggctgcccgtgttactcggctcgctggggtgcaaaccgcttaccatgtttctgatagctgagaataagatctggggaagaaaatcatggcctttgaacgaaggtattatggccgtcggcatcgtgtctattctcctgagttccctactgaagaacgatgtaccacttgccgggcccctcatcgctggaggcatgctgatagcatgttacgtgattagcggttctagcgccgacttgtccttagagaaagcggctgaggtctcatgggaagaggaagccgagcatagtggggcaagccacaatatcctggttgaagtgcaggatgacggaactatgaagatcaaagatgaggagagggacgatacactcaccattctgcttaaggccactctgttggctgtgtctggcgtctatcctctatccatacccgcaacactgttcgtgtggtacttttggcaaaagaaaaagcagcgatcaggcgttctctgggacaccccaagtcctcccgaagtagagcgcgccgtgctggatgacgggatctatcggattatgcagagaggacttttaggtaggagccaggtcggcgtgggggttttccaagaaaacgtgttccatacgatgtggcacgtcactcgtggagcggtgctgatgtaccagggcaaacgcctcgagccatcctgggcttctgtaaagaaagacttgatctcgtacggtgggggatggcggctgcagggcagctggaataccggcgaggaagtccaggtgattgccgttgagccggggaagaaccctaagaatgtgcaaacagcacccggaacctttaaaacaccagaaggtgaggtcggcgccatcgctctcgatttcaagcccgggacttcaggatcccctatagtgaacagagaaggcaaaatcgttggtctgtatgggaatggagtggtcaccacgagtggcacatacgtgtctgccattgcacaggctaaggccagccaggagggcccacttcccgagatcgaagacgaggtatttaggaaacgaaacctgactattatggatttgcaccctgggtccggaaagacccggcgctatctaccggcgatcgtgagagaagccataaagaggaaactgcggacactcattttagcaccaacccgagttgtcgcttcagagatggccgaagctctgaagggtatgcccatcagataccaaactaccgcagtgaaatctgagcatacaggccgcgagatcgtggaccttatgtgccacgccacgttcactatgaggctgctcagccctgtccgtgtaccaaattataacatgattatcatggatgaagcccattttaccgaccccagttccatagctgcgcgggggtacattagcacaagagtgggaatgggcgaggcagccgctatcttcatgaccgccactcctccgggttctgttgaagcatttccccagtcaaatgccgtgattcaggatgaggaaagggacatcccagagcgctcctggaacagtgggtatgagtggataacagatttccctggaaagaccgtctggtttgtgcccagcattaaatcgggcaatgacatcgctaactgtttgcgaaagaatggcaagagagttatccagctgtctcggaaaacgttcgatactgaataccaaaagacaaaaaacaacgactgggactacgtggtcaccaccgatatttccgagatgggggcgaattttagggccgaccgcgtgatcgatccacgtagatgcctcaagcctgtaattctgaaagacggacccgaacgggtgatacttgcaggtccaatgccggttactgtcgctagcgccgcacagaggcgcggccgaatcgggagaaaccacaataaggagggagatcagtatatttacatgggccagcctctaaacaatgacgaggatcatgcccactggacagaagctaagatgctgttggacaacatcaatacccccgagggtatcattccagccttattcgaacccgagcgggaaaaatcagcggcaatagatggggagtataggctgcgcggcgaggccagaaagacattcgtggaactcatgaggcggggagacctgcctgtgtggcttagttacaaagtcgcttctgagggctttcaatattccgatcgtcgctggtgcttcgacggggaacgaaacaatcaggttctggaggaaaacatggatgtggagatctggactaaggagggagaaagaaaaaagctcaggccacggtggttggacgcccgcacgtacagcgaccccctggctctaagagagtttaaagaattcgcagccggtaggcggtcagtaagtggcgatctgattctcgagatcgggaagcttcctcagcacctgacccagcgagctcaaaatgccttagacaacttggtgatgctgcataatagcgaacagggaggcagagcatatcgccacgcgatggaggagctcccggatacaattgaaactctgatgcttctggccctcatcgctgtcttgaccggtggggtgacactgtttttcttatccggcaggggactaggcaagacctctatagggctgctctgtgttatggccagctccgcacttctgtggatggcttcagtggagccacattggatcgccgcatctattatcttggaatttttcctgatggtcctcctgattcccgagcctgaccggcagcgtactccccaggataaccaacttgcctacgtagtgatcggactcctgtttatgatattgacggttgctgcgaatgagatgggtctgttagaaaccacaaaaaaggacctaggcattgggcacgtggccgtcgagaaccaccatcacgcaactatgctggatgtggacctccatccagctagtgcctggaccctttacgccgtcgcaacaaccatcattactcctatgatgagacacacaatcgaaaacacgaccgctaatatatcgctgactgccatcgcgaaccaggctgccattttgatgggactggataaaggctggcccatcagcaagatggacattggtgtgccactcctggcacttgggtgctattcccaggttaatcctttaacactgaccgccgctgtgctcatgttggtagcacattacgccatcataggcccgggactgcaagcgaaagctaccagggaggcccagaagcgcacagcagccggcattatgaagaaccccactgtggatgggatcgtcgctatcgacctagatccagttgtgtatgacgccaaattcgaaaagcagctgggacagattatgctccttatcctgtgtacgtctcaaatattgctgatgcggaccacatgggcactctgcgagtcaattactctggctaccggccctttaacaaccctttgggagggtagccccgggaaattttggaatactacgatcgccgtctccatggcgaacattttccgaggaagttacctggccggcgcaggtctcgctttttctctaatgaagagcctgggcgggggaagaaggggcacaggggcccagggagaaaccttgggcgagaaatggaagcgccagctgaatcagctctcaaagtccgaattcaacacttataaacggagtggtatcatggaggtggacagaagcgaagcaaaggaggggcttcgtaggggagagaccacaaaacacgctgtatctcggggcactgccaagctgcgctggttcgtggaacgaaatttggttaaaccagagggtaaggtgatagatctgggctgtgggagaggaggctggtcctactattgcgccgggctcaagaaagtcaccgaagtgaagggatacacaaaaggcggtcctgggcacgaggaacccatcccgatggcgacgtacggatggaacttagtcaagctgcattcaggcaaagacgtgtttttcattccacctgagaagtgtgatacccttctgtgcgacatcggcgagagctcgcccaatccaactattgaagaggggaggacactacgggttctcaaaatggtagaaccctggctgcgcggaaaccaattttgtatcaagattttgaatccttatatgccgtctgtggtcgagaccctggagcagatgcagagaaagcacggtggcatgctcgtgaggaacccccttagtcgaaattccactcatgaaatgtactgggttagctgcgggacaggaaacatcgtgtcagctgtcaatatgacctcccggatgctgttaaaccgtttcacgatggcacacagaaaaccaacctatgagcgcgatgtggacctgggcgccggtacaaggcacgtagctgtggaacctgaggttgccaacttggatataattgggcagcggatcgaaaatatcaagcatgagcacaaatctacttggcattacgacgaggataacccctataagacctgggcataccacggaagctatgaagtcaaacctagtggctccgccagctctatggtgaatggcgtggtcaagctcctgacaaagccatgggacgttattcccatggtgactcaaatagctatgaccgatacaaccccttttgggcagcagagagtattcaaagagaaggtggacactcgcacgccaaaagcgaagaggggaacagcccaaatcatggaagtcaccgcacgatggctatggggttttctttcacggaacaaaaagcccagaatttgtactagggaggaattcacccgcaaggtgcgtagtaatgctgccatcggcgcagtttttgtggacgagaaccagtggaattccgccaaagaggctgtcgaagatgagcggttctgggacctggtgcatagagaaagggagctccacaagcaggggaaatgcgccacatgcgtatacaacatgatgggaaagcgcgaaaaaaagctgggcgagtttggtaaggcgaaagggagccgagcaatttggtacatgtggttgggagcccggttcctggagtttgaagctctcggcttcatgaatgaggatcactggttctctagagaaaactcgctttcaggcgttgagggggagggactgcataagttaggttatatcctgagggacataagcaaaatcccgggcgggaatatgtacgccgatgacacggcaggatgggatacccgcattactgaagacgatttgcagaacgaggctaagatcacagacattatggaacctgagcacgccctcctggctacctccatctttaaactaacttatcaaaataaggtggtcagagtgcagcggccagccaggaacggcacagtgatggatgtcataagtcgtcgagaccagcgcggttctgggcaggttggaacctacggccttaatacattcactaacatggaagcacaactgattagacagatggagagcgagggcatcttttccccctcagaactcgagacccctaacctggcggaacgggtgttggattggttagagaaacatggggtagaaaggctgaagcgcatggccatcagtggagacgactgtgtggtcaagccaattgatgacagattcgctacggccctctctgcacttaatgatatgggtaaagtgcggaaggacataccccagtgggagccgagcaaaggctggaacgattggcagcaagttcctttttgctcccaccacttccatcagctgatcatgaaggacgggagggagattgtggtcccctgtcgaaatcaggatgaactagtgggacgtgctagagtatcacagggcgccggttggagcctgcgcgagaccgcatgcctcgggaaatcttatgcccaaatgtggcagttgatgtactttcaccggagggacctgagacttgcggctaacgccatctgttccgcagttccagtggattgggtccctacaagtcgcactacctggagcattcatgcccaccatcagtggatgacaactgaagacatgctgtcggtgtggaatcgggtttggatcgaggaaaacccctggatggaggataagacccacatatcctcttggggagacgtgccatatctcggcaagagggaggaccaatggtgcggctcattaatcgggctgacggctcgagccacatgggcaaccaatattcaggtcgctatcaaccaggtgagacggttgattggaaatgaaaactacctggattacatgactagcatgaaaaggttcaagaatgagagtgaccccgaaggtgccctctggtga

SEQ ID NO: 13560 - RNA, 9879 nt, synthetic construct
  misc_feature 1..9879: note = derived and/or modified CDS sequence (opt3) from DENV-1__EU677152__SS-prME
  source 1..9879: mol_type = other RNA
agcgtgaccatgctgctaatgcttatgcccaccgcactggctttccacttgactacgagaggcggggaacctcatatgatcgtctccaagcaggaaagggggaagtctttactgtttaagacctcagccggtgttaacatgtgcacactaattgccatggacctcggcgagttctgtgaagatactatgacctacaaatgcccacggataacagaggcggaaccggacgatgtggactgttggtgcaatgctaccgatacttgggtaacatatgggacctgtagtcagacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaagacgcaaactttgtttgccgccgaacattcgtggatagaggctggggtaatgggtgtggactgtttggcaaaggctccttgataacttgcgctaagttcaagtgcgtaaccaaactcgaggggaagacagtgcagtacgaaaacctgaaatattcagtcattgtgaccgttcacactggagaccagcatcaagtgggtaatgagagtacggaacacggcacaaccgccactatcacaccccaggcgcctagcacagagattcagttaaccgactacggggccctgactctcgattgttctccaaggacaggacttgactttaacgaaatggtcctgttgacgatgaaggagaaatcctggctagtgcataagcagtggttcctggatctcccgctgccctggacctcaggcgcaagcacaagtcaagagacatggaatcggaaagaccttctggtaacctttaagacagctcacgccaagaaacaggaagttgtggtcttgggttctcaggagggggctatgcacactgccctcaccggcgcaacggaaatccaaacctccggaacaactaccatcttcgccggccatctgaagtgccgtttaaaaatggataagctgacactaaaagggatgagctatgtgatgtgtactggatcgttcaagctcgagaaggaagtcgctgagacccagcacggtacggtgctggttcagattaaatacgagggcacagacgcgccttgcaagataccattttctacccaggatgaaaaaggggtgactcaaaacggacgccttatcacagcaaatcccattgtaaccgacaaggagaaacctgtcaacatcgaagccgagccacccttcggcgagtcctatatagtgattggtgctggggaaaaggccttgaagctgtcatggtttaaaaagggcagtagcatcggaaaaatgttcgaggcaactgccagaggcgctaggcggatggccatcctcggggataccgcatgggactttggatccattggtggcgttttcacatctgtggggaagctggtccatcagatctttggaacggcgtacggcgtgcttttcagcggtgtatcatggaccatgaaaattgggataggcgtgctgttgacttggctcggactgaatagtcgatccactagcttatctatgacctgtatcgctgttggcctggtcacactatacctcggggtgatggtgcaggccgattcaggatgcgtcattaactggaagggccgcgaactgaagtgtggtagtgggatctttgttactaatgaggtgcacacctggacggaacagtataaattccaagcagacagcccgaagagactttccgccgctatcggaaaagcctgggaggagggcgtgtgcggtattaggtctgcaacacggttggaaaacataatgtggaagcagatctcgaacgagctgaatcatattctcctggaaaacgacatgaaatttaccgtagtcgtgggcgatgttgctgggatcttagcccagggaaagaaaatgattcgccctcagcccatggagtacaagtatagctggaagtcctggggcaaagcgaagatcataggggccgacgtgcaaaatactaccttcatcattgatggaccaaacacacctgaatgtcccgacgatcagagagcttggaatatctgggaggtcgaggactacggctttggtattttcactaccaacatctggctgaaacttagggattcatatacacaggtgtgcgaccaccgtttgatgagtgcagccataaaggattctaaagctgttcacgccgacatggggtactggattgaaagcgagaagaatgaaacgtggaagctcgcacgggcgtccttcatcgaggtgaaaacctgtatttggccaaagtcacatactctgtggagcaacggagtactagaatctgagatgatcatacccaaaatctatggcggtcctatttcccagcacaattaccgaccaggctactttacacaaaccgccgggccgtggcatctgggaaagctcgagctggatttcgacctttgcgaaggcactacagtcgtggtggatgagcactgcgggaacagaggacccagtttgaggaccacgactgtcaccggcaaaatcattcacgaatggtgttgccgcagctgtacactgcctccattacggtttaagggtgaggacgggtgctggtatggaatggagatcagacccgttaaggaaaaagaggaaaatctcgtgaagtctatggtatccgctggctcaggtgaggtggacagtttcagcctgggccttctgtgtatatcgattatgatcgaagaggtcatgaggtcccgctggtctcgaaaaatgttgatgaccgggactctcgccgtgtttttcctgctaatcatgggacagctgacatggaacgatctcattcggctgtgcatcatggttggcgcaaatgctagcgaccgtatggggatgggaaccacataccttgccttgatggcaacttttaagatgagacctatgttcgccgtgggcctgttatttaggcgcctcacctcacgggaggtcctgcttctgacgattggtctaagtctcgtggcttccgttgaactgccaaactctttggaggaactgggggatggattagcgatgggcataatgatcctcaaactgcttacagacttccagagccatcaactgtgggccaccttgctctccctgacttttattaagaccacattctcactacactatgcatggaagactatggctatggtgctgagcatcgtcagtctttttcccctctgtctgtctaccacgtcccagaaaacaacctggttgccggtactgttaggcagcctcgggtgcaagcctctgactatgttccttattgccgagaataaaatctggggaagaaagtcgtggccactgaacgaaggtataatggccgtgggcatcgtttcaattttgctctctagtctgctcaagaatgatgtgcccctggctgggcctcttatcgcaggaggcatgctcattgcctgttacgtcatctccggtagctctgcggacctgagcttggagaaggctgccgaggtgtcctgggaagaggaagcagagcattcaggggccagtcacaatatattagtagaagtgcaggatgacggaacaatgaaaattaaggatgaggagagggacgataccctgactatcctcctgaaggctacacttctggcagtcagcggcgtttatcccttgtctatcccagccaccctattcgtgtggtacttttggcagaaaaagaaacaacgatccggcgtgctgtgggacacgccttcacccccagaagtcgagcgcgcggtgctcgatgacgggatttatcggataatgcagagaggactgcttggtaggagtcaggttggcgtaggggtgttccaggaaaacgtctttcatactatgtggcacgtgacccgtggagctgttttaatgtaccaaggcaagcgcctggagccgagctgggcctccgtgaaaaaggacctcatctcttacggtgggggatggcggttgcagggctcgtggaatacaggcgaggaagtccaggtgattgcagtagagcctgggaagaaccccaaaaatgtccagaccgccccaggaacattcaagactagcgaaggtgaggtgggcgctatcgccctggattttaaacccgggacctcaggatcccctattgttaacagagaaggcaagatcgtgggtctctatgggaatggagtcgtgacgacaagtggcacttacgtttctgcaatagctcaagccaaagcgagccaggagggcccactgcccgagatcgaagacgaggtgttcaggaagcgaaaccttaccattatggatctgcaccctgggtccggaaagacacggcgctatttgccggccatcgtcagagaagcaattaaaaggaagctacggaccctgatcctcgctccaactcgagtggtagcctcagagatggctgaagcattaaaaggtatgcccataagataccagaccacagccgtgaagtctgagcatacgggcaaagagattgttgacctgatgtgccacgccacttttaccatgcgccttctgagccctgtcagggtgccaaattataacatgatcatcatggatgaagctcatttcacagaccccagttccattgcggcacgtgggtacatcagcacccgggtgggaatgggcgaggccgctgccatatttatgactgcaacacctccgggttctgtcgaagccttcccccaatcaaatgctgtaattcaggatgaggaaagagacatcccagagaggtcctggaacagtgggtatgagtggattaccgattttcctggaaagacggtgtggttcgttcccagcatcaagtcgggcaatgacatagcgaactgtctccgcaaaaatggcaagcgagtgattcagttgtctagaaaaactttcgatacagaataccagaagaccaaaaacaacgactgggactacgtcgtgaccactgatatctccgagatgggggccaattttcgggcagacagggttatcgatccacgccgttgcctgaagcctgtgattctcaaggacggacccgaaagagtcatcctggctggtccaatgccggtgacagtagccagcgcagcccaacggaggggccgcattgggcgaaaccacaataaagagggagatcagtatatatacatgggccagcctcttaacaatgacgaggatcatgctcactggaccgaagccaagatgctactggacaacatcaatacacccgagggtattatcccagcgttgttcgaacccgagagagaaaaatcagcagccatcgatggggagtatcggttaaggggcgaggctcgcaagacttttgtggaactgatgagaaggggagacctccctgtttggctgagttacaaagtcgcctctgagggcttccagtattccgatcggcgttggtgctttgacggggaacgcaacaatcaagtgcttgaggaaaacatggatgtggagatttggacgaaggagggagaacgaaagaaactgagaccaaggtggctcgacgctcggacctacagcgaccccttggcactgcgcgagttcaaagaatttgccgctggtagaaggtcagtcagtggcgatctaatactggagatcgggaaactccctcagcaccttacacagcgggcccagaatgcactggacaacttagttatgttgcataatagcgaacaaggaggccgagcgtatagacacgccatggaggagctgccggatactattgaaaccctcatgctgcttgctctgatcgccgtgctcacaggtggggtaaccttgttctttctgtccggccgcggattaggcaagacttctattgggctactgtgtgtgatggcaagctccgtcctcctttggatggcttcagtggagccacattggatcgccgcatctataatcctggagttctttttgatggttctgctcattcccgagcctgacaggcagcggacgccccaggataaccagctggcctacgtggtcatcggacttctcttcatgattctgaccgtagctgcgaatgagatgggtttgctggaaacaactaaaaaggacttaggcatcgggcacgccgcagtggagaaccaccatcacgctgccatgctagatgttgacctgcatccagccagtgcatggaccctctacgctgtggccacaaccataattactcctatgatgcgtcacacaatcgaaaacacgaccgcgaatatttcgcttactgctatcgccaaccaagcagccatactgatgggattggataaaggctggcccatcagcaagatggacattggtgtcccactgctcgctctggggtgctattcccaggtgaatcctcttacattaaccgcagccgtcctgatgctcgtggcgcattacgctatcattggcccgggattgcaggccaaggcaaccagagaggcccagaagaggacagctgccggcatcatgaagaaccccactgttgatgggatagtggcaattgacctggatccagtagtgtatgacgctaaatttgaaaagcagctaggacagatcatgctgctcatcctttgtacgtctcagattctgttgatgcgcaccacatgggccctgtgcgagtcaatcactctcgcgaccggccctctgacaaccttatgggagggtagccccgggaaattctggaatactacgatagccgtctccatggcaaacattttccggggaagttaccttgctggcgccggtctggcattttctctcatgaaaagcctaggcgggggacgaagaggcacaggggctcaaggagaaaccctgggcgagaagtggaaaaggcagttgaatcagctgtcaaagtccgagttcaacacttataaacgcagtggtatcatggaggttgaccggagcgaagccaaggaggggctcaaaagaggagagaccacaaagcacgccgtgtctcgtggcactgcgaaacttaggtggtttgtcgaacggaatctggtgaaaccagagggtaaggtaattgatttgggctgtgggcgcggaggctggtcctactattgcgctgggctgaaaaaggtgaccgaagttaaaggatacacaaagggcggtcctgggcacgaggaacccatcccgatggcaacgtacggatggaacctcgtgaaattacattcaggcaaggacgtcttctttataccacctgagaagtgtgataccctgctttgcgacatcggcgagagctcgcccaatccaactattgaagaggggcgaacactgagagtgctaaaaatggtcgaaccctggctcaggggaaaccagttctgtatcaagattctgaatccttatatgccgtctgtggttgagaccttggagcaaatgcagcggaaacacggtggcatgctggtacgcaaccccctcagtagaaattccactcatgaaatgtactgggtgagctgcgggacaggaaacatcgtctcagccgtgaatatgacctccaggatgcttctgaaccgatttacgatggctcaccggaagccaacctatgagcgtgatgttgacttaggcgccggtacaagacacgtggcagtcgaacctgaggtggccaacctggatattatcgggcagcgcatagaaaatattaaacatgagcacaagtctacttggcattacgacgaggataacccctataagacctgggcttaccacggaagctatgaagtaaaacctagtggctccgcgagctctatggtgaatggcgttgtcaagttgctcacaaaaccatgggacgtgatccccatggtgactcagatcgccatgaccgatacaacccctttcgggcaacagagggtctttaaggagaaagttgacactcggacgccaaaggcaaagagaggaacagctcagattatggaagtgaccgccaaatggctgtggggtttcctatcacgcaacaagaaacccaggatatgtactcgagaggaatttacccggaaggtaagaagtaatgcagccatcggcgctgtgttcgtcgacgagaaccaatggaactccgccaaagaggcggtggaagatgagaggttttgggaccttgttcatcgcgaacgtgagctgcacaagcaggggaagtgcgcaacatgcgtgtacaacatgatgggaaaacgggaaaagaaactcggcgagttcggtaaggccaaagggagcagagctatttggtacatgtggctgggagccaggttcttggagtttgaagcactgggcttcatgaatgaggatcactggttttctcgcgaaaactcgctctcaggcgtcgagggggagggacttcataagctgggttatatcttacgagacattagcaaaatcccgggcgggaatatgtacgctgatgacacggccggatgggatacccggataactgaagacgatctgcagaacgaggctaagatcacagacattatggaacctgagcacgccttgctcgcaaagtccatcttcaaactgacctatcagaataaggtggtaagagttcaaaggccagcgaaaaacggcactgtgatggatgtcattagtcgcagagaccagcggggttctggacaggtgggaacatacggcctaaatacctttacaaacatggaagcccagcttatcaggcaaatggagagcgagggcatattctccccctcagaactggagactcctaacctcgctgggcgtgtgctggattggttggaaaagcatggagtcgagcgattaaaacgcatggccattagtggtgacgactgtgttgtgaagccaatcgatgacagatttgcaaccgctctgacggccctcaatgatatgggcaaggtacggaaagacatcccccagtgggaaccgtctaaggggtggaacgattggcaacaggtgcctttctgcagccaccactttcatcaacttattatgaaagacggaagggagatagtcgtgccctgtcgcaatcaggatgagctggttggcagagcacgggtgtcccagggtgccgggtggtcactaagggaaaccgcgtgcctgggaaagagctatgctcagatgtggcaactcatgtacttccaccgacgtgacttgagactggccgcaaacgccatctgttctgctgtcccagtggattgggtacctacatcccgcactacctggagtattcatgcccaccatcagtggatgacaactgaggacatgcttagcgtttggaatcgggtgtggatcgaagagaacccctggatggaagataaaacccacatttcgtcctggggcgacgtcccatatctgggcaagagggaggaccagtggtgcgggtctctcatcggattaacggcaagagctacatgggccaccaatatacaagtggcgatcaaccaggttcgccggctgattggtaatgagaactacttggattacatgacttcaatgaagaggtttaaaaatgaaagcgaccccgagggcgctctgtggtga

SEQ ID NO: 13561 - RNA, 9879 nt, synthetic construct
  misc_feature 1..9879: note = derived and/or modified CDS sequence (opt3) from DENV-1__EU677155__SS-prME
  source 1..9879: mol_type = other RNA
agcgtgaccatgctgctcatgcttatgcccacggccctggctttccacttgactacgagaggaggggaacctcatatgatcgtctccaagcaggaaagaggaaaatctttactgtttaagacctcagccggtgttaatatgtgcacactaattgccatggacctcggcgaactgtgtgaagatactatgacctacaaatgcccacggattacagagaccgaaccggacgatgtggactgttggtgcaatgcgactgatacatgggtgacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccggtagcttcaaactggagaaggaagtcgccgagacgcagcacggaacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattgtgatcggtgccggggaaaaagctctgaagctctcctggttcaagaaaggctcaagtatcggaaagatgtttgaggccaccgcaagaggcgccaggcggatggctattctgggggatacagcctgggacttcggaagcatcggtggcgtttttacgtccgtggggaaacttgtccatcagattttcggaaccgcatacggcgtgctgttttctggtgtaagctggactatgaagatagggatcggcgtgttgctcacatggctgggattaaattcacgaagtacctccctgagcatgacatgtattgcggttggcctagtcactctctacctgggggtgatggtgcaggctgattctggatgcgtcatcaactggaaaggccgcgaacttaagtgtggttcagggatcttcgttaccaatgaggtgcacacgtggacagaacaatataagtttcaggccgacagtccgaaaagattgagcgcagccattggaaaggcttgggaggagggcgtgtgcggtataaggtccgccacccggctggaaaacatcatgtggaaacagatttctaacgagctcaatcatatcctgttagaaaacgacatgaagttcactgtagtcgtgggcgatgttgcagggattctggctcagggcaaaaagatgatccgccctcaacccatggagtacaaatattcgtggaaaagctggggcaaggccaagataatcggggcggacgtgcagaataccacatttattatcgatggaccaaacactcctgaatgtcccgacgatcagagagcctggaatatttgggaggtcgaggactacggcttcggtatctttaccacaaacatatggcttaagttgagggattcctatacacaggtgtgcgaccaccgtctcatgtcagctgcaattaaagatagtaaggccgttcacgctgacatggggtactggatcgaatctgagaaaaatgaaacctggaagctggcccgggcatccttcattgaggtgaagacttgtatctggccaaaatcccatacactatggtcaaacggagtactggaaagcgagatgataatccccaagatttatggcggtcctatctctcaacacaattaccgaccaggctacttcacccagactgcggggccgtggcatctcggaaaactggagcttgattttgacttgtgcgaaggcacaaccgtcgtggtggatgagcactgcgggaacagaggaccctccctgaggacgactaccgtcacaggcaagattatccacgaatggtgttgccgcagttgtaccttacctccactccggttcagaggtgaggacgggtgctggtatggaatggagataaggcccgttaaagaaaaggaggaaaatctggtaaagagcatggtatctgccggctccggtgaggtggactcatttagtcttggcctgttgtgtattagcatcatgatcgaagaggtcatgcgctcgcgatggtcccggaaaatgctcatgactgggacactggctgtgttctttctactgattatgggacagctcacctggaacgatctgatccgtctttgcattatggttggcgccaatgcatctgacagaatggggatgggaacaacttacttggctctgatggccaccttcaagatgaggcctatgtttgcagtgggcttactcttccgccggctgacgagcagagaggtccttctgctaacaataggtctctcactggtggccagtgttgaattgccaaactccctggaggaattaggggatggactcgctatgggcatcatgattctgaaacttctgaccgactttcaatctcatcagttgtgggcgactctcctgagcctaaccttcatcaagacaactttttccctgcactatgcctggaaaaccatggcaatggtgctttcaattgtcagcctcttccccctgtgtttgagtacgacatctcagaagaccacttggctgccggtattactcggctccctggggtgcaagcctcttacaatgtttctgatcgctgagaataaaatatggggaaggcgaagctggccattgaacgaaggtatcatggccgtgggcattgtttcgatcctcctgtcatctctactgaagaacgatgtgccccttgccgggcctctcattgctggaggcatgctgatcgcatgttacgtcataagtggttccagcgccgacttgtctttagagaaagcggctgaggtgagctgggaagaggaagccgagcattccgggacctcacacaatattctggtagaagtgcaggatgacggaactatgaagatcaaagatgaggagcgcgacgatacactcaccatcctgcttaaggcaacgctgttggccgtcagtggcgtttatcccctaagcattccagctactctgttcgtgtggtacttctggcagaaaaagaagcagcggtctggcgtgctctgggacaccccttcacccccagaagtcgagagagcagtgctggatgacgggatatataggatcatgcagcgtggacttttaggtcgcagccaggttggcgtaggggtgtttcaagaaaacgtcttccatacaatgtggcacgtgacccggggagccgttctgatgtaccagggcaaaagactcgagccgagttgggcgagcgtgaagaaagacttgatttcctacggtgggggatggaggctgcagggctcttggaatacaggcgaggaagtccaggtgatcgctgtagagcctgggaagaaccccaaaaatgtccaaactgccccaggaacctttaagacgcccgaaggtgaggtgggcgcaattgccctcgatttcaagcctgggacatcgggaagcccaatcgttaaccgagaaggcaaaatagtgggtctgtatgggaatggagtcgtgactacctcaggcacatacgtttccgctatcgcccaggcaaaggctagtcaggagggcccccttcctgagattgaagacgaggtgtttcggaaacgcaacctgaccatcatggatttgcacccggggtctggaaagactagaaggtatctaccagccattgtccgggaagcgatcaaacgaaagctgagaaccctcatattagcccccacacgcgtggtagcaagcgagatggctgaagccctgaagggtatgcctattaggtaccaaacgactgctgtgaaatccgagcataccggcaaggagatcgttgaccttatgtgccacgcaacattcaccatgcgtctgctctcaccagtccgggtgcccaattataacatgatcattatggatgaagcccattttactgacccttctagcatcgccgctagagggtacataagtacaagggtgggaatgggcgaggcggcagccattttcatgaccgctacgccgcccggttccgtcgaagcctttccacagagcaatgcagtaatccaggatgaggaacgcgacattcctgagcgatcttggaactcagggtatgagtggatcactgatttccccggaaaaacagtgtggtttgttccatccataaagagtggcaatgacattgccaactgtttgaggaaaaatggcaagcgggtgatccagctgagcaggaagaccttcgataccgaataccagaaaactaagaacaacgactgggactacgtcgtgacaaccgatatctcggagatgggggctaatttccgcgcggaccgtgttattgatcctagacggtgcctcaaacccgtgatcctgaaggacggaccagaaagggtcattcttgccggtccgatgcctgtgacagtagcatctgctgcccagcgccgaggcagaatagggcggaaccacaataaagagggagatcagtatatctacatgggccagcccctaaacaatgacgaggatcatgcacactggactgaagccaagatgctgttggacaacattaatacgccagagggtatcatccccgctttatttgaacctgagagggaaaagtccgccgcgattgatggggagtatcgcctgagaggcgaggcaaggaaaaccttcgtggaactcatgcggcgtggagacctgccagtttggcttagctacaaggtcgcctcagagggctttcaatatagtgatcgccgatggtgcttcgacggggaaagaaacaatcaggtgctggaggaaaacatggatgtggagatatggacaaaagagggagaaaggaagaaactccggccccgctggttggacgctagaacttactctgaccctctggccctaagggagtttaaggagttcgctgcaggtcggcgatccgtcagcggcgatctgatcctcgagattgggaaacttccgcagcacctgacccagagagcccaaaatgctttagacaacttggttatgctgcataattcagaacagggaggccgcgcctataggcacgcaatggaggagctcccagatacaatcgaaaccctgatgcttctggcgctcattgccgtgttgactggtggggtaacgctgtttttcttaagtggccggggactaggcaagaccagcatcgggctgctctgtgtgatggcttcctctgtccttctgtggatggccagcgtggagccccattggatagcagcttccatcattttggaatttttcctgatggttctcctgatccctgagcccgaccgtcagagaacaccacaggataaccaacttgcctacgtggtcattggactcctgtttatgatcttgactgtagcagccaatgagatgggtctgttagaaaccacaaagaaagacctaggcatagggcacgtggctgttgagaaccaccatcacgcggccatgctggatgtggacctccatcctgcatcagcttggaccctttacgccgtcgccactacaattatcacgcccatgatgaggcacaccattgaaaacactacagcaaatatctctctgaccgctatagccaaccaggcggctatcttgatgggactggataagggctggccaattagtaaaatggacatcggtgtgcctctcctggcccttgggtgctattcgcaggtcaatccgttaaccctgacagcagccgtgctcatgttggttgctcattacgcaattatcggccccggactgcaagccaaggcgactcgcgaggctcagaaacggacggccgcaggcataatgaagaacccaaccgtggatgggattgtagccatcgacctagatcctgtggtctatgacgctaagttcgaaaaacagctgggacagatcatgctccttattctgtgtacaagccaaatcttgctgatgcgaactacctgggccctctgcgagtccataacactggcaaccggccccttaactacgctttgggagggttctccagggaagttttggaatacaaccattgctgtttcaatggccaacatcttcagaggaagctacctggcgggcgccggtctcgcattctccctaatgaaaagtctgggcgggggaaggcgcggcactggggctcagggagaaaccttgggcgagaagtggaaacggcagctgaatcagctctctaagagcgaatttaacacatataagagatcaggtattatggaggtggaccgttccgaagccaaagaggggcttaagaggggagagactaccaaacacgcagtcagtcggggcacagctaagctgcgctggttcgtggaacgaaatttggtaaaacctgagggtaaggtgatcgatctgggctgtgggagaggaggctggagctactattgcgccgggctcaagaaagttacggaagtgaagggatacaccaaaggcggtcccgggcacgaggaaccgataccaatggccacttacggatggaacttagtcaagctgcattctggcaaagacgtgtttttcatccctcccgagaagtgtgatacacttctgtgcgacattggcgagtcctcaccaaatcccaccatcgaagaggggaggactctacgggtcctcaaaatggtggaaccttggctgcgcggaaaccaattttgtattaagatcttgaatccgtatatgcccagcgttgtagagacactggagcagatgcagagaaagcacggtggcatgctcgtgaggaacccactttcgcgaaattctacccatgaaatgtactgggtcagttgcgggacgggaaacattgtgtccgcggttaatatgaccagccggatgctgttaaaccgtttcacaatggctcacagaaaacctacttatgagcgcgatgtggacctgggcgcaggtaccaggcacgtcgccgtggaacccgaggtagctaacttggatatcatagggcagcggattgaaaatatcaagcatgagcacaaatcaacatggcattacgacgaggataacccttataagacttgggcctaccacggatcctatgaagtgaaaccatctggcagcgcaagttccatggttaatggcgtcgtgaagctcctgaccaagccctgggacgtgatccctatggtcacacaaattgccatgaccgatactacgccatttgggcagcagagagttttcaaagagaaggtggacacacgcacccccaaagctaagaggggaactgcgcaaataatggaagtaaccgccaaatggctatggggttttcttagccgaaacaagaagccgcggatctgtacaagagaggagttcacgaggaaagtgcgctctaatgcagctattggcgccgtctttgtggacgagaaccagtggaactcagcaaaggaggccgttgaagatgagcgtttctgggacctggtgcatcgggaaagagagctccacaaacaggggaagtgcgctacctgcgtctacaacatgatgggaaaaagggaaaagaagctgggcgagtttggtaaagccaaggggagtcgcgcgatctggtacatgtggttgggagcacgattcctggagttcgaagccctcggctttatgaatgaggatcactggttctcccgggaaaacagcctttctggcgtggagggggagggactgcataaattaggttatattctgagagacatctcgaagatacctggcgggaatatgtacgctgatgacactgccggatgggatacaaggatcaccgaagacgatttgcagaacgaggcacgcattactgacatcatggaaccagagcacgctctcctggccggctcaatttttaaactaacatatcaaaataaggtagttagagtgcagcggcccgctaaaaacggtaccgtcatggatgtgatcagcaggcgtgaccagcgagggtccggacaggtgggcacatacggccttaatactttcaccaacatggaagcccaactgatacgccagatggagagtgaggggatattttctcctagcgaactcgagacgccaaacctggcagaaagagtcttggattggttagagaagtatggagttgaacggctgaagaggatggcgatctccggtgacgactgtgtggtaaaacccatcgatgaccgcttcgccaccgctctcacagcccttaatgatatgggcaaggtgagaaaagacattccgcagtgggagccttcaaaggggtggaacgattggcagcaagtccccttttgcagtcatcacttccaccagctgataatgaaagacggacgggagatcgtggttccatgtaggaatcaggatgagctagtgggccgagcacgtgtctctcagggtgctgggtggagcctgagagagactgcctgcctcggaaagtcctacgcacaaatgtggcagttgatgtattttcatcgccgggacctgaggcttgccgcgaacgctatttgttcagccgtgcctgtagattggatccccaccagcagaacaacttggtctattcacgcacatcaccagtggatgaccacggaagacatgctgtccgtttggaatcgcgtgtggatcgaggaaaacccatggatggaggataagacacatataagtagctggggcgacgtcccctacctcggcaaacgggaggaccaatggtgcgggtcgttaatcggactgaccgccagggctacttgggccacaaatattcaggtggcaatcaaccaggttcgaagattgattggtaatgaaaactacctggattatatgacctccatgaagcggttcaaaaatgagtctgaccctgaaggcgctctctggtga

SEQ ID NO: 13562 - RNA, 9879 nt, synthetic construct
  misc_feature 1..9879: note = derived and/or modified CDS sequence (opt3) from DENV-1__EU677157__SS-prME
  source 1..9879: mol_type = other RNA
agcgtgaccatgctgctcatgcttatgcccacagccctggctttccacttgactacgagaggaggggaacctcatatgatcgtctccaagcaggaaagaggaaaatctttactgtttaagacctcagccggtgttaatatgtgcacactaattgccatggacctcggcgagctgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaactttggtggatagaggctggggtaatgggtgtggactctttggcaaaggctccctgataacctgcgcaaagttcaagtgcgtaacaaaattagaggggaagattgtgcagtacgaaaacctgaaatattcagtcatcgtgaccgttcacactggagaccagcatcaagtgggtaatgagagtacggaacacggcacaaccgctactattacaccccaagcccctaccaccgagatccagctcactgactacggggcgcttacactggattgtagcccaaggacgggattggactttaacgaaatggtcctactgaccatgaaggagaaatcttggctcgtgcataagcagtggttcctggatcttccgctgccctggacttccggcgcctcaacaagccaagagacctggaatcggcaggacttgctcgtaacatttaaaactgcacacgctaagaagcaggaagttgtggtcctgggtagtcaagagggggccatgcacaccgctttaacgggcgccaccgaaatccagacatctggaactaccacaattttcgcaggccatctgaaatgccgtctaaagatggataaactcactctgaaggggatgtcctatgtgatgtgtaccgggtcgtttaaacttgagaaggaattggccgagacgcagcacggtacagtcctggtgcagataaagtacgagggcaccgacgctccttgcaaaatcccattctcgactcaagatgaaaagggggttacacagaacggacgcctcattaccgcgaatcccatcgtgactgacaaagagaagcctgtaaacatagaagcagagccacccttcggcgagtcttatattgtcatcggtgccggggaaaaagctctgaaactttcctggtttaagaaaggctcaagtatcggaaagatgttcgaggccaccgcaagaggcgccaggcggatggctattctgggggatacagcctgggactttggaagcatcggtggcgtgttcacgtccgttgggaaattggtgcatcagatttttggaaccgcatacggcgtcctcttctctggtgtgagctggactatgaagatagggatcggcgtactgttaacatggctgggactaaattcacgaagtacctccctcagcatgacatgtattgcggtgggcctggttactctttacttgggggtcatggtgcaggctgattctggatgcgtgatcaactggaaaggccgcgaactgaagtgtggttcagggatctttgtcaccaatgaggttcacacgtggacagaacaatataagttccaggccgacagtccgaaaagactcagcgcagccattggaaaggcttgggaggagggcgtgtgcggtataaggtccgccacccggctggaaaacatcatgtggaaacagatttctaacgagttaaatcatatcctgcttgaaaacgacatgaagtttactgtggtagtcggcgatgtggcagggattttggctcagggcaagaagatgatccgccctcaacccatggagtacaaatattcgtggaaaagctggggcaaggccaagataatcggggcggacgttcagaataccacattcattatcgatggaccaaacactcctgaatgtcccgacgatcagagagcctggaatatttgggaggtggaggactacggctttggtatcttcaccacaaacatatggctcaagctgagggattcctatacgcaggtctgcgaccaccgtctaatgtcagctgcaattaaagatagtaaggccgtgcacgctgacatggggtactggatcgaatctgagaaaaatgaaacctggaagctggcccgggcatcctttattgaggttaagacttgtatctggccaaaatcccatacactctggtcaaacggagtgctggaaagcgagatgataatccccaagatttatggcggtcctatctctcaacacaattaccgaccaggctacttcacccagactgcggggccgtggcatcttggaaaattggagctggatttcgacttatgcgaaggcacaaccgtagtcgtggatgagcactgcgggaacagaggaccctccctcaggacgactaccgtgacaggcaagattatccacgaatggtgttgccgcagttgtaccctgcctccacttcggtttagaggtgaggacgggtgctggtatggaatggagataaggcccgtcaaagaaaaggaggaaaatctggttaagagcatggtgtctgccggctccggtgaggtagactcattcagtttgggcctcctgtgtattagcatcatgatcgaagaggtgatgcgctcgcgatggtcccggaaaatgctaatgactgggacactggctgtctttttcctcctgattatgggacagcttacctggaacgatttgatccgtctgtgcattatggtgggcgccaatgcatctgacagaatggggatgggaacaacttacttagctctcatggccacctttaagatgaggcctatgttcgcagttggcctgctttttcgccggctgacgagcagagaggtgctactcctgacaataggtttgtcactggtcgccagtgtggaattaccaaactccctcgaggaactgggggatggacttgctatgggcatcatgattctgaaattgctcaccgacttccaatctcatcagctgtgggcgactctactgagccttacctttatcaagacaactttctccctccactatgcctggaaaaccatggcaatggttctgtcaattgtgagcttgtttcccctgtgtttaagtacgacatctcagaagaccacttggctcccggtcctgcttggctccctggggtgcaagcctttgacaatgttcctcatcgctgagaataaaatatggggaaggcgaagctggccactgaacgaaggtatcatggccgtaggcattgtgtcgatcctactgtcatctcttctcaagaacgatgttcccctggccgggcctttgattgctggaggcatgttaatcgcatgttacgtgataagtggttccagcgccgacctgtctctcgagaaagcggctgaggtcagctgggaagaggaagccgagcattccggggcatcacacaatattctggtggaagtacaggatgacggaaccatgaagatcaaagatgaggagcgcgacgatactcttacaatcctgttgaaggccaccctactggctgtgagtggcgtctatcccctcagcattccagcaacgctgtttgtttggtacttctggcagaaaaagaagcagcggtctggcgtgctttgggacactccttcacccccagaagtggagagagccgtcttagatgacgggatatataggatcatgcagcgtggactgctcggtcgcagccaggtgggcgttggggtattccaagaaaacgtgtttcataccatgtggcacgtcacacggggagcggtgttgatgtaccagggcaaaagactggagccgagttgggctagcgttaagaaagacctcatttcctacggtgggggatggaggctgcagggctcttggaataccggcgaggaagtgcaggtcatcgccgtggagcctgggaagaaccccaaaaatgtacaaacagcaccaggaactttcaagacccccgaaggtgaggtcggcgccattgctcttgattttaagcctgggacgtcgggaagcccaatcgtgaaccgagaaggcaaaatagttggtctgtatgggaatggagtggtcacaacttcaggcacctacgtgtccgccatcgcacaggctaaggccagtcaggagggccccttgcctgagattgaagacgaggttttccggaaacgcaacctaacaatcatggatctgcacccggggtctggaaagaccagaaggtatctcccagcgattgtgcgggaagccatcaaacgaaagttaagaactctgatacttgcacccacccgcgtcgtggctagcgagatggccgaagctctgaagggtatgcctattaggtaccaaacaacggcagtaaaatccgagcatactggcaaggagatcgtggacctcatgtgccacgccacctttacaatgcgtttgctgtcaccagttcgggtccccaattataacatgatcattatggatgaagcccatttcaccgacccttctagcatcgctgcgagagggtacataagtactagggtgggaatgggcgaggcagccgctatttttatgacagccaccccgcccggttccgtggaagcattcccacagagcaatgccgtcatccaggatgaggaacgcgacattcctgagcgatcttggaactcagggtatgagtggatcacggattttcccggaaaaactgtatggttcgtgccatccataaagagtggcaatgacattgctaactgtctcaggaaaaatggcaagcgggttatccagctgagcaggaagacatttgataccgaataccagaaaaccaagaacaacgactgggactacgtggtcactacagatatctcggagatgggggcgaatttccgcgccgaccgtgtgattgatcctagacggtgccttaaacccgttatcctaaaggacggaccagaaagggtgattctggcaggtccgatgcctgtcaccgtggcttctgccgcacagcgccgaggcagaatagggcggaaccacaataaagagggagatcagtatatctacatgggccagcccttgaacaatgacgaggatcatgcccactggacagaagctaagatgttactggacaacattaatactccagagggtatcatccccgccctcttcgaacctgagagggaaaagtccgcggcaattgatggggagtatcgcctgagaggcgaggccaggaaaacgtttgtagaacttatgcggcgtggagacctgccagtgtggctcagctacaaggttgcttcagagggcttccaatatagtgatcgccgatggtgctttgacggggaaagaaacaatcaggtcttggaggaaaacatggatgtggagatatggaccaaagagggagaaaggaagaaactgcggccccgctggctagacgccagaacatactctgaccctctggctctcagggagttcaaggaatttgcagccggtcggcgatccgtgagcggcgatcttatcctggagattgggaaattaccgcagcacttgactcagagagctcaaaatgccctggacaacctcgtcatgctgcataattcagaacagggaggccgcgcatataggcacgcgatggaggagcttccagataccatcgaaacactgatgctcttggccctgattgctgttttaaccggtggggtgactctattctttctgagtggccggggactcggcaagacgagcatcgggcttctgtgtgtaatggcctcctctgtgttgctgtggatggcaagcgtcgagccccattggatagctgcctccatcattctcgagttctttctgatggtgcttctcatccctgagcccgaccgtcagagaaccccacaggataaccaactggcatacgttgtgattggattgctgttcatgatcttaacagtcgccgctaatgagatgggtctactggaaactaccaagaaagacctcggcatagggcacgtagcggtggagaaccaccatcacgccgcaatgcttgatgttgacctgcatcctgcttcagcctggacattgtacgccgtggcaaccactattatcacacccatgatgaggcacacgattgaaaacaccactgctaatatctctctgacagccatagcgaaccaggctgccatcctcatgggactggataagggctggccaattagtaaaatggacatcggtgtccctcttttagcactggggtgctatagccaggtgaatccgctcaccttgaccgccgctgtcctgatgctagtggcacattacgccattatcggccccggactgcaagcgaaggctacacgcgaggcccagaaacggactgcagccggcataatgaagaacccaacggttgatgggattgtggctatcgacctcgatcctgtagtgtatgacgccaagtttgaaaaacagcttggacagatcatgctgttgattctgtgtaccagccaaatcctcctgatgcgaacaacttgggcattatgcgagtccataacccttgctacaggccccctgaccactctctgggagggttctccagggaagttctggaatacgacaattgccgtctcaatggcgaacatctttagaggaagctacctagccggcgcaggtctggctttctccttgatgaaaagtctgggcgggggaaggcgcggcaccggggcccagggagaaactctcggcgagaagtggaaacggcagcttaatcagctgtctaagagcgagttcaacacctataagagatcaggtattatggaggttgaccgttccgaagcaaaagaggggttgaagaggggagagacaactaaacacgctgtgagtcggggcaccgccaagctgcgctggtttgtcgaacgaaatctcgtgaaacctgagggtaaggtaatcgatttaggctgtgggagaggaggctggagctactattgcgccgggctgaagaaagtgacagaagttaagggatacacgaaaggcggtcccgggcacgaggaaccgataccaatggcgacctacggatggaaccttgtgaagctgcattctggcaaagacgtcttctttatccctcccgagaagtgtgatactctactctgcgacattggcgagtcctcaccaaatcccacaatcgaagaggggaggaccctgcgggtgttgaaaatggtcgaaccttggctgcgcggaaaccaattctgtattaagatcctcaatccgtatatgcccagcgtggttgagactcttgagcagatgcagagaaagcacggtggcatgctggtaaggaacccattatcgcgaaattctacacatgaaatgtactgggtgagttgcgggaccggaaacattgtctccgctgtgaatatgacgagccggatgctgttgaaccgttttaccatggcacacagaaaacctacatatgagcgcgatgttgacctcggcgccggtactaggcacgtggctgtcgaacccgaggtggccaacctggatatcatagggcagcggattgaaaatatcaagcatgagcacaaatcaacctggcattacgacgaggataacccttataagacatgggcataccacggatcctatgaagtaaaaccatctggcagcgccagttccatggtgaatggcgttgtcaagctacttactaagccctgggacgtgatccctatggtgacccaaattgctatgacagataccactccattcgggcagcagagagtctttaaagagaaggttgacacgcgcacacccaaagcgaagaggggaaccgcccaaataatggaagtgactgcaaaatggctgtggggtttcctcagccgaaacaagaagccgcggatctgtaccagagaggaatttacaaggaaagtacgctctaatgctgccattggcgcagtgttcgtcgacgagaaccagtggaactcagccaaggaggctgtggaagatgagcgtttttgggacctggttcatcgggaaagagagttgcacaaacaggggaagtgcgccacgtgcgtgtacaacatgatgggaaaaagggaaaagaagctgggcgagttcggtaaagcgaaggggagtcgcgcaatctggtacatgtggctcggagcccgatttcttgagttcgaagctctgggcttcatgaatgaggatcactggttttcccgggaaaacagcttatctggcgtcgagggggagggactgcataaattgggttatattctcagagacatctcgaagatacctggcgggaatatgtacgccgatgacaccgcaggatgggatactaggatcacagaagacgatctgcagaacgaggctcgcattaccgacatcatggaaccagagcacgccctacttgctaaatcaattttcaagctgacttatcaaaataaagtggtaagagttcagcggcccgccaagaacggcacagtgatggatgtcatcagcaggcgtgaccagcgaggttccggacaggtgggaacctacggcctcaatacatttactaacatggaagcacaactgatacgccagatggagagtgagggcattttctctcctagcgaattggagaccccaaacttagcgaagagagtgctggattggctcgaaaaatatggggtcgagcggcttaagaggatggccatctccggagacgactgtgttgtgaaacccatcgatgaccgctttgctacggccctgaccgcactaaatgatatgggtaaggtaagaaaagacattccgcagtgggaaccttcaaagggctggaacgattggcagcaagtgcccttctgcagtcatcactttcaccagctgataatgaaggacgggcgggagatcgtcgtgccatgtaggaatcaggatgagctcgttggacgagctcgtgtgtctcagggcgccggttggagcttgagagaaacagcatgcctggggaaatcctacgcccaaatgtggcagcttatgtatttccatcgccgggacctgaggctcgcggctaacgccatttgttcagcagtccctgtggattggatccccactagcagaaccacatggtctattcacgcccatcaccagtggatgactaccgaggacatgttatccgtatggaatcgcgtttggatcgaagagaacccatggatggaagataagacgcatataagtagctggggagacgtgccctacctgggcaaacgggaggaccaatggtgcggctcgttgatcgggctgacagctagggccacctgggcaactaatattcaggtcgctatcaaccaggtgcgaagactcattggaaatgagaactaccttgattatatgacatccatgaagcggtttaaaaatgaatctgaccctgagggtgccctgtggtga

SEQ ID NO: 13563 - RNA, 9879 nt, synthetic construct
  misc_feature 1..9879: note = derived and/or modified CDS sequence (opt3) from DENV-1__EU677158__SS-prME
  source 1..9879: mol_type = other RNA
agcgtgaccatgctgctcatgcttatgcccacagccctggctttccacttgactacgagaggaggggaacctcatatgatcgtctccaagcaggaaagagggaaatctttactgtttaagacctcagccggtgttaatatgtgcacactaattgccatggacctcggagagctgtgtgaagatactatgacctacaaatgcccacggataacagagaccgaaccggacgatgtggactgttggtgcaatgcgactgatacatgggtaacctatgggacgtgtagtcaaactggggagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccggcagcttcaaactggagaaggaagtcgccgagacgcagcacggtacagtgcttgttcagataaagtacgagggcaccgacgctccttgcaaaatcccattcttgactcaagatgaaaagggggtgacacagaacggacgcctgattaccgcgaatcccatcgtaactgacaaagagaagcctgtcaacatagaagcagagccaccctttggcgagtcgtatattatcatcggtgccggggaaaaagctctcaagctgtcttggttcaagaaaggctcctcaattggaaagatgtttgaggccaccgcaagaggcgccaggcggatggctatccttggggatacagcctgggacttcggaagtattggtggcgtgtttacgagcgttgggaaactggtgcatcagatattcggaaccgcatacggcgtcttgttttccggtgtgtcttggactatgaagatcgggattggcgtactcctgacatggttaggactgaatagccgatcaaccagtctatccatgacatgtatcgcggtgggcctcgttactctgtaccttggggtcatggtgcaggctgatagcggatgcgtgatcaactggaaaggccgcgaattgaagtgtggttctgggattttcgtcaccaatgaggttcacacgtggacagaacaatataagtttcaggccgactcaccgaaaagactgagtgcagccataggaaaggcttgggaggagggcgtgtgcggtatcaggagcgccacccggctcgaaaacattatgtggaaacagatctccaacgagctgaatcatattttactggaaaacgacatgaagttcactgtggtagtcggcgatgtggcagggatccttgctcagggcaagaagatgatacgccctcaacccatggagtacaaatattcttggaagtcgtggggcaaggccaaaatcattggggcggacgttcagaataccacatttatcattgatggaccaaacactcctgaatgtcccgacgatcagagagcctggaatatctgggaggtggaggactacggcttcggtatatttaccacaaacatttggttgaagctcagggatagctatacgcaggtctgcgaccaccgtctgatgtccgctgcaatcaaagattcaaaggccgtgcacgctgacatggggtactggattgaaagtgagaaaaatgaaacctggaagctagcccgggcatctttcatcgaggttaagacttgtatatggccaaaaagccatacactgtggtccaacggagtgctcgaatcagagatgatcattcccaagatctatggcggtcctattagccaacacaattaccgaccaggctacttcacccagactgcggggccgtggcatctgggaaaacttgagttggattttgacctgtgcgaaggcacaaccgtagtcgtggatgagcactgcgggaacagaggaccctctttaaggacgactaccgtgacaggcaagatcatacacgaatggtgttgccgctcctgtaccctccctccactgcggttcagaggtgaggacgggtgctggtatggaatggagattaggcccgtcaaagaaaaggaggaaaatcttgttaagagtatggtgagcgccggctctggtgaggtagactccttttcactgggcttgctctgtatcagtatcattatcgaagaggtgatgcgcagccgatggtcgcggaaaatgctgatgactgggacactagctgtcttcgtgctgctcattatgggacagctgacctggaacgatcttatacgtttgtgcatcatggttggcgccaatgcatccgacagaatggggatgggaacaacttacctggctttaatggccacctttaagatgaggcctatgttcgcagtgggcctcctgtttcgccggcttacgtctagagaggtcctgctactcacaattggtctgagcttggtggcctcagttgaactgccaaacagtttagaggaactcggggatggactggctatgggcatcatgattcttaaactgttgaccgacttccaatcccatcagctctgggcgactctgctatctctgacctttatcaagacaactttcagccttcactatgcctggaaaaccatggcaatggtgctctccatagtctcactgtttcccttgtgtctgagcacgacaagtcagaagaccacttggttaccggtactcctgggctctcttgggtgcaagcctctgacaatgttcttgatcgctgagaataaaatttggggaaggcgatcctggccactcaacgaaggtatcatggccgtgggcattgttagcatcctgctatcgtcactgcttaagaacgatgtgcccctcgccgggcctctgatagctggaggcatgttgattgcatgttacgtcatctctggtagttccgccgacttaagcctggagaaagcggctgaggtgtcttgggaagaggaagccgagcatagcggggcatcccacaatatcctcgtagaagtgcaggatgacggaaccatgaagattaaagatgaggagcgcgacgatactctgacaatacttctgaaggccaccttgctagctgtctcaggcgtttatcccctgagtatcccagcaacgctctttgtgtggtacttctggcagaagaagaagcagcggagcggcgtgctgtgggacactccttctcccccagaagtcgagagagccgtgcttgatgacgggatttataggatcatgcagcgtggattactgggtcgctcccaggttggcgtaggggtgttccaagaaaacgtctttcataccatgtggcacgtgacacggggagcggttctcatgtaccagggcaaaagattggagccgtcatgggctagtgtgaagaaagacctgattagctacggtgggggatggaggctccagggctcctggaataccggcgaggaagtccaggtgatcgccgtagagcctgggaagaaccccaaaaatgtccaaacagcaccaggaactttcaagacccccgaaggtgaggtgggcgccatagctctggattttaagcctgggacgtctggatcgccaatcgttaaccgagaaggcaaaattgtgggtctttatgggaatggagtcgtgacaactagcggcacctacgtttcagccatcgcacaggctaaggcctcccaggagggccccctgcctgagattgaagacgaggtgttccggaaacgcaacttgacaatcatggatctacacccggggagtggaaagaccagaaggtatctgccagcgatagtccgggaagccattaaacgaaagctcagaactttaatcctggcacccacccgcgtggtagcttctgagatggccgaagctcttaagggtatgcctatcaggtaccaaacaacggcagtgaaaagcgagcatactggcaaggagattgttgacctgatgtgccacgccacctttacaatgcgtctcttgtccccagtccgggtgcccaattataacatgatcataatggatgaagcccatttcaccgacccttcatctattgctgcgagagggtacatcagcactagggtgggaatgggcgaggcagccgctatttttatgacagccaccccgcccggtagtgtcgaagcattcccacagtccaatgccgtaatccaggatgaggaacgcgacatacctgagcgaagctggaactctgggtatgagtggattacggattttcccggaaaaactgtgtggttcgttccatcaatcaagtccggcaatgacatcgctaactgtctgaggaaaaatggcaagcgggtgattcagctcagtaggaagacatttgataccgaataccagaaaaccaagaacaacgactgggactacgtcgtgactacagatatcagcgagatgggggcgaatttccgcgccgaccgtgttattgatcctagacggtgcctgaaacccgtgatacttaaggacggaccagaaagggtcatcctagcaggtccgatgcctgtgaccgtagcttcggccgcacagcgccgaggcagaattgggcggaaccacaataaagagggagatcagtatatctacatgggccagcccctgaacaatgacgaggatcatgcccactggacagaagctaagatgttgttagacaacatcaatactccagagggtattatacccgccctgttcgaacctgagagggaaaagtctgcggcaatcgatggggagtatcgcctcagaggcgaggccaggaaaacgtttgtggaactgatgcggcgtggagaccttccagtttggctgtcctacaaggtcgctagcgagggcttccaatattcagatcgccgatggtgctttgacggggaaagaaacaatcaggtgctcgaggaaaacatggatgtggagatttggaccaaagagggagaaaggaagaaattgcggccccgctggctggacgccagaacatacagtgaccctctagctctgagggagttcaaggaatttgcagccggtcggcgatctgtctccggcgatctcatccttgagattgggaaactgccgcagcacttaactcagagagctcaaaatgccttggacaacctggttatgctccataatagcgaacagggaggccgcgcatataggcacgcgatggaggagctgccagataccatcgaaacacttatgctgctcgccttgatagctgtgctgaccggtggggtaactttattctttctatcaggccggggactgggcaagacgagtatcgggctcctttgtgtgatggccagctccgtcctgttgtggatggcatctgtggagccccattggattgctgccagcatcattctggagttctttctcatggttctgcttatccctgagcccgaccgtcagagaaccccacaggataaccaactcgcatacgtggtcataggactgttgttcatgattctgacagtagccgctaatgagatgggtttactagaaactaccaagaaagacctgggcatcgggcacgtggcggttgagaaccaccatcacgccgcaatgctcgatgtggaccttcatcctgcttccgcctggacactgtacgccgtcgcaaccactattatcacacccatgatgaggcacacgatagaaaacaccactgctaatatctcattgacagccattgcgaaccaggctgccatcctgatgggactcgataagggctggccaatttctaaaatggacatcggtgtgcctctgcttgcattagggtgctatagtcaggtcaatccgctgaccctcaccgccgctgtgttgatgctggttgcacattacgccataattggccccggactacaagcgaaggctacacgcgaggcccagaaacggactgcagccggcatcatgaagaacccaacggtggatgggatcgtagctattgacctggatcctgtggtctatgacgccaagtttgaaaaacagctcggacagatcatgcttctgatattgtgtacctcgcaaattctgctcatgcgaacaacttgggcactgtgcgagagcatcaccttagctacaggcccccttaccactctgtgggagggttccccagggaagttctggaatacgacaattgccgtttctatggcgaacatctttagaggatcatacctcgccggcgcaggtctagctttcagcctgatgaaatccttgggcgggggaaggcgcggcaccggggcccagggagaaactctgggcgagaagtggaaacggcagctcaatcagcttagtaagtctgagttcaacacctataagagaagcggtataatggaggtggaccgttcagaagcaaaagaggggctgaagaggggagagacaactaaacacgctgtctcccggggcaccgccaagttgcgctggtttgtggaacgaaatctggtaaaacctgagggtaaggtgatcgatctcggctgtgggagaggaggctggagttactattgcgccgggttaaagaaagttacagaagtgaagggatacacgaaaggcggtcccgggcacgaggaaccgattccaatggcgacctacggatggaacctggtcaaacttcatagcggcaaagacgtgttctttatccctcccgagaagtgtgatactctgctatgcgacattggcgagtcttccccaaatcccacaatcgaagaggggaggaccctccgggtcctgaaaatggtggaaccttggttgcgcggaaaccaattctgtattaagatcctgaatccgtatatgccctcagttgtagagactctcgagcagatgcagagaaagcacggtggcatgcttgtgaggaacccactgagccgaaattcgacacatgaaatgtactgggtctcttgcgggaccggaaacatagtgagtgctgttaatatgacgtcccggatgttactgaaccgttttaccatggcacacagaaaacctacatatgagcgcgatgtggacttgggcgccggtactaggcacgtcgctgtggaacccgaggtagccaacctcgatattatcgggcagcggatcgaaaatattaagcatgagcacaaaagcacctggcattacgacgaggataacccttataagacatgggcataccacggatcatatgaagtgaaaccatccggctctgccagcagtatggttaatggcgtcgtgaagctgctaactaagccctgggacgtgatacctatggtcacccaaatcgctatgacagataccactccattcgggcagcagagagtttttaaagagaaggtggacacgcgcacacccaaagcgaagaggggaaccgcccaaattatggaagtaactgcaaaatggctttggggtttcctgtcccgaaacaagaagccgcggatctgtaccagagaggaatttacaaggaaagtgcgcagcaatgctgccattggcgcagtcttcgtggacgagaaccagtggaactctgccaaggaggctgttgaagatgagcgtttttgggacctcgtgcatcgggaaagagagctgcacaaacaggggaagtgcgccacgtgcgtctacaacatgatgggaaaaagggaaaagaagttgggcgagttcggtaaagcgaaggggtcacgcgcaatctggtacatgtggctgggagcccgatttctcgagttcgaagctcttggcttcatgaatgaggatcactggtttagtcgggaaaactccctgagcggcgtggagggggagggattacataaactgggttatatattgagagacatctctaagattcctggcgggaatatgtacgccgatgacaccgcaggatgggatactaggatcacagaagacgatctccagaacgaggctcgcattaccgacatcatggaaccagagcacgccctgctagctaaatcgatattcaaacttacttatcaaaataaagtagttagagtgcagcggcccgccaagaacggcacagtcatggatgtgatttcaaggcgtgaccagcgaggtagcggacaggtgggaacctacggcctgaatacatttactaacatggaagcacaactcatccgccagatggagtccgagggcatcttcagtccttctgaactggagaccccaaacttggcggaaagagtcttagattggctggagaagtatggggttgaacggctcaaaaggatggccattagcggagacgactgtgtggtaaagcccatagatgaccgctttgctacggcccttaccgcactgaatgatatgggtaaagtgagaaaggacatcccgcagtgggagccttccaaaggctggaacgattggcagcaagtccccttctgctcacatcactttcaccagctaattatgaaggacgggcgggagatcgtggttccatgtaggaatcaggatgaactggtgggacgagctcgtgtcagtcagggcgccggttggtctctcagagagacagcatgcttgggaaagagctacgcccaaatgtggcagctgatgtatttccatcgccgggaccttaggctggcggctaacgccatttgttccgcagtgcctgtagattggatccccacttcaagaaccacatggagcatacacgcccatcaccagtggatgactaccgaagacatgctctctgtttggaatcgcgtgtggatcgaggaaaacccatggatggaggataaaacgcatatttccagttggggagacgtcccctacttaggcaagcgggaggaccaatggtgcggcagcctgatcgggttgacagctagggccacctgggcaactaatattcaggtggctatcaaccaggttcgaagactgattggaaatgaaaactacctcgattatatgacatcgatgaaacggtttaagaatgagggtgaccctgaaggcgccctttggtga

SEQ ID NO: 13564 - RNA, 9879 nt, synthetic construct
  misc_feature 1..9879: note = derived and/or modified CDS sequence (opt3) from DENV-1__EU677159__SS-prME
  source 1..9879: mol_type = other RNA
agcgtgaccatgctgctcatgcttatgcccacagcactggctttccacttgactacgagaggaggggaacctcatatgatcgtctccaagcaggaaaggggaaaatctttactgtttaagacctcagccggtgttaacatgtgcacactgattgccatggacctcggcgagctgtgtgaagatactatgacctacaaatgcccacggataacagaggcggaaccggacgatgtggactgttggtgcaatgctaccgatacttgggtaacatatgggacctgtagtcagacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccgtgctgaggaaactttgcattgaagctaagatctctaatacgaccacagatagccggtgtccaactcaaggagaggccaccctggtcgaagaacaggacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatgtgtactggtagcttcaaactggagaaggaagtcgctgagacccagcacggtacggtgcttgttcagataaagtacgagggcacagacgcgccttgcaaaatcccattctcgacccaagatgaaaagggggtgactcagaacggacgcttgattacagcaaatcccatcgtaaccgacaaagagaagcctgtcaacatagaagccgagccaccctttggcgagtcttatattgtgatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtttttacatccgtggggaaacttgtccatcagattttcggaacggcgtacggcgtgctgttttctggtgtaagctggaccatgaagatagggatcggcgtgttgctcacttggctgggattaaattcacgaagtacatccctgagcatgacctgtattgctgttggcctagtcacactctacctgggggtgatggtgcaggccgattctggatgcgtcatcaactggaaaggccgcgaacttaagtgtggttcagggatcttcgttactaatgaggtgcacacctggacggaacaatataagtttcaggcagacagtccgaaaagattgagcgccgctattggaaaggcctgggaggagggcgtgtgcggtataaggtccgcaacacggctggaaaacatcatgtggaaacagatttctaacgagctcaatcatatcctgttagaaaacgacatgaagctgaccgtagtcgtgggcgatgttgctgggattcttggacagggcaaaaagatgatccgccctcaacccatggagtacaaatattcgtggaaaagctgggggaaggccaagataatcggagcggacgcccagaatactaccttcattatcgatggcccaaacacacctgaatgtcccgacgatcagagagcttggaatatttgggaggtggaggactacggttttgggatcttcactaccaacatatggttgaagctcagggattcctatacacaggtctgcgaccaccgtctgatgtcagcagccattaaagatagtaaggctgtgcacgccgacatgggatactggatcgaatctgagaaaaatgaaacgtggaagctagcacgggcgagctttattgaggttaagacctgtatctggccaaaatcccatactctgtggtcaaacggcgtgctcgaaagcgagatgataatccccaagatttatggtggccctatctctcaacacaattaccgaccagggtacttcacacagaccgccggaccgtggcatctgggcaaacttgagttggatttcgacctgtgcgaagggactacagtagtcgtggatgagcactgcggaaacagaggcccctccttaaggaccacgactgtgaccggtaagattatccacgaatggtgttgccgcagttgtacactccctccactgcggtttagaggggaggacggatgctggtatggcatggagataaggcccgtcaaagaaaaggaggaaaatcttgttaagagcatggtgtctgctggttccggcgaggtagactcattcagtctggggttgctctgtattagcatcatgatcgaagaggtgatgcgctcgcgatggtcccggaaaatgctgatgaccggaactctagccgtctttttcctgctcattatgggccagctgacatggaacgatcttatccgtttgtgcattatggtgggggcaaatgcttctgacagaatgggaatgggcaccacatacctggccttaatggcaacttttaagatgaggcctatgttcgccgttggtctcctgtttcgccggcttaccagcagagaggtgctgctactcacgatagggctgtcattggtcgctagtgtggaactgccaaactccttagaggaactcggagatggcctggcgatgggcatcatgattcttaaactgttgacagacttccaatctcatcagctctgggccaccctgctaagcctgacttttatcaagaccacattctcccttcactatgcatggaaaactatggctatggttctctcaattgtgagcctgtttcccttgtgtctgagtaccacgtctcagaagacaacctggttaccggtcctcctggggtcccttggatgcaagcctctgactatgttcttgatcgccgagaataaaatatggggtaggaagtcctggccactcaacgaaggcatcatggccgtagggattgtgtcgatcctgctatcatctctgcttaaaaacgatgttcccctcgctggacctctgattgcaggcggtatgttgatcgcctgttacgtgataagtgggtccagcgcggacttatctctggagaaggctgccgaggtcagctgggaagaggaagcagagcattccggagcctcacacaatattctcgtggaagtacaggatgacggcacaatgaaaatcaaggatgaggagcgagacgataccctgactatccttctgaaagctacattgctagcagtgagtggcgtctatcccattagcataccagccaccctgtttgtttggtacttctggcaaaagaagaaacagcgctctggggtgctctgggacacgccttcacccccagaagtggagcgggcggtcctggatgacggaatctatagaattatgcagaggggtcttttaggccgtagccaggtgggggttggagtattccaagaaaacgtgtttcatactatgtggcacgtcacccgcggcgctgtgctgatgtaccagggtaagcggctcgagccgagttgggccagcgttaaaaaggacttgatctcctacgggggaggctggagactgaggggctcttggaatacaggggaggaagtgcaggtcattgcagtggagcctggcaagaatcccaagaatgtacagaccgccccaggtacattcaagactcccgaaggcgaggtcggggctatcgccctcgattttaaacctggaacctcgggcagcccaatagtgaaccgagaaggtaagatcgttgggctgtatggaaatggcgtggtcacgacatcaggcacttacgtgtccgcaattgctcaagccaaagcgagtcaggaggggccccttcctgagatcgaagacgaggttttccggaagcgcaacctgaccattatggatttgcacccgggatctggtaaaacaagaaggtatctaccagccatcgtgcgggaagcaataaagcgaaagctgagaaccctcattttagctcccactcgcgtcgtggccagcgagatggctgaagcactgaaaggcatgcctatcaggtaccagaccacagccgtaaagtccgagcatacggggaaagagatcgtggaccttatgtgccacgccacttttaccatgcgtctgctctcaccagttcgggtccccaattataacatgattatcatggatgaagctcatttcacagacccttctagcatagcggcaagaggatacattagtaccagggtgggcatgggtgaggccgctgccatctttatgactgcaacaccgcccgggtccgtggaagccttcccacaaagcaatgctgtcattcaggatgaggaacgcgacatccctgagcgatcttggaactcaggatatgagtggataaccgattttcccggcaagacggtatggttcgtgccatccattaaaagtggcaatgacatcgcgaactgtttgagaaagaatgggaagcgggttatccagctgagcaggaaaacttttgatacagaataccagaagaccaaaaacaacgactgggactacgtggtcaccactgatatttcggagatgggagccaatttccgcgcagaccgtgtgatcgatcctagacggtgcctcaagcccgttattctgaaagacggtccagaaagggtgatacttgctggcccgatgcctgtcacagtggcctctgcagcccaacgccgagggagaatcggacggaaccacaataaggagggcgatcagtatatttacatgggtcagcccctaaacaatgacgaggatcatgctcactggaccgaagccaagatgctgttggacaacatcaatacaccagaggggatcattcccgcgttattcgaacctgagagggaaaaatccgcagccgtagatggcgagtatcgcctgagaggagaggctaggaagacttttgtggaactcatgcggcgtggcgacctgccagtttggcttagctacaaagtcgcctcagaggggttccagtatagtgatcgccgatggtgctttgacggagaaagaaacaatcaagtgctggaggaaaacatggatgtggagatatggacgaaggagggtgaaaggaaaaagctccggccccgctggttggacgctagaacctactctgaccctctggcactaagggagttcaaagaatttgccgctggccggcgatccgtcagcggggatctgatcctcgagattggaaaacttccgcagcacctgacacagagagcccagaatgcattagacaacttggttatgctgcataattcagaacaaggcggtcgcgcgtataggcacgccatggaggagctcccagatactatcgaaaccctgatgcttctggctctcattgccgtgttgacagggggcgtaaccctgttctttttaagtggacggggcctagggaagactagcatcggactgctctgtgtgatggcatcctctgtccttctgtggatggctagcgtggagccccattggatagccgcatccatcattttggagttctttctgatggttctcctgatccctgagcccgaccgtcagagaacgccacaggataaccagcttgcctacgtggtcattggtctcctgttcatgatcttgaccgtagctgcgaatgagatgggcctgttagaaacaactaaaaaggacctagggataggacacgtggccgttgagaaccaccatcacgcagctatgctggatgtggacctccatcctgcctcagcctggaccctttacgcagtcgctacaaccattatcactcccatgatgaggcacacaattgaaaacacgaccgccaatatctctctgactgcgatagctaaccaagccgcaatcttgatgggcctggataaaggttggccaattagtaagatggacatcggggtgcctctcctggcccttggctgctattcgcaggtcaatccgttaacactgaccgctgcagtgctcatgttggttgcccattacgcgattatcggacccggcctgcaggctaaagccacccgcgaggcacaaaagcggacagccgctgggataatgaagaacccaactgtggatggaattgtagccatcgacctagatcctgtggtctatgacgcaaaatttgaaaagcagctgggccagatcatgctccttattctgtgtacgagccagatcttgctgatgcgaaccacatgggctctctgcgagtccataactctggccaccggtcccttaacaaccctttgggaggggtctccaggaaaattctggaatactacgattgcggtttcaatggccaacatctttagaggcagctacctggcaggagctggcctcgccttctccctaatgaagagtctagggggaggcaggcgcgggacaggagcacaaggcgaaaccttgggtgagaaatggaagcggcagctgaatcagctctctaagagcgagttcaacacttataaaagatcagggattatggaggtggaccgttccgaagctaaggagggacttaaaaggggcgagaccacaaagcacgccgtcagtcggggtactgccaaactgcgctggtttgtggaacgaaatttggtaaagcctgagggcaaggtgatcgatctggggtgtggaagaggcgggtggagctactattgcgcgggactcaaaaaggttaccgaagtgaaaggctacacaaagggtgggcccggacacgaggaaccgataccaatggctacgtacggctggaacttagtcaaactgcattctggcaaggacgtgttctttatccctcccgagaaatgtgatacccttctgtgcgacattggggagtcctcaccaaatcccactatcgaagagggaaggacactacgggtcctcaagatggtggaaccttggctgcgcggtaaccagttctgtattaagatcttgaatccgtatatgcccagcgttgtagaggcactggagcaaatgcagagaaaacacggcgggatgctcgtgaggaacccactttcgcgaaattctacccatgaaatgtactgggtcagttgcggaactggcaacattgtgtccgccgttaatatgacaagccggatgctgttaaaccgttttaccatggctcacagaaagcctacgtatgagcgcgatgtggacctgggtaccgggacaaggcacgtcgccgtggaacccgaggtagcaaacttggatatcataggacagcggattgaaaatatcaaacatgagcacaagtcaacttggcattacgacgaggataacccttataaaacctgggcctaccacggctcctatgaagtgaagccatctggcagcgctagttccatggttaatggggtcgtgaagctcctgacaaaaccctgggacgtgatccctatggtcactcagattgcgatgaccgatacaaccccattcggacaacagagagtttttaaggagaaagtggacactcgcacgcccaaggccaaaaggggtacagcacagataatggaagtaaccgctcgatggctatggggcttccttagccggaacaagaagccgagaatctgtactagggaggaatttacccgcaaagtgcgttctaatgccgcaattggggccgtcttcgtggacgagaaccaatggaactcagctaaggaggccgttgaagatgagcggttttgggacctggtgcatagagaaagggagctccacaaacagggaaagtgcgcgacatgcgtctacaacatgatgggcaaacgcgaaaagaagctgggtgagttcgggaaagcaaagggaagtcgagccatctggtacatgtggttgggcgctcggtttctggagttcgaagccctcggcttcatgaatgaggatcactggttttccagagaaaacagcctttctggggtggagggagagggtctgcataaattaggctatattctgagggacatctcgaagatacctgggggaaatatgtacgcagatgacacggctggctgggatacccgcatcactgaagacgatttgcagaacgaggccaaaattacagacatcatggaaccagagcacgctctcctggccaaggcaattttcaaactaacctatcagaataaggtagttagagtgcaacggcccgcgaagaacggtactgtcatggatgtgatctcaaggcgtgaccagcgagggagcggacaggtgggcacatacggccttaatacctttacaaacatggaagcccagctgatacgccaaatggagtccgaggggattttcagtccttctgaactcgagactccaaacctggctgaaagagccttggattggttaggaaaatatggtgtcgagcggctgaagaggatggcaatcagcggcgacgactgtgttgtgaaacccatcgatgaccgctttgctaccgccctcacggcacttaatgatatggggaaggtaagaaaagacattccgcagtgggaaccttccaagggatggaacgattggcaacaggtgcccttctgctcacatcactttcaccaactgataatgaaggacggccgggagatcgtcgtgccatgtaggaatcaggatgagctagttggtcgagcccgtgtgagtcagggggcgggatggtctctgagagaaaccgcttgcctcggcaaaagctacgcccagatgtggcaattgatgtatttccatcgccgggacctgaggcttgcagccaacgctatttgttccgccgtccctgtggattgggtacccacatcaagaactacctggagcatccacgcacatcaccagtggatgacaactgaggacatgctgtctgtttggaatcgcgtgtggattgaagagaacccatggatggaagataagacccatatctccagttgggaggacgtcccctacctcggcaaacgggaggaccagtggtgcgggagcttaataggactgacggctagggccacatgggcgaccaatatccaagtggctattaaccaggttcgaagattgatcggtaatgaaaactacctggattatatgatttcgatgaagcggtttaaaaatgagtccgaccctgaaggcgccctctggtga

SEQ ID NO: 13565 - RNA, 9879 nt, synthetic construct
  misc_feature 1..9879: note = derived and/or modified CDS sequence (opt3) from DENV-1__EU677160__SS-prME
  source 1..9879: mol_type = other RNA
agcgtgaccatgctgctcatgcttatgcccaccgcactggctttccacttgactacgagaggcggggaacctcatatgatcgtctccaagcaggaaagggggaaatctttactgtttaagacctcagccggtgttaacatgtgcacactaattgcaatggacctcggcgagttctgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcgtgttagtcacgccatcaatggccatgcgctgcgtggggattggaagcagagatttcgttgagggtctgagtggcgcgacttgggttgacgtggtccttgagcacgggtcctgtgtgacaaccatggcaaaggataaacccactttggacatcgaactgctaaagacagaggtgaccaaccctgccgtcctcaggaaactgtgcattgaagctaagatctctaatacgaccacagatagccggtgtccaactcaaggagaggccacccttgttgaagaacaggacgcaaactttgtgtgccgccgaacattcgtagatagaggctggggtaatgggtgtggactgtttggcaaaggctccttgataacttgcgctaagttcaagtgcgtgaccaaactcgaggggaagacagtccagtacgaaaacctgaaatattcagtgattgttaccgtgcacactggagaccagcatcaagtcggtaatgagagtacggaacacggcacaaccgccactatcacaccccaggcgcctagcacagagattcagttaaccgactacggggccctgactctcgattgttctccaaggacaggacttgactttaacgaaatggtgctgttgacgatgaaggagaaatcctggctagtacataagcagtggttcctggatctcccgctgccctggacctcaggcgcaagcacaagtcaagagacatggaatcggaaagaccttctggttacctttaagacagctcacgccaagaaacaggaagtggtcgtgttgggttctcaggagggggctatgcacactgccctcaccggcgcaacggaaatccaaacctccggaacaactaccatcttcgccggccatctgaagtgccgtttaaaaatggataagctgacactaaaagggatgagctatgtcatgtgtactggatcgttcaagctcgagaaggaagtggctgagacccagcacggtacggttctggtgcagattaaatacgagggcacagacgcgccttgcaagataccattttctacccaggatgaaaaaggggtaactcaaaacggacgccttatcacagcaaatcccattgtcaccgacaaggagaaacctgtgaacatcgaagccgagccacccttcggcgagtcctatatagttattggtgctggggaaaaggccttgaagctgtcatggtttaaaaagggcagtagcatcggaaaaatgttcgaggcaactgccagaggcgctaggcggatggccatcctcggggataccgcatgggactttggatccattggtggcgtgttcacatctgtcgggaagctggtgcatcagatctttggaacggcgtacggcgtacttttcagcggtgtgtcatggaccatgaaaattgggataggcgttctgttgacttggctcggactgaatagtcgatccactagcttatctatgacctgtatcgctgtcggcctggtgacactatacctcggggtgatggtccaggccgattcaggatgcgttattaactggaagggccgcgaactgaagtgtggtagtgggatctttgtgactaatgaggtgcacacctggacggaacagtataaattccaagcagacagcccgaagagactttccgccgctatcggaaaagcctgggaggagggcgtatgcggtattaggtctgcaacacggttggaaaacataatgtggaagcagatctcgaacgagctgaatcatattctcctggaaaacgacatgaaatttaccgtcgtggttggcgatgtggctgggatcttagcccagggaaagaaaatgattcgccctcagcccatggagtacaagtatagctggaagtcctggggcaaagcgaagatcataggggccgacgtccaaaatactaccttcatcattgatggaccaaacacacctgaatgtcccgacgatcagagagcttggaatatctgggaggtggaggactacggctttggtattttcactaccaacatctggctgaaacttagggattcatatacacaggtttgcgaccaccgtttgatgagtgcagccataaaggattctaaagctgtgcacgccgacatggggtactggattgaaagcgagaagaatgaaacgtggaagctcgcacgggcgtccttcatcgaggtaaaaacctgtatttggccaaagtcacatactctgtggagcaacggagtcctagaatctgagatgatcatacccaaaatctatggcggtcctatttcccagcacaattaccgaccaggctactttacacaaaccgccgggccgtggcatctgggaaagctcgagctggatttcgacctttgcgaaggcactacagtggtggtcgatgagcactgcgggaacagaggacccagtttgaggaccacgactgttaccggcaaaatcattcacgaatggtgttgccgcagctgtacactgcctccattacggtttaagggtgaggacgggtgctggtatggaatggagatcagacccgtgaaggaaaaagaggaaaatctcgtaaagtctctggtgtccgctggctcaggtgaggtcgacagtttcagccttggcctgttgtgtatatcgattatgatcgaagaggtgatgaggtcccgctggtctcgaaaaatgctcatgaccgggactctggccgtatttttcctactgatcatgggacagctcacatggaacgatctgattcggctttgcatcatggtgggcgcaaatgctagcgaccgtatggggatgggaaccacatacttggccctgatggcaacttttaagatgagacctatgttcgccgtcggcttactctttaggcgcctgacctcacgggaggtgcttctgctaacgattggtctcagtctggttgcttccgtggaattgccaaactctctggaggaattaggggatggactcgcgatgggcataatgatcctgaaacttctgacagacttccagagccatcaattgtgggccaccctcctgtccctaacttttattaagaccacattctcactgcactatgcatggaagactatggctatggtccttagcatcgtaagtctctttcccctgtgtttgtctaccacgtcccagaaaacaacctggctgccggtgttactcggcagcctggggtgcaagcctcttactatgttcctgattgccgagaataaaatctggggaagaaagtcgtggccattgaacgaaggtataatggccgttggcatcgtgtcaattctcctgtctagtctactgaaaaacgatgtcccccttgctgggcctctcatcgcaggaggcatgctgattgcctgttacgtgatctccggtagctctgcggacttgagcttagagaaggctgccgaggtatcctgggaagaggaagcagagcattcaggggccagtcacaatatactggtggaagtccaggatgacggaacaatgaaaattaaggatgaggagagggacgataccctcactatcctgcttaaggctacactgttggcagttagcggcgtgtatcccctatctatcccagccaccctgttcgtgtggtacttttggcagaaaaagaaacaacgatccggcgtcctctgggacacgccttcacccccagaagtggagcgcgcggttctggatgacgggatttatcggataatgcagagaggacttttaggtaggagtcaggtaggcgtgggggtcttccaggaaaacgtgtttcatactatgtggcacgttacccgtggagctgtgctgatgtaccaaggcaagcgcctcgagccgagctgggcctccgtcaaaaaggacttgatctcttacggtgggggatggcggctgcagggctcgtggaatacaggcgaggaagtgcaggtaattgcagtcgagcctgggaagaaccccaaaaatgtgcagaccgccccaggaacattcaagactagcgaaggtgaggttggcgctatcgccctcgattttaaacccgggacctcaggatcccctattgtgaacagagaaggcaagatcgtcggtctgtatgggaatggagtggttacgacaagtggcacttacgtgtctgcaatagctcaagccaaagcgagccaggagggcccacttcccgagatcgaagacgaggtcttcaggaagcgaaacctgaccattatggatttgcaccctgggtccggaaagacacggcgctatctaccggccatcgtgagagaagcaattaaaaggaagctgcggaccctcatcttagctccaactcgagtagtggcctcagagatggctgaagcactgaaaggtatgcccataagataccagaccacagccgttaagtctgagcatacgggcaaagagattgtcgaccttatgtgccacgccacttttaccatgcgcctgctcagccctgtgagggtgccaaattataacatgatcatcatggatgaagctcatttcacagaccccagttccattgcggcacgtgggtacatcagcacccgggtcggaatgggcgaggccgctgccatatttatgactgcaacacctccgggttctgtagaagccttcccccaatcaaatgctgtgattcaggatgaggaaagagacatcccagagaggtcctggaacagtgggtatgagtggattaccgattttcctggaaagacggtttggttcgtgcccagcatcaagtcgggcaatgacatagcgaactgtttgcgcaaaaatggcaagcgagtcattcagctgtctagaaaaactttcgatacagaataccagaagaccaaaaacaacgactgggactacgtggttaccactgatatctccgagatgggggccaattttcgggcagacagggtgatcgatccacgccgttgcctcaagcctgtcattctgaaggacggacccgaaagagtgatccttgctggtccaatgccggtaacagtggccagcgcagcccaacggaggggccgcattgggcgaaaccacaataaagagggagatcagtatatatacatgggccagcctctaaacaatgacgaggatcatgctcactggaccgaagccaagatgctgttggacaacatcaatacacccgagggtattatcccagcgttattcgaacccgagagagaaaaatcagcagccatcgatggggagtatcggctgaggggcgaggctcgcaagacttttgttgaactcatgagaaggggagacctgcctgtctggcttagttacaaagtggcctctgagggcttccagtattccgatcggcgttggtgctttgacggggaacgcaacaatcaagtgctggaggaaaacatggatgtcgagatttggacgaaggagggagaacgaaagaaactcagaccaaggtggttggacgctcggacctacagcgaccccctggcactacgcgagttcaaagaatttgccgctggtagaaggtcagttagtggcgatctgatactcgagatcgggaaacttcctcagcacctgacacagcgggcccagaatgcattagacaacttggtgatgctgcataatagcgaacaaggaggccgagcgtatagacacgccatggaggagctcccggatactattgaaaccctgatgcttctggctctcatcgccgtattgacaggtggggtgaccctgttctttttatccggccgcggactaggcaagacttctattgggctgctctgtgtcatggcaagctccgtgcttctgtggatggcttcagttgagccacattggatcgccgcatctataatcttggagttctttctgatggtgctcctgattcccgagcctgacaggcagcggacgccccaggataaccagcttgcctacgtcgtaatcggactcctgttcatgattttgaccgtggctgcgaatgagatgggtctgttagaaacaactaaaaaggacctaggcatcgggcacgttgccgtggagaaccaccatcacgcagctatgctggatgtcgacctccatccagccagtgcctggaccctttacgcagtggctacaaccataattactcctatgatgcgtcacacaatcgaaaacacgaccgccaatatttcgctgactgcgatcgctaaccaagccgcaatattgatgggactggataaaggctggcccatcagcaagatggacattggtgtcccactcctggcccttgggtgctattcccaggtgaatcctttaacactgaccgctgcagttctcatgttggtggcccattacgcgatcattggcccgggactgcaggctaaggccaccagagaggcacagaagaggacagccgctggcatcatgaagaaccccactgtagatgggatagtggccattgacctagatccagtcgtttatgacgcaaaatttgaaaagcagctgggacagatcatgctccttatcctgtgtacgtctcagattttgctgatgcgcaccacatgggctctctgcgagtcaatcactctggccaccggccctttaacaaccctttgggagggtagccccgggaaattctggaatactacgatagcggtgtccatggccaacattttccggggaagttacctggcaggcgctggtctcgccttttctctaatgaaaagcctgggcgggggacgaagaggcacaggggcacaaggagaaaccttgggcgagaagtggaaaaggcagctgaatcagctctcaaagtccgagttcaacacttataaacgcagtggtatcatggaggtcgaccggagcgaagctaaggaggggcttaaaagaggagagaccacaaagcacgccgtgtctcgtggcactgccaagctgaggtggtttgtagaacggaatttggtgaaaccagagggtaaggttattgatctgggctgtgggcgcggaggctggtcctactattgcgcggggctcaaaaaggtgaccgaagtcaaaggatacacaaagggcggtcctgggcacgaggaacccatcccgatggctacgtacggatggaacttagtgaaactgcattcaggcaaggacgtcttctttataccacctgagaagtgtgatacccttctgtgcgacatcggcgagagctcgcccaatccaactattgaagaggggcgaacactaagagtgctcaaaatggttgaaccctggctgaggggaaaccagttctgtatcaagattttgaatccttatatgccgtctgtagtggagaccctggagcaaatgcagcggaaacacggtggcatgctcgtccgcaacccccttagtagaaattccactcatgaaatgtactgggtgagctgcgggacaggaaacatcgtttcagcagtgaatatgacctccaggatgctgttaaaccgatttacgatggcccaccggaagccaacctatgagcgtgatgtcgacctgggcgctggtacaagacacgtggccgtagaacctgaggtggcaaacttggatattatcgggcagcgcatagaaaatattaaacatgagcacaagtctacttggcattacgacgaggataacccctataagacctgggcctaccacggaagctatgaagttaaacctagtggctccgctagctctatggtcaatggcgtggtgaagctcctgacaaaaccatgggacgtcatccccatggttactcagatcgcgatgaccgatacaacccctttcgggcaacagagggtgtttaaggagaaagtagacactcggacgccaaaggccaagagaggaacagcacagattatggaagtgaccgctaaatggctatggggtttcctttcacgcaacaagaaacccaggatatgtactcgagaggaatttacccggaaggtcagaagtaatgccgcaatcggcgccgtgttcgttgacgagaaccaatggaactccgctaaagaggccgtggaagatgagaggttttgggacctggtccatcgcgaacgtgagctccacaagcaggggaagtgcgcgacatgcgtgtacaacatgatgggaaaacgggaaaagaaactgggcgagttcggtaaggcaaaagggagcagagccatttggtacatgtggttgggagctaggttcctggagtttgaagccctcggcttcatgaatgaggatcactggttttctcgcgaaaactcgctttcaggcgtagagggggagggactgcataagttaggttatatcctgcgagacattagcaaaatcccgggcgggaatatgtacgcagatgacacggctggatgggatacccggataactgaagacgatttgcagaacgaggccaagatcacagacattatggaacctgagcacgctctcctggccaagtccatcttcaaactaacctatcagaataaggttgtgagagtccaaaggccagccaagaatggcactgtgatggatgtgattagtcgcagagaccagcggggttctgggcaggtcggaacatacggccttaatacctttacaaacatggaagcgcagctgatcaggcaaatggagagcgagggcatattctccccctcagaactcgagactcctaacctggcccgtcgagttttggattggttagaaaagcatggggtggagcgcctgaaaagaatggctattagtggagacgactgtgtagtgaagccaatcgatgaccggtttgccaccgcactcacggctcttaatgatatgggtaaggtcaggaaagacatcccccagtgggaaccgtctaagggctggaacgattggcaacaggtgcctttctgcagccaccactttcatcaactgattatgaaagacgggcgcgagatagttgtgccctgtagaaatcaggatgagctagtcggacgggccagggtgtcccagggcgcaggttggtcactgcgagaaaccgcctgcctcggaaagagctatgcgcagatgtggcaattgatgtacttccaccgtagagacctgcgccttgctgccaacgcaatctgttctgccgtaccagttgattgggtgcctacatcccggactacctggagtattcatgctcaccatcagtggatgacaactgaggacatgctgagcgtctggaatagggtgtggatcgaagagaacccctggatggaagataaaacccacatttcgtcctggggagacgttccatatctcggcaagagagaggaccagtggtgcggctctttaatcgggctgacggcccgcgcaacatgggctaccaatatacaagtggccatcaaccaggtccggaggttgattggaaatgagaactacctggattacatgacttcaatgaagcgatttaaaaatgaaagcgaccccgagggtgcgctctggtga

SEQ ID NO: 13566 - RNA, 9879 nt, synthetic construct
  misc_feature 1..9879: note = derived and/or modified CDS sequence (opt3) from DENV-1__EU677162__SS-prME
  source 1..9879: mol_type = other RNA
agcgtgaccatgctgctcatgcttatgcccacagcactggctttccacttgactacgaggggaggggaacctcatatgatcgtctccaagcaggaaagggggaaatctttactgtttaagacctcagccggtgttaatatgtgcacactaattgccatggacctcggcgagttctgtgaagatactatgacctacaaatgcccacggataacagaagcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaggacgcaaactttgtttgccgccgaacattcgtggatagaggctggggtaatgggtgtggactgtttggcaaaggctccttgataacttgcgctaagttcaagtgcgtaaccaaactcgaggggaagattgtgcagtacgaaaacctgaaatattcagtcatcgtgacagttcacaccggagaccagcatcaagtgggtaatgagagtactgaacacggcacgacagccaccattactccccaggcgcctagcaccgagatccagttaacagactacggggccctgaccctcgattgttctccaaggactggacttgactttaacgaaatggtcctgttgacaatgaaggagaaatcctggctagtgcataagcagtggttcctggatctcccgctgccctggacgtcaggcgcaagcaccagtcaagagacttggaatcggaaagaccttctggtaacatttaagaccgctcacgccaagaaacaggaagttgtggtcttgggttctcaggagggggctatgcacacagccctcactggcgcaaccgaaatccaaacgtccggaaccacaactattttcgccggccatctgaagtgccgtttaaaaatggataagctgaccctaaaagggatgagctatgtgatgtgtacaggatcgttcaagctcgagaaggaagtcgctgagactcagcacggtaccgtgctggttcagataaaatacgagggcacggacgcgccttgcaagatcccattttctacacaggatgaaaaaggggtgacccaaaacggacgccttattactgcaaatcccatcgtaacagacaaggagaaacctgtcaacatagaagccgagccacccttcggcgagtcctatattgtgatcggtgctggggaaaaggccttgaagctgtcatggtttaaaaagggcagtagcatcggaagaatgttcgaggcaaccgccaggggcgctcggcgaatggccattctcggggatactgcatgggactttggatccatcggtggcgttttcacctctgtggggaaactggtccatcagatttttggaacagcgtacggcgtgcttttcagcggtgtatcatggacgatgaagatagggatcggcgtgctgttgacctggctcggactgaatagtcgctccactagcttatctatgacatgtattgctgttggcctggtcaccctatacctcggggtgatggtgcaggccgattcaggatgcgtcatcaactggaaaggcagagaactgaagtgtggtagtgggatctttgttacaaatgaggtgcacacttggaccgaacagtataagttccaagcagacagcccgaaaaggctttccgccgctattggaaaggcctgggaggagggcgtgtgcggtatacggtctgcaacgcgcttggaaaacatcatgtggaaacagatttcgaacgagctgaatcatatcctcctggaaaacgacatgaagtttacagtagtcgtgggcgatgttgctgggattttagcccagggcaagaagatgatcagacctcagcccatggagtacaaatatagctggaagtcctggggcaaggcgaaaataatcggggccgacgtgcaaaataccactttcattatcgatggaccaaacacccctgaatgtcccgacgatcagagggcttggaatatttgggaggtcgaggactacggctttggtatcttcacaactaacatatggctgaaacttcgtgattcatatacccaggtgtgcgaccaccggttgatgagtgcagccattaaagattctaaggctgttcacgccgacatggggtactggatcgaaagcgagaaaaatgaaacatggaagctcgcacgagcgtccttcattgaggtgaagacgtgtatctggccaaaatcacataccctgtggagcaacggagtactagaatctgagatgataatccccaagatttatggcggtcctatctcccagcacaattacagaccaggctactttactcaaacagccgggccgtggcatctgggaaaactcgagctggatttcgacctttgcgaaggcaccactgtcgtggtggatgagcactgcgggaacaggggacccagtttgcgcacaaccacggtcactggcaagattatccacgaatggtgttgccggagctgtaccctgcctccattaagatttaaaggtgaggacgggtgctggtatggaatggagataaggcccgttaaggaaaaggaggaaaatctcgtgaaatctatggtatccgctggctcaggtgaggtggacagtttcagcctgggccttctgtgtatttcgatcatgatcgaagaggtcatgcgctcccgatggtctcggaagatgttgatgacagggaccctcgccgtgtttttcctgctaattatgggacagctgacttggaacgatctcatccgtctgtgcattatggttggcgcaaatgctagcgacagaatggggatgggaacaacctaccttgccttgatggcaacatttaaaatgaggcctatgttcgccgtgggcctgttatttcgccggctcacttcaagagaggtcctgcttctgaccataggtctaagtctcgtggcttccgttgaactgccaaactctttggaggaactgggggatggattagcgatgggcatcatgattctcaagctgcttacggacttccagagccatcaactgtgggccacattgctctccctgacctttatcaaaactaccttctcactacactatgcatggaagacaatggctatggtgctgagcattgtcagtctttttcccctctgtctgtctactacctcccagaagacgacatggttgccggtactgttaggcagcctcgggtgcaaacctctgaccatgttccttatcgccgagaataagatatggggaaggaaatcgtggccactgaacgaaggtatcatggccgtgggcattgtttcaatcttgctctctagtctgctaaagaacgatgtgcccctggctgggcctcttattgcaggaggcatgctcatcgcctgttacgtcatatccggtagctctgcggacctgagcttggagaaagctgccgaggtgtcctgggaagaggaagcagagcattcaggggccagtcacaatattttagtagaagtgcaggatgacggaactatgaagatcaaagatgaggagcgagacgatacactgaccatcctcctgaaggctactcttctggcagtcagcggcgtttatcccttgtctattccagccacactattcgtgtggtacttttggcagaagaaaaagcaacgctccggcgtgctgtgggacaccccttcacccccagaagtcgagcgggcggtgctcgatgacgggatatatagaatcatgcagaggggactgcttggtcgtagtcaggttggcgtaggggtgttccaggaaaacgtctttcatacgatgtggcacgtgactcgcggagctgttttaatgtaccaaggcaaacggctggagccgagctgggcctccgtgaagaaagacctcatttcttacggtgggggatggagattgcagggctcgtggaataccggcgaggaagtccaggtgatcgcagtagagcctgggaagaaccccaagaatgtccagacagccccaggaaccttcaaaacaagcgaaggtgaggtgggcgctattgccctggattttaagcccgggacttcaggatcccctatcgttaacagggaaggcaaaatagtgggtctctatgggaatggagtcgtgaccacgagtggcacatacgtttctgcaatcgctcaagccaaggcgagccaggagggcccactgcccgagattgaagacgaggtgttccgaaaacggaaccttactatcatggatctgcaccctgggtccggaaagacccgcagatatttgccggccattgtcagggaagcaatcaagcggaaactacgaacactgatactcgctccaaccagagtggtagcctcagagatggctgaagcattaaagggtatgcccattcgctaccagactaccgccgtgaaatctgagcatacaggcaaggagatcgttgacctgatgtgccacgccacgtttactatgaggcttctgagccctgtccgtgtgccaaattataacatgatcattatggatgaagctcatttcaccgaccccagttccatcgcggcacgggggtacataagcacaagagtgggaatgggcgaggccgctgccatttttatgaccgcaactcctccgggttctgtcgaagccttcccccaatcaaatgctgtaatccaggatgaggaaagggacattccagagcgctcctggaacagtgggtatgagtggatcacagattttcctggaaaaaccgtgtggttcgttcccagcataaagtcgggcaatgacattgcgaactgtctccgaaagaatggcaaaagagtgatccagttgtctcggaagacgttcgatactgaataccagaaaacaaagaacaacgactgggactacgtcgtgaccaccgatatctccgagatgggggccaattttagggcagaccgcgttattgatccacgtagatgcctgaaacctgtgatcctcaaggacggacccgaacgggtcattctggctggtccaatgccggtgactgtagccagcgcagcccaaaggcgcggccgaatagggagaaaccacaataaggagggagatcagtatatctacatgggccagcctcttaacaatgacgaggatcatgctcactggacagaagccaaaatgctactggacaacattaatacccccgagggtatcatcccagcgttgttcgaacccgagcgggaaaagtcagcagccattgatggggagtataggttacgcggcgaggctagaaaaacatttgtggaactgatgaggcggggagacctccctgtttggctgagttacaaggtcgcctctgagggcttccagtattccgatcgtcgctggtgctttgacggggaacgaaacaatcaagtgcttgaggaaaacatggatgtggagatatggactaaagagggagaaagaaagaaactgaggccacggtggctcgacgctcgcacgtacagcgaccccttggcactgagagagttcaaggaatttgccgctggtaggcggtcagtcagtggcgatctaatcctggagattgggaagctccctcagcaccttacccagcgagcccagaatgcactggacaacttagttatgttgcataatagcgaacaaggaggcagagcgtatcgccacgccatggaggagctgccggatacaatcgaaactctcatgctgcttgctctgattgccgtgctcaccggtggggtaacattgttctttctgtccggcaggggattaggcaaaacctctatcgggctactgtgtgtgatggcaagctccgtcctcctttggatggcttcagtggagccacattggatagccgcatctatcattctggagttctttttgatggttctgctcatccccgagcctgaccggcagcgtactccccaggataaccagctggcctacgtggtcattggacttctcttcatgatcctgacggtagctgcgaatgagatgggtttgctggaaaccacaaagaaagacttaggcatagggcacgtggccgttgagaaccaccatcacgcagctatgctagatgtggacctgcatccagccagtgcctggactctctacgcagtcgctaccacaattatcacccctatgatgagacacactattgaaaacacaacggccaatatctcgcttaccgcgatagctaaccaagccgcaatcctgatgggattggataagggctggcccattagcaaaatggacatcggtgtgccactgctcgccctggggtgctattcccaggtcaatcctcttactttaacagctgcagtgctgatgctcgttgcccattacgcgattatcggcccgggattgcaggctaaggccaccagggaggcacaaaagcgcaccgccgctggcataatgaaaaaccccacagtggatgggattgtagccatcgacctggatccagtggtctatgacgcaaagtttgaaaaacagctaggacagatcatgctgctcattctttgtacttctcagatcctgttgatgcggacgacctgggctctgtgcgagtcaataacactcgccactggccctctgaccacattatgggagggtagccccgggaagttctggaataccactattgcggtttccatggccaacatcttccgaggaagttaccttgcaggcgctggtctggccttttctctcatgaaaagcctaggcgggggaagaaggggcacgggggcacaaggagaaacactgggcgagaagtggaagcgccagttgaatcagctgtcaaaatccgagttcaacacctataagcggagtggtattatggaggtggacagaagcgaagctaaagaggggctcaagcgtggagagactaccaaacacgccgtctctaggggcacagccaaacttcggtggtttgtggaacgcaatctggtaaagccagagggtaaagtgatcgatttgggctgtgggcgaggaggctggtcctactattgcgcggggctgaagaaagttactgaagtgaagggatacaccaaaggcggtcctgggcacgaggaacccataccgatggctacatacggatggaacctcgtcaagttacattcaggcaaagacgtgttctttatcccacctgagaagtgtgatacgctgctttgcgacattggcgagagctcgcccaatccaaccatcgaagaggggagaactctgagggtcctaaagatggtggaaccctggctccggggaaaccagttctgtattaaaatcctgaatccttatatgccgtctgttgtagagacattggagcaaatgcagcgcaagcacggtggcatgctggtgagaaaccccctcagtagaaattccacccatgaaatgtactgggtcagctgcgggactggaaacattgtgtcagcagttaatatgacatcccgaatgcttctgaaccggtttaccatggcccaccgtaaaccaacgtatgagagagatgtggacttaggcgctggtacccgccacgtcgccgtggaacctgaggtagcaaacctggatatcatagggcagaggattgaaaatatcaagcatgagcacaaatctacatggcattacgacgaggataacccctataagacttgggcctaccacggaagctatgaagtgaagcctagtggctccgctagctctatggttaatggcgtcgtgaaattgctcaccaagccatgggacgtgatccccatggtcacacagattgcgatgactgataccacacctttcgggcaacagcgggtttttaaagagaaggtggacaccagaactccaaaagccaagcgcggaacggcacagataatggaagtaacagctaagtggctgtggggtttcctatcaaggaacaaaaagccccgaatctgtacccgggaggaatttactagaaaagtgaggagtaatgccgcaattggcgccgtcttcgtggacgagaaccaatggaactccgctaaggaggccgttgaagatgagcgcttttgggaccttgtgcatcgtgaacgggagctgcacaaacaggggaagtgcgcgacctgcgtctacaacatgatgggaaagagagagaagaagctcggcgagttcggtaaagcaaaggggagcagggccatctggtacatgtggctgggagctcgcttcttggagtttgaagccctgggcttcatgaatgaggatcactggttttctcgagaaaactcgctctcaggcgtggagggggagggacttcataaactgggttatattttacgggacatcagcaagataccgggcgggaatatgtacgcagatgacacagctggatgggatacgagaatcaccgaagacgatctgcagaacgaggccaaaattactgacatcatggaacctgagcacgctttgctcgccaagtccattttcaagctgacatatcagaataaagtagttagggtgcaacgcccagcaaagaacggcaccgtcatggatgtgatcagtagacgggaccagaggggttctggacaggtgggaacttacggcctaaatacatttaccaacatggaagcgcagcttatacgtcaaatggagagcgagggcattttctccccctcagaactggagacacctaacctcgccgggcgagtcctggattggttggaaaaacatggagttgagcgcttaaagagaatggctatcagtggtgacgactgtgtggtaaaaccaatcgatgaccggtttgccactgcactgaccgctctcaatgatatgggcaaggtgaggaaggacattccccagtgggaaccgtctaaagggtggaacgattggcagcaggtccctttctgcagccaccactttcatcaacttataatgaaggacggacgcgagatcgtggttccctgtagaaatcaggatgagctggtgggccgggccagggtctcccagggtgcagggtggtcactacgagaaacggcctgcctgggaaaaagctatgcgcagatgtggcaactcatgtacttccaccgtagagacttgcgcctggctgccaacgcaatttgttctgccgtgccagtagattgggttcctacctcccggacaacttggagtatccatgctcaccatcagtggatgaccacagaggacatgcttagcgtgtggaatagggtctggattgaagagaacccctggatggaagataagactcacatctcgtcctggggcgacgtgccatatctgggcaaaagagaggaccagtggtgcgggtctctcataggattaaccgcccgcgcaacgtgggctacaaatatccaagttgccattaaccaggtgcggaggctgatcggtaatgagaactacttggattacatgacctcaatgaagcgatttaagaatgaaagcgaccccgagggcgcgctgtggtga

SEQ ID NO: 13567 - RNA, 9879 nt, synthetic construct
  misc_feature 1..9879: note = derived and/or modified CDS sequence (opt3) from DENV-1__EU677164__SS-prME
  source 1..9879: mol_type = other RNA
agcgtgaccatgctgctcatgcttatgcccactgcactggctttccacttgactacgagaggcggggaacctcatatgatcgtctccaagcaggaaagggggaaatctttactgtttaagacctcagccggtgttaacatgtgcaccctaattgcaatggacctcggcgagttctgtgaagatactatgacctacaaatgcccacggataaccgaggcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaggacgcaaactttgtttgccgccgaacattcgtggatagaggctggggtaatgggtgtggactgtttggcaaaggctccttgataacttgcgctaagttcaagtgcgtaaccaaactcgaggggaagacagtgcagtacgaaaacctgaaatattcagtcattgtgaccgttcacactggagaccagcatcaagtgggtaatgagagtacggaacacggcacaaccgccactatcacaccccaggcgcctagcacagagattcagttaaccgactacggggccctgactctcgattgttctccaaggacaggacttgactttaacgaaatggtcctgttgacgatgaaggagaaatcctggctagtgcataagcagtggttcctggatctcccgctgccctggacctcaggcgcaagcacaagtcaagagacatggaatcggaaagaccttctggtaacctttaagacagctcacgccaagaaacaggaagttgtggtcttgggttctcaggagggggctatgcacactgccctcaccggcgcaacggaaatccaaacctccggaacaactaccatcttcgccggccatctgaagtgccgtttaaaaatggataagctgacactaaaagggatgagctatgtgatgtgtactggatcgttcaagctcgagaaggaagtcgctgagacccagcacggtacggtgctggttcagattaaatacgagggcacagacgcgccttgcaagataccattttctacccaggatgaaaaaggggtgactcaaaacggacgccttatcacagcaaatcccattgtaaccgacaaggagaaacctgtcaacatcgaagccgagccacccttcggcgagtcctatatagtgattggtgctggggaaaaggccttgaagctgtcatggtttaaaaagggcagtagcatcggaaaaatgttcgaggcaactgccagaggcgctaggcggatcgccattctcggggataccgcatgggactttggatccatcggtggcgttttcacatctgtggggaagctggtccatcagatttttggaacggcgtacggcgtgcttttcagcggtgtatcatggaccatgaaaatagggatcggcgtgctgttgacttggctcggactgaatagtcgatccactagcttatctatgacctgtattgctgttggcctggtcacactatacctcggggtgatggtgcaggccgattcaggatgcgtcatcaactggaagggccgcgaactgaagtgtggtagtgggatctttgttactaatgaggtgcacacctggacggaacagtataaattccaagcagacagcccgaagagactttccgccgctattggaaaagcctgggaggagggcgtgtgcggtataaggtctgcaacacggttggaaaacatcatgtggaagcagatttcgaacgagctgaatcatatcctcctggaaaacgacatgaaatttaccgtagtcgtgggcgatgttgctgggattttagcccagggaaagaaaatgatccgccctcagcccatggagtacaagtatagctggaagtcctggggcaaagcgaagataatcggggccgacgtgcaaaatactaccttcattatcgatggaccaaacacacctgaatgtcccgacgatcagagagcttggaatatttgggaggtcgaggactacggctttggtatcttcactaccaacatatggctgaaacttagggattcatatacacaggtgtgcgaccaccgtttgatgagtgcagccattaaggattctaaagctgttcacgccgacatggggtactggatcgaaagcgagaagaatgaaacgtggaagctcgcacgggcgtccttcattgaggtgaaaacctgtatctggccaaagtcacatactctgtggagcaacggagtactagaatctgagatgataatccccaaaaattatggcggtcctatttcccagcacaactaccgaccaggctactttacacaaaccgccgggccgtggcatctgggaaagctcgagctggatttcgacctttgcgaaggcactacagtcgtggtggatgagcactgcgggaatagaggacccagtttgaggaccacgactgtcaccggcaaaatcattcacgaatggtgttgccgcagctgtacactgcctccattacggtttaagggtgaggacgggtgctggtatggaatggagatcagacccgttaaggaaaaagaggaaaacctcgtgaagtctatggtatccgctggctcaggtgaggtggacagtttcagcctgggccttctgtgtatatcgattatgatcgaagaggtcatgaggtcccgctggtctcgaaaaatgttgatgaccgggactctcgccgtgctgtttctactgatcatgggacagctcacatggaatgatctgattcggctttgcatcatggttggcgcaaacgctagcgaccgtatggggatgggaaccacatacttggccctgatggcaactttcaagatgagacctatgtttgccgtgggcttactcttcaggcgcctgacctcacgggaggtccttctgctaacgattggtctcagtctggtggcttccgttgaattgccaaattctctggaggaattaggggatggactcgcgatgggcataatgatcctgaaacttctgacagactttcagagccatcaattgtgggccaccctcctgtccctaactttcattaagaccacattttcactgcactatgcatggaagactatggctatggtgcttagcatcgtcagtctcttccccctgtgtttgtctaccacgtcccagaaaacaacctggctgccggtattactcggcagcctggggtgcaagcctcttactatgtttctgattgccgagaacaaaatctggggaagaaagtcgtggccattgaacgaaggtataatggccgtgggcatcgtttcaattctcctgtctagtctactgaaaaatgatgtgccccttgctgggcctctcatcgcaggaggcatgctgattgcctgttacgtcatctccggtagctctgcggacttgagcttagagaaggctgccgaggtgtcctgggaagaggaagcagagcattcaggggccagtcacaacatactggtagaagtgcaggatgacggaacaatgaaaattaaggatgaggagagggacgataccctcactacactgcttaaggctaccctgttggcagtcagcggcgtttatcccctatctatcccagccacgctgttcgtgtggtacttctggcagaaaaagaaacaacgatccggcgtgctctgggacactccttcacccccagaagtcgagcgcgcggtgctggatgacgggatctatcggattatgcagagaggacttttaggtaggagtcaggttggcgtaggggtgtttcaggaaaatgtcttccataccatgtggcacgtgacacgtggagctgttctgatgtaccaaggcaagcgcctcgagccgagctgggcctccgtgaaaaaggacttgatatcttacggtgggggatggcggctgcagggctcgtggaacaccggcgaggaagtccaggtgatcgcagtagagcctgggaagaatcccaaaaacgtccagacagccccaggaacttttaagaccagcgaaggtgaggtgggcgctattgccctcgatttcaaacccgggacgtcaggatcccctatcgttaatagagaaggcaagattgtgggtctgtatgggaacggagtcgtgacaacaagtggcacctacgtttctgcaatcgctcaagccaaagcgagccaggagggcccacttcccgagatagaagacgaggtgtttaggaagcgaaatctgacaatcatggatttgcaccctgggtccggaaagacccggcgctatctaccggccattgtcagagaagcaatcaaaaggaagctgcggactctcattttagctccaacccgagtggtagcctcagagatggctgaagcactgaaaggtatgcccatcagataccagacaacggccgtgaagtctgagcatactggcaaagagatagttgaccttatgtgccacgccaccttcacaatgcgcctgctcagccctgtcagggtgccaaactataatatgattatcatggatgaagctcattttaccgaccccagttccatcgcggcacgtgggtacattagcactcgggtgggaatgggcgaggccgctgccatcttcatgacagcaacccctccgggttctgtcgaagcctttccccaatcaaacgctgtaatacaggatgaggaaagagacattccagagaggtcctggaatagtgggtatgagtggatcacggatttccctggaaagactgtgtggtttgttcccagcattaagtcgggcaacgacatcgcgaattgtttgcgcaaaaacggcaagcgagtgatacagctgtctagaaaaacattcgataccgaataccagaagaccaaaaacaatgactgggactacgtcgtgactacagatatttccgagatgggggccaacttccgggcagacagggttatcgatccacgccgttgcctcaagcctgtgatcctgaaggacggacccgaaagagtcattcttgctggtccaatgccggtgaccgtagccagcgcagcccaacggaggggccgcatcgggcgaaatcacaacaaagagggagatcagtatatttacatgggccagcctctaaataacgacgaggatcatgctcactggacagaagccaagatgctgttggacaatataaacactcccgagggtatcattccagcgttatttgaacccgagagagaaaaatcagcagccatcgatggggagtatcggctgaggggcgaggctcgcaagacgttcgtggaactcatgagaaggggagacctgcctgtttggcttagttacaaagtcgcctctgagggctttcagtattccgatcggcgttggtgcttcgacggggaacgcaataaccaagtgctggaggaaaatatggatgtggagatctggaccaaggagggagaacgaaagaaactcagaccaaggtggttggacgctcggacatacagcgaccccctggcactacgcgagtttaaagagttcgccgctggtagaaggtcagtcagtggcgatctgattctcgagatagggaaacttcctcagcacctgactcagcgggcccagaacgcattagacaatttggttatgctgcataacagcgaacaaggaggccgagcgtatagacacgccatggaggagctcccggataccatcgaaacactgatgcttctggctctcattgccgtgttgaccggtggggtaactctgtttttcttatccggccgcggactaggcaagacgtctatcgggctgctctgtgtgatggcaagctccgtccttctgtggatggcttcagtggagccacattggattgccgcatctatcatattggaatttttcctgatggttctcctgatccccgagcctgacaggcagcggacaccccaggataatcagcttgcctacgtggtcattggactcctgtttatgatcttgacagtagctgcgaacgagatgggtctgttagaaactaccaaaaaggacctaggcattgggcacgtggccgttgagaaccaccatcacgcagctatgctggatgtggacctccatccagccagtgcctggacactttacgcagtcgctaccactatcataacacctatgatgcgtcacacgattgaaaataccactgccaacatctcgctgacagcgattgctaatcaagccgcaatcttgatgggactggataaaggctggcccataagcaagatggacatcggtgtgccactcctggcccttgggtgctattcccaggtcaaccctttaaccctgaccgctgcagtgctcatgttggttgcccattacgcgattatcggcccgggactgcaggctaaggccacaagagaggcacaaaagaggactgccgctggcattatgaagaatcccacggtggatgggatcgtagccatagacctagatccagtggtctatgacgcaaaattcgaaaagcagctgggacagattatgctccttatcctgtgtacctctcagatcttgctgatgcgcacaacttgggctctctgcgagtcaattaccctggccacaggccctttaaccactctttgggagggtagccccgggaaattttggaacacgacaatcgcggtttccatggccaatatattccggggaagttacctggcaggcgctggtctcgccttctctctaatgaaaagcctgggcgggggacgaagaggcaccggggcacaaggagaaactttgggcgagaagtggaaaaggcagctgaaccagctctcaaagtccgaatttaatacctataaacgcagtggtattatggaggtggaccggagcgaagctaaggaggggcttaaaagaggagagacaactaagcacgccgtctctcgtggcaccgccaagctgaggtggttcgtggaacggaacttggtaaaaccagagggtaaggtgatcgatctgggctgtgggcgcggaggctggtcctactattgcgcggggctcaaaaaggttacagaagtgaaaggatacacgaagggcggtcctgggcacgaggaacccattccgatggctacctacggatggaatttagtcaaactgcattcaggcaaggacgtgtttttcatcccacctgagaagtgtgatactcttctgtgcgacataggcgagagctcgcccaacccaacaatcgaagaggggcgaaccctaagagtcctcaaaatggtggaaccctggctgaggggaaatcagttttgtattaagatcttgaacccttatatgccgtctgttgtagagactctggagcaaatgcagcggaaacacggtggcatgctcgtgcgcaatccccttagtagaaactccacacatgaaatgtactgggtcagctgcgggaccggaaatattgtgtcagcagttaacatgacgtccaggatgctgttaaaccgattcaccatggcccaccggaagccaacatatgagcgtgatgtggacctgggcgctggtactagacacgtcgccgtggaacctgaggtagcaaatttggatatcattgggcagcgcatcgaaaacataaaacatgagcacaagtctacctggcattacgacgaggataatccctataagacatgggcctaccacggaagctatgaagtgaaacctagtggctccgctagctctatggttaacggcgtcgtgaagctcctgactaaaccatgggacgtgattcccatggtcacccagatcgcgatgacagataccactccttttgggcaacagagggttttcaaggagaaagtggacacgcggacaccaaaggccaagagaggaaccgcacagatcatggaagtaactgctaaatggctatggggttttctttcacgcaataagaaacccaggatttgtacccgagaggagttcacacggaaggtgagaagtaacgccgcaataggcgccgtctttgtggacgagaatcaatggaactccgctaaagaggccgttgaagatgagaggttctgggacctggtgcatcgcgaacgtgagctccacaagcaggggaagtgcgcgacgtgcgtctacaatatgatgggaaaacgggaaaagaaactgggcgagtttggtaaggcaaaagggagcagagccatctggtacatgtggttgggagctaggttcctggagttcgaagccctcggctttatgaacgaggatcactggttctctcgcgaaaattcgctttcaggcgtggagggggagggactgcataagttaggttatattctgcgagacatcagcaaaattccgggcgggaacatgtacgcagatgacaccgctggatgggatactcggatcacagaagacgatttgcagaatgaggccaagataaccgacatcatggaacctgagcacgctctcctggccaagtccatttttaaactaacttatcagaacaaggtagttagagtgcaaaggccagccaagaatggcacagtcatggatgtgatcagtcgcagagaccagcggggttctggacaggtgggaacctacggccttaacacattcactaacatggaagcgcagctgattaggcaaatggagagcgagggcatcttttccccctcagaactcgagacccctaatctggccgggcgtgtcttggattggttagaaaagcatggagttgagcgactgaaacgcatggctataagtggtgacgactgtgtggtaaagccaattgatgacagattcgccacggcactcaccgctcttaacgatatgggcaaggtgcggaaagacatcccccagtgggaaccgtctaaggggtggaatgattggcagcaggtccctttttgcagccaccacttccatcaactgatcatgaaagacggaagggagattgtggttccctgtcgcaaccaggatgagctagtgggcagagcccgggtctcccagggtgcagggtggtcactgagggaaacagcctgcctcggaaagagctatgcgcagatgtggcaattgatgtactttcaccgacgtgacctgagacttgctgccaatgcaatatgttctgccgtgccagtagattgggttcctacttcccgcaccacatggagtatccatgctcaccatcagtggatgactaccgaggacatgctgagcgtgtggaaccgggtctggattgaagagaatccctggatggaagataaaacgcacatctcgtcctggggcgacgtgccatatctcggcaagagggaggaccagtggtgcgggtctttaattggactgacagccagagcaacctgggctactaacatccaagttgccataaatcaggtgcgccggttgatcggtaacgagaattacctggattacatgacatcaatgaagaggttcaaaaacgaaagcgaccccgagggcgcgctctggtga

SEQ ID NO: 13568 - RNA, 9879 nt, synthetic construct
  misc_feature 1..9879: note = derived and/or modified CDS sequence (opt3) from DENV-1__EU677165__SS-prME
  source 1..9879: mol_type = other RNA
agcgtgaccatgctgctcatgcttatgcccaccgccctggctttccacttgactacgcggggcggggaacctcatatgatcgtctccaagcaggaaaggggaaagtctttactgtttaagacctcagccggtgttaatatgtgcacactaattgccatggacctcggcgaactgtgtgaagatactataacctacaagtgcccacggatcacagaaaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagattcagagggtggaaacctgggccctccggcaccctggattcacagttatcgctctgtttctggcacatgccattggcacctcgatcacgcagaagggcataatcttcattctcttaatgctggctactccatcaatggccatgcgctgcgtggggatcggaagcagagattttgtcgagggtcttagtggcgcgacatgggtggacgtagttttggagcacgggtcctgtgtgaccactatggcaaaggataaacccacactggacattgaactactcaagaccgaggtcacgaaccctgccgtgctgaggaaactttgcatcgaagctaagatatctaataccacaactgatagccggtgtccaacccaaggagaggccacactggtggaagaacaggacgcaaacttcgtctgccgccgaacttttgttgatagaggctggggtaatgggtgtggattgttcggcaaaggctccctcattacctgcgctaagtttaagtgcgtgacaaaactggaggggaagatcgtacagtacgaaaacttaaaatattcagtgattgtcaccgtgcacactggagaccagcatcaagttggtaatgagagtacggaacacggcacaaccgccactatcacaccccaggcgcctacaaccgagatccagctgactgactacggggccctcacacttgattgtagcccaaggacgggactggacttcaacgaaatggtgttgctaaccatgaaggagaaatcttggctggtccataagcagtggtttctcgatctgccgcttccctggacttccggcgcatcaacaagccaagagacctggaatcggcaggacctgttggtgacattcaaaactgctcacgccaagaagcaggaagtagttgtgctcggtagtcaagagggggctatgcacaccgccctgacgggcgcaaccgaaattcagacatctggaactaccacaatatttgccggccatttaaaatgccgtctgaagatggataaactaactctccgcgggatgtcctatgtcatgtgtaccgggtcgttcaagctggagaaagaagtggctgagacgcagcacggtacagtccttgtgcagatcaagtacgagggcaccgacgcgccttgcaagattccattctcgactcaagatgaaaaaggggttacacagaacggaagattgatcaccgcaaatcccatagtgactgacaaggagaaacctgtaaacattgaagccgagccaccctttggcgagtcttatatcgtcatcggtgctggggaaaaggccctgaaactctcctggttcaagaagggctcaagtattggaaaaatgtttgaggcaaccgccaggggcgctcggcgaatggccatcctgggggatacagcatgggacttcggaagcattggtggcgtgtttacgtccgttgggaaacttgtgcatcagatattcggaaccgcgtacggcgtcctgttttctggtgtgagctggactatgaaaatcgggattggcgtattgctcacatggctgggattaaattcacgcagtacctccctgagcatgacatgtatcgctgtgggcctagttactctctacctgggggtcatggtgcaggccgattctggatgcgtgatcaactggaagggcagagaacttaaatgtggttcagggattttcgtcaccaatgaggttcacacgtggacagaacaatataagtttcaggcagacagtccgaagaggttgagcgccgctataggaaaagcctgggaggagggcgtgtgcggtatccggtccgcaacccgcctggaaaacattatgtggaagcagatctctaacgagctcaatcatattctgttagaaaacgacatgaaattcactgtggtagtcggcgatgtggctgggatcctggcccagggaaagaaaatgataagacctcaacccatggagcacaagtactcgtggaaaagctggggcaaggcgaagatcattggggccgacgttcagaataccacatttatcattgatggaccaaacactcctgaatgtcccgacgatcagagggcttggaatatctgggaggtggaggactatggcttcggtatatttaccacaaacatttggcttaaattgcgtgattcctacacgcaggtctgcgaccaccggctcatgtcagcagccatcaaggatagtaaagctgtgcatgccgacatggggtattggattgaatctgagaagaatgaaacctggaaactggcacgagcgagcttcatcgaggttaagacttgtatatggccaaagtcccacacactatggtcaaacggagtgctggaaagcgagatgatcattcccaaaatctacggcggtcctatttctcaacataattatagaccaggctacttcacccagactgccgggccgtggcacctcggaaagctggagcttgattttgacttgtgcgaaggcacaaccgtagtcgtggatgagcactgcgggaacaggggaccctccctgcgcacgactaccgtgacaggcaaaatcatacatgaatggtgttgccggagttgtaccttacctccactcagattcaggggtgaggacgggtgctggtacggaatggagattcgccccgtcaaggaaaaagaggaaaatctggttaagagcatggtgtctgctggctccggtgaggtagactcatttagtcttggcctgttgtgtatcagcatcatgattgaagaggtgatgcgatcgcggtggtcccgtaagatgctcatgactgggacactggccgtcttctttctactgatcatgggacagctcacctggaacgatctgattagactttgcataatggtgggcgcaaatgcttctgacaggatggggatgggaacaacttatttggccctgatggcaaccttcaaaatgcgccctatgtttgccgttggcttactcttccggagactgacgagcagggaggtgcttctgctaacaatcggtctctcactggtcgctagtgtggaattgccaaactccctggaggaattaggggatggactcgcgatgggcattatgatcctgaaacttctgaccgactttcaatctcaccagttgtgggccactctcctgagcctaaccttcattaaaacaactttttccctgcattacgcatggaagaccatggctatggttctttcaatcgtgagcctcttccccctgtgtttgagtacgacatctcagaaaaccacttggctgccggtcttactcggctccctggggtgcaagcctcttacaatgtttctgatagccgagaataagatctggggacgacgcagctggccattgaacgaaggtattatggccgtaggcatcgtgtcgattctcctgtcatctctactgaaaaacgatgttccccttgctgggcctctcatcgcaggaggcatgctgatagcctgttatgtgattagtggttccagcgcggacttgtctttagagaaggctgccgaggtcagctgggaagaggaagcagagcactccggggcctcacataatatcctggtggaagtacaggatgacggaaccatgaaaatcaaggatgaggagcgggacgatactctcacaattctgcttaaagctaccctgttggcagtgagtggcgtctaccccctaagcataccagccacgctgttcgtttggtatttctggcaaaagaaaaagcagagatctggcgtgctctgggacactccttcacccccagaagtggagagggcggtcctggatgacgggatctaccgtattatgcagcgcggacttttaggtcggagccaggtgggcgttggggtatttcaagaaaacgtgttccacaccatgtggcacgtcacaagaggagctgtgctgatgtatcagggcaagaggctcgagccgagttgggccagcgttaaaaaggacttgatctcctacggtgggggatggcgactgcagggctcttggaataccggcgaggaagtgcaggtcattgcagtggagcctgggaaaaaccccaagaatgtacaaacagccccaggaacttttaaaacccccgaaggtgaggtcggcgctatcgccctcgatttcaagcctgggacgtcgggaagcccaatagtgaaccgggaaggcaagatcgttggtctgtacgggaatggagtggtcacaacttcaggcacctatgtgtccgcaattgctcaggccaaagcgagtcaggagggcccccttcctgagatcgaagacgaggtttttcgcaagagaaacctgacaattatggatttgcatccggggtctggaaaaaccaggcggtacctaccagccatcgtgcgagaagcaataaagagaaaactgcgcactctcattttagctcccaccagggtcgtggccagcgagatggctgaagcactgaagggtatgcctatccgttatcaaacaacggccgtaaagtccgagcacactggcaaagagatcgtggaccttatgtgccatgccaccttcacaatgcggctgctctcaccagttagagtccccaattacaacatgattatcatggatgaagctcactttaccgacccttctagcatagcggcaagggggtatattagtactcgcgtgggaatgggcgaggccgctgccatcttcatgacagcaaccccgcccggttccgtggaagcctttccacagagcaatgctgtcattcaggatgaggaacgagacatccctgagagatcttggaactcagggtacgagtggataacggatttccccggaaagactgtatggtttgtgccatccattaaaagtggcaatgacatcgcgaactgtttgcggaagaatggcaaaagggttatccagctgagccgcaagacattcgataccgaatatcaaaagaccaaaaacaacgactgggactacgtggtcactacagatatttcggagatgggggccaatttccgtgcagacagagtgatcgatcctcggaggtgcctcaagcccgttattctgaaagacggaccagaacgcgtgatacttgctggtccgatgcctgtcaccgtggcctctgcagcccagcgaagaggccggatcgggaggaaccataataaggagggagatcagtacatttatatgggccagcccctaaacaatgacgaggatcacgctcactggacagaagccaaaatgctgttggacaacatcaatactccagagggtatcattcccgcgttatttgaacctgagcgcgaaaagtccgcagccatagatggggagtacagactgaggggcgaggctcggaagacgttcgtagaactcatgcgtcgcggagacctgccagtgtggcttagctataaagttgcctcagagggctttcaatacagtgatcgaagatggtgcttcgacggggaaaggaacaatcaggtcctggaggaaaacatggatgtggagatctggaccaaggagggagaacggaaaaagctccgccccagatggttggacgctaggacatattctgaccctctggcactacgggagtttaaagagttcgccgctggtcgaagatccgtgagcggcgatctgattctcgagatcgggaaacttccgcagcatctgactcagcgcgcccaaaatgcattagacaacttggtcatgctgcacaattcagaacagggaggcagggcgtaccggcatgccatggaggagctcccagataccattgaaacactgatgcttctggctctcatcgccgttttgaccggtggggtgactctgtttttcttaagtggccgtggactaggcaaaacgagcatagggctgctctgtgtaatggcatcctctgtgcttctgtggatggctagcgtcgagccccactggatcgccgcatccattatcttggaatttttcctgatggtgctcctgattcctgagcccgacagacagaggaccccacaggataaccaacttgcctatgttgtgatcggactcctgtttatgatattgacagtcgctgcgaatgagatgggtctgttagaaactaccaagaaggacctaggcattgggcacgtagccgtggagaaccatcaccatgcagctatgctggatgttgacctccaccctgcctcagcctggacactttacgcagtggctaccactatcattacacccatgatgcgccatacgatcgaaaacaccactgccaatatatctctgacagcgatcgctaaccaggccgcaattttgatgggactggataaaggctggccaatcagtaagatggacattggtgtccctctcctggcccttgggtgctacagccaggtgaatccgttaaccctgaccgctgcagtcctcatgttggtggcccactatgcgatcataggccccggactgcaagctaaagccacacgggaggcacagaagcgaactgccgctggcattatgaaaaacccaacggttgatgggatcgtggccatcgacctagatcctgtagtgtacgacgcaaagttcgaaaagcagctgggacagattatgctccttatcctgtgtaccagccaaatattgctgatgagaacaacttgggctctctgcgagtccattaccctggccacaggccccttaaccactctttgggagggttctccagggaaattttggaatacgacaatcgcggtctcaatggccaacattttcaggggaagctatctggcaggcgctggtctcgccttctccctaatgaagagtctgggcgggggacgccggggcaccggggcacagggagaaactttgggcgagaaatggaagagacagctgaatcagctctctaaaagcgaatttaacacctacaagcgttcaggtatcatggaggttgacaggtccgaagctaaggaggggcttaaacggggagagacaactaagcacgccgtgagtcgcggcaccgccaaactgcgatggttcgtcgaaagaaatttggtgaagcctgagggtaaagtaatagatctgggctgtgggaggggaggctggagctattactgcgcggggctcaagaaggtgacagaagttaaaggatatacgaagggcggtcccgggcatgaggaaccgatcccaatggctacctacggatggaacttagtgaaactgcactctggcaaggacgtctttttcattcctcccgagaaatgtgatactcttctgtgcgacatcggcgagtcctcaccaaatcccacaattgaagaggggcggaccctacgcgtgctcaagatggtcgaaccttggctgagaggaaaccaattttgtatcaaaattttgaatccgtacatgcccagcgtggttgagactctggagcagatgcagaggaagcatggtggcatgctcgtacgaaacccactttcgagaaattctacacacgaaatgtattgggtgagttgcgggaccggaaacatcgtctccgcagtgaatatgacgagccgtatgctgttaaacagattcaccatggcccaccgcaagcctacatacgagagggatgttgacctgggcgctggtactcggcatgtggccgtcgaacccgaggtggcaaacttggatataattgggcagagaatcgaaaatatcaaacacgagcataagtcaacctggcactatgacgaggataacccttacaaaacatgggcctatcatggatcctacgaagtaaagccatctggcagcgctagttccatggtgaatggcgttgtcaaactcctgactaagccctgggacgtgattcctatggtgacccaaatagcgatgacagataccactccatttgggcagcagcgcgtcttcaaggagaaagttgacacgaggacacccaaggccaaacgaggaaccgcacaaatcatggaagtgactgctaagtggctatggggttttcttgcccggaacaaaaagccgagaatttgtaccagggaggagttcacacgcaaggtacgtagcaatgcagccatcggcgctgtgtttgtcgacgagaaccagtggaactctgccaaagaggcggtggaagatgagcggttctgggacctggttcacagagaaagggagctccacaagcaggggaaatgcgcaacgtgcgtgtataacatgatgggaaagcgcgagaagaagctgggcgagtttggtaaggccaaagggtcacgagctatttggtacatgtggttgggagcccggttcctggagttcgaagcactcggctttatgaatgaggatcattggttcagtagagaaaactcccttagcggcgtcgagggggagggactgcacaagttaggttacatcctgagggacatatctaaaatccctggcgggaatatgtatgctgatgacaccgccggatgggatactcgcattacagaagacgatttgcagaacgaggctagaatcaccgacattatggaaccagagcatgccctcctggcaaagtcgatctttaaactaacttaccaaaataaggtggtacgggttcagaggcccgcgaaaaacggcacagtgatggatgtcatatcacgtcgagaccagcgcggtagcggacaggtgggaacctatggccttaatacattcactaacatggaagcccaactgattagacagatggagtccgagggcatctttagtccttctgaactcgagaccccaaacctggctgaacgggtgttggattggttagagaagtacggggtcgaaaggctgaagcgcatggccatcagcggagacgactgtgttgtgaaacccattgatgacagattcgcaacggctctcaccgcccttaatgatatgggtaaggtacggaaagacataccgcagtgggagccttccaagggctggaacgattggcagcaagtgcccttttgctcacaccacttccatcagctgatcatgaaagacgggagggagattgtcgtgccatgtcgaaatcaggatgagctagttggacgtgcaagagtgagtcagggcgccggttggtctctgcgcgagacagcgtgcctcgggaagtcctatgctcaaatgtggcagttgatgtactttcaccggagggacctgagacttgccgcaaacgccatctgttccgctgtccctgtggattggattcccacttcacgcaccacatggagcatccatgcccaccatcagtggatgactaccgaagacatgctgtctgtatggaatcgggtttggatagaggaaaacccatggatggaggataagacgcacatctccagttggggagacgtgccctatctcggcaaaagggaggaccaatggtgcggcagcttaattgggctgacagcacgagctacctgggccactaatatccaggtcgcgattaaccaggtgagacggttgatcggaaatgaaaactacctggattacatgacatcgatgaagaggttcaaaaatgagtccgaccctgaaggtgctctctggtga

SEQ ID NO: 13569 - RNA, 9879 nt, synthetic construct
  misc_feature 1..9879: note = derived and/or modified CDS sequence (opt3) from DENV-1__EU677140__SS-prME
  source 1..9879: mol_type = other RNA
agcgtgaccatgctgctcatgcttatgcccacagccctggctttccacttgactacgagaggaggggaacctcatatgatcgtctccaagcaggaaagaggaaaatctttactgtttaagacctcagccggtgttaatatgtgcacactaattgccatggacctcggcgagctgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccgggtcgttcaaactggagaaggaagtcgccgagacgcagcacggtacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattatcatcggtgccggggaaaaagctctgaagctctcctggttcaagaaaggctcaagtattggaaagatgtttgaggccaccgcaagaggcgccaggcggatggctatcctgggggatacagcctgggacttcggaagcattggtggcgtgtttacgtccgttgggaaacttgtgcatcagatattcggaaccgcatacggcgtcctgttttctggtgtgagctggactatgaagatcgggattggcgtattgctcacatggctgggattaaattcacgaagtacctccctgagcatgacatgtatcgcggtgggcctagttactctctacctgggggtcatggtgcaggctgattctggatgcgtgatcaactggaaaggccgcgaacttaagtgtggttcagggattttcgtcaccaatgaggttcacacgtggacagaacaatataagtttcaggccgacagtccgaaaagattgagcgcagccataggaaaggcttgggaggagggcgtgtgcggtatcaggtccgccacccggctggaaaacattatgtggaaacagatctctaacgagctcaatcatattctgttagaaaacgacatgaagttcactgtggtagtcggcgatgtggcagggatcctggctcagggcaaaaagatgatacgccctcaacccatggagtacaaatattcgtggaaaagctggggcaaggccaagatcattggggcggacgttcagaataccacatttatcattgatggaccaaacactcctgaatgtcccgacgatcagagagcctggaatatctgggaggtggaggactacggcttcggtatatttaccacaaacatttggcttaagttgagggattcccacacgcaggtctgcgaccaccgtctcatgtcagctgcaatcaaagatagtaaggccgtgcatgctgacatggggtattggattgaatctgagaaaaatgaaacctggaagctggcccgggcatccttcatcgaggttaagacttgtatatggccaaaatcccacacactatggtcaaacggagtgctggaaagcgagatgatcattcccaagatctacggcggtcctatttctcaacataattatcgaccaggctacttcacccagactgcggggccgtggcacctcggaaaactggagcttgattttgacttgtgcgaaggcacaaccgtagtcgtggatgagcactgcgggaacagaggaccctccctgaggacgactaccgtgacaggcaagatcatacatgaatggtgttgccgcagttgtaccttacctccactccggttcagaggtgaggacgggtgctggtacggaatggagattaggcccgtcaaagaaaaggaggaaaatctggttaagagcatggtgtctgccggctccggtgaggtagactcatttagtcttggcctgttgtgtatcagcatcatgattgaagaggtgatgcgctcgcgatggtcccggaaaatgctcatgactgggacactggctgtcttctttctactgatcatgggacagctcacctggaacgatctgattcgtctttgcataatggtgggcgccaatgcatctgacagaatggggatgggaacaacttatttggctctgatggccaccttcaagatgaggcctatgtttgcagttggcttactcttccgccggctgacgagcagagaggtgcttctgctaacaatcggtctctcactggtcgccagtgtggaattgccaaactccctggaggaattaggggatggactcgctatgggcattatgatcctgaaacttctgaccgactttcaatctcaccagttgtgggcgactctcctgagcctaaccttcattaagacaactttttccctgcattacgcctggaaaaccatggcaatggttctttcaatcgtgagcctcttccccctgtgtttgagtacgacatctcagaagaccacttggctgccggtcttactcggctccctggggtgcaagcctcttacaatgtttctgatagctgagaataaaatctggggaaggcgaagctggccattgaacgaaggtattatggccgtaggcatcgtgtcgattctcctgtcatctctactgaagaacgatgttccccttgccgggcctctcatcgctggaggcatgctgatagcatgttatgtgattagtggttccagcgccgacttgtctttagagaaagcggctgaggtcagctgggaagaggaagccgagcactccggggcatcacataatatcctggtggaagtacaggatgacggaaccatgaagatcaaagatgaggagcgcgacgatactctcacaattctgcttaaggccaccctgttggctgtgagtggcgtctaccccctaagcataccagcaacgctgttcgtttggtatttctggcagaaaaagaagcagcggtctggcgtgctctgggacactccttcacccccagaagtggagagagccgtcctggatgacgggatctacaggattatgcagcgtggacttttaggtcgcagccaggtgggcgttggggtatttcaagaaaacgtgttccacaccatgtggcacgtcacacggggagcggtgctgatgtatcagggcaaaagactcgagccgagttgggctagcgttaagaaagacttgatctcctacggtgggggatggaggctgcagggctcttggaataccggcgaggaagtgcaggtcattgccgtggagcctgggaagaaccccaaaaatgtacaaacagcaccaggaacttttaagacccccgaaggtgaggtcggcgccatcgctctcgatttcaagcctgggacgtcgggaagcccaatagtgaaccgagaaggcaaaatcgttggtctgtacgggaatggagtggtcacaacttcaggcacctatgtgtccgccattgcacaggctaaggccagtcaggagggcccccttcctgagatcgaagacgaggtttttcggaaacgcaacctgacaattatggatttgcatccggggtctggaaagaccagaaggtacctaccagcgatcgtgcgggaagccataaaacgaaagctgagaactctcattttagcacccacccgcgtcgtggctagcgagatggccgaagctctgaagggtatgcctatcaggtatcaaacaacggcagtaaaatccgagcacactggcaaggagatcgtggaccttatgtgccatgccaccttcacaatgcgtctgctctcaccagttcgggtccccaattacaacatgattatcatggatgaagcccactttaccgacccttctagcatagctgcgagagggtatattagtactagggtgggaatgggcgaggcagccgctatcttcatgacagccaccccgcccggttccgtggaagcatttccacagagcaatgccgtcattcaggatgaggaacgcgacatccctgagcgatcttggaactcagggtacgagtggataacggatttccccggaaaaactgtatggtttgtgccatccattaagagtggcaatgacatcgctaactgtttgaggaaaaatggcaagcgggttatccagctgagcaggaagacattcgataccgaatatcagaaaaccaagaacaacgactgggactacgtggtcactacagatatttcggagatgggggcgaatttccgcgccgaccgtgtgatcgatcctagacggtgcctcaaacccgttattctgaaggacggaccagaaagggtgatacttgcaggtccgatgcctgtcaccgtggcttctgccgcacagcgccgaggcagaatcgggcggaaccataataaagagggagatcagtacatttatatgggccagcccctaaacaatgacgaggatcacgcccactggacagaagctaagatgctgttggacaacatcaatactccagagggtatcattcccgccttatttgaacctgagagggaaaagtccgcggcaatagatggggagtaccgcctgagaggcgaggccaggaaaacgttcgtagaactcatgcggcgtggagacctgccagtgtggcttagctataaggttgcttcagagggctttcaatacagtgatcgccgatggtgcttcgacggggaaagaaacaatcaggtcctggaggaaaacatggatgtggagatctggaccaaagagggagaaaggaagaaactccggccccgctggttggacgccagaacatattctgaccctctggctctaagggagtttaaggagttcgcagccggtcggcgatccgtgagcggcgatctgattctcgagatcgggaaacttccgcagcatctgactcagagagctcaaaatgccttagacaacttggtcatgctgcacaattcagaacagggaggccgcgcatacaggcatgcgatggaggagctcccagataccattgaaacactgatgcttctggccctcatcgctgttttgaccggtggggtgactctgtttttcttaagtggccggggactaggcaagacgagcatagggctgctctgtgtaatggcctcctctgtgcttctgtggatggcaagcgtcgagccccactggatcgctgcctccattatcttggaatttttcctgatggtgctcctgattcctgagcccgaccgtcagagaaccccacaggataaccaacttgcatatgttgtgatcggactcctgtttatgatattgacagtcgccgctaatgagatgggtctgttagaaactaccaagaaagacctaggcattgggcacgtagcggtggagaaccatcaccatgccgcaatgctggatgttgacctccaccctgcttcagcctggacactttacgccgtggcaaccactatcattacacccatgatgaggcatacgatcgaaaacaccactgctaatatatctctgacagccatcgcgaaccaggctgccattttgatgggactggataagggctggccaatcagtaaaatggacattggtgtccctctcctggcacttgggtgctacagccaggtgaatccgttaaccctgaccgccgctgtcctcatgttggtggcacactatgccatcataggccccggactgcaagcgaaggctacacgcgaggcccagaaacggactgcagccggcattatgaagaacccaacggttgatgggatcgtggctatcgacctagatcctgtagtgtacgacgccaagttcgaaaaacagctgggacagattatgctccttatcctgtgtaccagccaaatattgctgatgcgaacaacttgggcactctgcgagtccattaccctggctacaggccccttaaccactctttgggagggttctccagggaagttttggaatacgacaatcgccgtctcaatggcgaacattttcagaggaagctatctggccggcgcaggtctcgctttctccctaatgaaaagtctgggcgggggaaggcgcggcaccggggcccagggagaaactttgggcgagaagtggaaacggcagctgaatcagctctctaagagcgaatttaacacctacaagagatcaggtatcatggaggttgaccgttccgaagcaaaagaggggcttaagaggggagagacaactaaacacgctgtgagtcggggcaccgccaagctgcgctggttcgtcgaacgaaatttggtgaaacctgagggtaaggtaatagatctgggctgtgggagaggaggctggagctattactgcgccgggctcaagaaagtgacagaagttaagggatatacgaaaggcggtcccgggcatgaggaaccgatcccaatggcgacctacggatggaacttagtgaagctgcactctggcaaagacgtctttttcattcctcccgagaagtgtgatactcttctgtgcgacatcggcgagtcctcaccaaatcccacaattgaagaggggaggaccctacgggtgctcaaaatggtcgaaccttggctgcgcggaaaccaattttgtatcaagattttgaatccgtacatgcccagcgtggttgagactctggagcagatgcagagaaagcatggtggcatgctcgtaaggaacccactttcgcgaaattctacacacgaaatgtattgggtgagttgcgggaccggaaacatcgtctccgctgtgaatatgacgagccggatgctgttaaaccgtttcaccatggcacacagaaaacctacatacgagcgcgatgttgacctgggcgccggtactaggcatgtggctgtcgaacccgaggtggccaacttggatataattgggcagcggatcgaaaatatcaagcacgagcataaatcaacctggcactatgacgaggataacccttacaagacatgggcatatcatggatcctacgaagtaaaaccatctggcagcgccagttccatggtgaatggcgttgtcaagctcctgactaagccctgggacgtgattcctatggtgacccaaatagctatgacagataccactccatttgggcagcagagagtcttcaaagagaaggttgacacgcgcacacccaaagcgaagaggggaaccgcccaaatcatggaagtgactgcaaaatggctatggggttttcttagccgaaacaagaagccgcggatttgtaccagagaggagttcacaaggaaagtacgctctaatgctgccatcggcgcagtgtttgtcgacgagaaccagtggaactcagccaaggaggctgtggaagatgagcgtttctgggacctggttcaccgggaaagagagctccacaaacaggggaagtgcgccacgtgcgtgtataacatgatgggaaaaagggaaaagaagctgggcgagtttggtaaagcgaaggggagtcgcgcaatttggtacatgtggttgggagcccgattcctggagttcgaagctctcggctttatgaatgaggatcattggttctcccgggaaaacagcctttctggcgtcgagggggagggactgcacaaattaggttacatcctgagagacatatcgaagatccctggcgggaatatgtatgccgatgacaccgcaggatgggatactaggattacagaagacgatttgcagaacgaggctcgcatcaccgacattatggaaccagagcatgccctcctggctaaatcaatctttaagctaacttaccaaaataaagtggtaagagttcagcggcccgccaagaacggcacagtgatggatgtcataagcaggcgtgaccagcgaggttccggacaggtgggaacctatggccttaatacattcactaacatggaagcacaactgattcgccagatggagagtgagggcatcttttctcctagcgaactcgagaccccaaacctggcggaaagagtgttggattggttaaagaaatacggggtcgagcggctgaagaggatggccatctccggagacgactgtgttgtgaaacccattgatgaccgcttcgctacggccctcaccgcacttaatgatatgggtaaggtaagaaaagacataccgcagtgggaaccttcaaagggctggaacgattggcagcaagtgcccttttgcagtcaccacttccatcagctgatcatgaaggacgggcgggagattgtcgtgccatgtaggaatcaggatgagctagttggacgagctcgtgtgtctcagggcgccggttggagcctgagagaaacagcatgcctcgggaaatcctatgcccaaatgtggcagttgatgtactttcaccgccgggacctgaggcttgcggctaacgccatctgttcagcagtccctgtggattggattcccactagcagaaccacatggtctatccatgcccaccatcagtggatgactaccgaggacatgctgtccgtatggaatcgcgtttggatagaagagaacccatggatggaagataagacgcacatcagtagctggggagacgtgccctatctcggcaaacgggaggaccaatggtgcggctcgttaattgggctgacagctagggccacctgggcaactaatatccaggtcgctattaaccaggtgcgaagattgatcggaaatgagaactacctggattacatgacatccatgaagcggttcaaaaatgaaggtgaccctgagggcgccctctggtga

SEQ ID NO: 13570 - RNA, 9879 nt, synthetic construct
  misc_feature 1..9879: note = derived and/or modified CDS sequence (opt3) from DENV-1__EU677166__SS-prME
  source 1..9879: mol_type = other RNA
agcgtgaccatgctgctcatgcttatgcccacggccctggctttccacttgactacgagaggaggggaacctcatatgatcgtctccaagcaggaaagaggaaaatctttactgtttaagacctcagccggtgttaatatgtgcacactaattgccatggacctcggcgaactgtgtgaagatactatgacctacaaatgcccacggattacagagaccgaaccggacgatgtggactgttggtgcaatgcgactgatacatgggtgacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccgggagcttcaaactggagaaggaagtcgccgagacgcagcacggtacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattgtgatcggtgccggggaaaaagctctgaagctctcctggttcaagaaaggctcaagtatcggaaagatgtttgaggccaccgcaagaggcgccaggcggatggctattctgggggatacagcctgggacttcggaagcatcggtggcgtttttacgtccgtggggaaacttgtccatcagattttcggaaccgcatacggcgtgctgttttctggtgtaagctggactatgaagatagggatcggcgtgttgctcacatggctgggattaaattcacgaagtacctccctgagcatgacatgtattgcggttggcctagtcactctctacctgggggtgatggtgcaggctgattctggatgcgtcatcaactggaaaggccgcgaacttaagtgtggttcagggatcttcgttaccaatgaggtgcacacgtggacagaacaatataagtttcaggccgacagtccgaaaagattgagcgcagccattggaaaggcttgggaggagggcgtgtgcggtataaggtccgccacccggctggaaaacatcatgtggaaacagatttctaacgagctcaatcatatcctgttagaaaacgacatgaagttcactgtagtcgtgggcgatgttgcagggattctggctcagggcaaaaagatgatccgccctcaacccatggagtacaaatattcgtggaaaagctggggcaaggccaagataatcggggcggacgtgcagaataccacatttattatcgatggaccaaacactcctgaatgtcccgacgatcagagagcctggaatatttgggaggtcgaggactacggcttcggtatctttaccacaaacatatggcttaagttgagggattcctatacacaggtgtgcgaccaccgtctcatgtcagctgcaattaaagatagtaaggccgttcacgctgacatggggtactggatcgaatctgagaaaaatgaaacctggaagctggcccgggcatccttcattgaggtgaagacttgtatctggccaaaatcccatacactatggtcaaacggagtactggaaagcgagatgataatccccaagatttatggcggtcctatctctcaacacaattaccgaccaggctacttcacccagactgcggggccgtggcatctcggaaaactggagcttgattttgacttgtgcgaaggcacaaccgtcgtggtggatgagcactgcgggaacagaggaccctccctgaggacgactaccgtcacaggcaagattatccacgaatggtgttgccgcagttgtaccttacctccactccggttcagaggtgaggacgggtgctggtatggaatggagataaggcccgttaaagaaaaggaggaaaatctggtaaagagcatggtatctgccggctccggtgaggtggactcatttagtcttggcctgttgtgtattagcatcatgatcgaagaggtcatgcgctcgcgatggtcccggaaaatgctcatgactgggacactggctgtgttctttctactgattatgggacagctcacctggaacgatctgatccgtctttgcattatggttggcgccaatgcatctgacagaatggggatgggaacaacttacttggctctgatggccaccttcaagatgaggcctatgtttgcagtgggcttactcttccgccggctgacgagcagagaggtccttctgctaacaataggtctctcactggtggccagtgttgaattgccaaactccctggaggaattaggggatggactcgctatgggcatcatgattctgaaacttctgaccgactttcaatctcatcagttgtgggcgactctcctgagcctaaccttcatcaagacaactttttccctgcactatgcctggaaaaccatggcaatggtgctttcaattgtcagcctcttccccctgtgtttgagtacgacatctcagaagaccacttggctgccggtattactcggctccctggggtgcaagcctcttacaatgtttctgatcgctgagaataaaatatggggaaggcgaagctggccattgaacgaaggtatcatggccgtgggcattgtttcgatcctcctgtcatctctactgaagaacgatgtgccccttgccgggcctctcattgctggaggcatgctgatcgcatgttacgtcataagtggttccagcgccgacttgtctttagagaaagcggctgaggtgagctgggaagaggaagccgagcattccggggcatcacacaatattctggtagaagtgcaggatgacggaaccatgaagatcaaagatgaggagcgcgacgatactctcacaatcctgcttaaggccaccctgttggctgtcagtggcgtttatcccctaagcattccagcaacgctgttcgtgtggtacttctggcagaaaaagaagcagcggtctggcgtgctctgggacactccttcacccccagaagtcgagagagccgtgctggatgacgggatatataggatcatgcagcgtggacttttaggtcgcagccaggttggcgtaggggtgtttcaagaaaacgtcttccataccatgtggcacgtgacacggggagcggttctgatgtaccagggcaaaagactcgagccgagttgggctagcgtgaagaaagacttgatttcctacggtgggggatggaggctgcagggctcttggaataccggcgaggaagtccaggtgatcgccgtagagcctgggaagaaccccaaaaatgtccaaacagcaccaggaacttttaagacccccgaaggtgaggtgggcgccattgctctcgatttcaagcctgggacgtcgggaagcccaatcgttaaccgagaaggcaaaatagtgggtctgtatgggaatggagtcgtgacaacttcaggcacctacgtttccgccatcgcacaggctaaggccagtcaggagggcccccttcctgagattgaagacgaggtgtttcggaaacgcaacctgacaatcatggatttgcacccggggtctggaaagaccagaaggtatctaccagcgattgtccgggaagccatcaaacgaaagctgagaactctcatattagcacccacccgcgtggtagctagcgagatggccgaagctctgaagggtatgcctattaggtaccaaacaacggcagtgaaatccgagcatactggcaaggagatcgttgaccttatgtgccacgccaccttcacaatgcgtctgctctcaccagtccgggtgcccaattataacatgatcattatggatgaagcccattttaccgacccttctagcatcgctgcgagagggtacataagtactagggtgggaatgggcgaggcagccgctattttcatgacagccaccccgcccggttccgtcgaagcatttccacagagcaatgccgtaatccaggatgaggaacgcgacattcctgagcgatcttggaactcagggtatgagtggatcacggatttccccggaaaaactgtgtggtttgttccatccataaagagtggcaatgacattgctaactgtttgaggaaaaatggcaagcgggtgatccagctgagcaggaagacattcgataccgaataccagaaaaccaagaacaacgactgggactacgtcgtgactacagatatctcggagatgggggcgaatttccgcgccgaccgtgttattgatcctagacggtgcctcaaacccgtgatcctgaaggacggaccagaaagggtcattcttgcaggtccgatgcctgtgaccgtagcttctgccgcacagcgccgaggcagaatagggcggaaccacaataaagagggagatcagtatatctacatgggccagcccctaaacaatgacgaggatcatgcccactggacagaagctaagatgctgttggacaacattaatactccagagggtatcatccccgccttatttgaacctgagagggaaaagtccgcggcaattgatggggagtatcgcctgagaggcgaggccaggaaaacgttcgtggaactcatgcggcgtggagacctgccagtttggcttagctacaaggtcgcttcagagggctttcaatatagtgatcgccgatggtgcttcgacggggaaagaaacaatcaggtgctggaggaaaacatggatgtggagatatggaccaaagagggagaaaggaagaaactccggccccgctggttggacgccagaacatactctgaccctctggctctaagggagtttaaggagttcgcagccggtcggcgatccgtcagcggcgatctgatcctcgagattgggaaacttccgcagcacctgactcagagagctcaaaatgccttagacaacttggttatgctgcataattcagaacagggaggccgcgcatataggcacgcgatggaggagctcccagataccatcgaaacactgatgcttctggccctcattgctgtgttgaccggtggggtaactctgtttttcttaagtggccggggactaggcaagacgagcatcgggctgctctgtgtgatggcctcctctgtccttctgtggatggcaagcgtggagccccattggatagctgcctccatcattttggaatttttcctgatggttctcctgatccctgagcccgaccgtcagagaaccccacaggataaccaacttgcatacgtggtcattggactcctgtttatgatcttgacagtagccgctaatgagatgggtctgttagaaactaccaagaaagacctaggcatagggcacgtggcggttgagaaccaccatcacgccgcaatgctggatgtggacctccatcctgcttcagcctggacactttacgccgtcgcaaccactattatcacacccatgatgaggcacacgattgaaaacaccactgctaatatctctctgacagccatagcgaaccaggctgccatcttgatgggactggataagggctggccaattagtaaaatggacatcggtgtgcctctcctggcacttgggtgctattcgcaggtcaatccgttaaccctgaccgccgctgtgctcatgttggttgcacattacgccattatcggccccggactgcaagcgaaggctacacgcgaggcccagaaacggactgcagccggcataatgaagaacccaacggtggatgggattgtagctatcgacctagatcctgtggtctatgacgccaagttcgaaaaacagctgggacagatcatgctccttattctgtgtaccagccaaatcttgctgatgcgaacaacttgggcactctgcgagtccataaccctggctacaggccccttaaccactctttgggagggttctccagggaagttttggaatacgacaattgccgtttcaatggcgaacatcttcagaggaagctacctggccggcgcaggtctcgctttctccctaatgaaaagtctgggcgggggaaggcgcggcaccggggcccagggagaaactttgggcgagaagtggaaacggcagctgaatcagctctctaagagcgaatttaacacctataagagatcaggtattatggaggtggaccgttccgaagcaaaagaggggcttaagaggggagagacaactaaacacgctgtcagtcggggcaccgccaagctgcgctggttcgtggaacgaaatttggtaaaacctgagggtaaggtgatcgatctgggctgtgggagaggaggctggagctactattgcgccgggctcaagaaagttacagaagtgaagggatacacgaaaggcggtcccgggcacgaggaaccgataccaatggcgacctacggatggaacttagtcaagctgcattctggcaaagacgtgtttttcatccctcccgagaagtgtgatactcttctgtgcgacattggcgagtcctcaccaaatcccacaatcgaagaggggaggaccctacgggtcctcaaaatggtggaaccttggctgcgcggaaaccaattttgtattaagatcttgaatccgtatatgcccagcgttgtagagactctggagcagatgcagagaaagcacggtggcatgctcgtgaggaacccactttcgcgaaattctacacatgaaatgtactgggtcagttgcgggaccggaaacattgtgtccgctgttaatatgacgagccggatgctgttaaaccgtttcaccatggcacacagaaaacctacatatgagcgcgatgtggacctgggcgccggtactaggcacgtcgctgtggaacccgaggtagccaacttggatatcatagggcagcggattgaaaatatcaagcatgagcacaaatcaacctggcattacgacgaggataacccttataagacatgggcataccacggatcctatgaagtgaaaccatctggcagcgccagttccatggttaatggcgtcgtgaagctcctgactaagccctgggacgtgatccctatggtcacccaaattgctatgacagataccactccatttgggcagcagagagttttcaaagagaaggtggacacgcgcacacccaaagcgaagaggggaaccgcccaaataatggaagtaactgcaaaatggctatggggttttcttagccgaaacaagaagccgcggatctgtaccagagaggagttcacaaggaaagtgcgctctaatgctgccattggcgcagtctttgtggacgagaaccagtggaactcagccaaggaggctgttgaagatgagcgtttctgggacctggtgcatcgggaaagagagctccacaaacaggggaagtgcgccacgtgcgtctacaacatgatgggaaaaagggaaaagaagctgggcgagtttggtaaagcgaaggggagtcgcgcaatctggtacatgtggttgggagcccgattcctggagttcgaagctctcggctttatgaatgaggatcactggttctcccgggaaaacagcctttctggcgtggagggggagggactgcataaattaggttatattctgagagacatctcgaagatacctggcgggaatatgtacgccgatgacaccgcaggatgggatactaggatcacagaagacgatttgcagaacgaggctcgcattaccgacatcatggaaccagagcacgccctcctggctagatcaatttttaaactaacttatcaaaataaggtagttcgggtgcagaggcccgccaaaaacggcacagtcatggatgtgatcagccgtcgagaccagcgcggttccggacaggtgggaacctacggccttaatacattcactaacatggaagcacaactgataagacagatggagagtgagggcatattttctcctagcgaactcgagaccccaaacctggcggaacgggtcttggattggttagagaagtatggggttgaaaggctgaagcgcatggccatctccggagacgactgtgtggtaaaacccatcgatgacagattcgctacggccctcaccgcacttaatgatatgggtaaggtgcggaaagacattccgcagtgggagccttcaaagggctggaacgattggcagcaagtccccttttgcagtcatcacttccaccagctgataatgaaagacgggagggagatcgtggttccatgtcgaaatcaggatgagctagtgggacgtgctagagtctctcagggcgccggttggagcctgcgcgagacagcatgcctcgggaagtcctacgcccaaatgtggcagttgatgtattttcatcggagggacctgagacttgcggctaacgccatttgttcagcagtgcctgtaaattggatccccactagccgcaccacatggtctattcacgcccatcaccagtggatgactaccgaagatatgctgtccgtttggaaccgggtgtggatcgaggaaaatccatggatggaggacaagacgcatataagtagctggggagatgtcccctacctcggcaaaagggaggaccaatggtgcggctcgttaatcgggctgacagctcgagccacctgggcaactaacattcaggtggctatcaatcaggttagacggttgattggaaacgaaaattacctggactatatgacatccatgaagaggttcaaaaacgagtctgatcctgaaggtgccctctggtga

SEQ ID NO: 13571 - RNA, 9879 nt, synthetic construct
  misc_feature 1..9879: note = derived and/or modified CDS sequence (opt3) from DENV-1__EU677170__SS-prME
  source 1..9879: mol_type = other RNA
agcgtgaccatgctgctcatgcttatgcccacggccctggctttccacttgactacgagaggaggggaacctcatatgatcgtctccaagcaggaaagaggaaaatctttactgtttaagacctcagccggtgttaatatgtgcacactaattgccatggacctcggcgaactgtgtgaagatactatgacctacaaatgcccacggattacagagaccgaaccggacgatgtggactgttggtgcaatgcgactgatacatgggtgacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccgggagcttcaaactggagaaggaagtcgccgagacgcagcacggtacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattgtgatcggtgccggggaaaaagctctgaagctctcctggttcaagaaaggctcaagtatcggaaagatgtttgaggccaccgcaagaggcgccaggcggatggctattctgggggatacagcctgggacttcggaagcatcggtggcgtttttacgtccgtggggaaacttgtccatcagattttcggaaccgcatacggcgtgctgttttctggtgtaagctggactatgaagatagggatcggcgtgttgctcacatggctgggattaaattcacgaagtacctccctgagcatgacatgtattgcggttggcctagtcactctctacctgggggtgatggtgcaggctgattctggatgcgtcatcaactggaaaggccgcgaacttaagtgtggttcagggatcttcgttaccaatgaggtgcacacgtggacagaacaatataagtttcaggccgacagtccgaaaagattgagcgcagccattggaaaggcttgggaggagggcgtgtgcggtataaggtccgccacccggctggaaaacatcatgtggaaacagatttctaacgagctcaatcatatcctgttagaaaacgacatgaagttcactgtagtcgtgggcgatgttgcagggattctggctcagggcaagaagatgatccgccctcaacccatggagtacaaatattcgtggaaaagctggggcaaggccaagataatcggggcggacgtgcagaataccacatttattatcgatggaccaaacactcctgaatgtcccgacgatcagagagcctggaatatttgggaggtcgaggactacggcttcggtatctttaccacaaacatatggatgaaacttagggattcctatacacaggtgtgcgaccaccgtttgatgtcagctgcaattaaagatagtaaggccgttcacgctgacatggggtactggatcgaatctgagaaaaatgaaacctggaagctcgcccgggcatccttcattgaggtgaagacttgtatctggccaaaatcccatacactgtggtcaaacggagtactagaaagcgagatgataatccccaagatttatggcggtcctatctctcaacacaattaccgaccaggctacttcacccagactgcggggccgtggcatctgggaaaactcgagctggattttgacctttgcgaaggcacaaccgtcgtggtggatgagcactgcgggaacagaggaccctccttgaggacgactaccgtcacaggcaagattatccacgaatggtgttgccgcagttgtaccctgcctccattacggttcagaggtgaggacgggtgctggtatggaatggagataaggcccgttaaagaaaaggaggaaaatctcgtaaagagcatggtatctgccggctccggtgaggtggactcatttagtctgggccttctgtgtattagcatcatgatcgaagaggtcatgcgctcgcgatggtcccggaaaatgttgatgactgggacactcgctgtgttctttctgctaattatgggacagctgacctggaacgatctcatccgtctgtgcattatggttggcgccaatgcatctgacagaatggggatgggaacaacttaccttgctttgatggccaccttcaagatgaggcctatgtttgcagtgggcctgttattccgccggctcacgagcagagaggtcctgcttctgacaataggtctatcactcgtggccagtgttgaactgccaaactccttggaggaactgggggatggattagctatgggcatcatgattctcaaactgcttaccgactttcaatctcatcagctgtgggcgactttgctcagcctgaccttcatcaagacaactttttccctacactatgcctggaaaaccatggcaatggtgctgtcaattgtcagccttttccccctctgtctgagtacgacatctcagaagaccacttggttgccggtactgttaggctccctcgggtgcaagcctctgacaatgtttcttatcgctgagaataaaatatggggaaggcgaagctggccactgaacgaaggtatcatggccgtgggcattgtttcgatcttgctctcatctctgctaaagaacgatgtgcccctggccgggcctcttattgctggaggcatgctcatcgcatgttacgtcataagtggttccagcgccgacctgtctttggagaaagcggctgaggtgagctgggaagaggaagccgagcattccggggcatcacacaatattttagtagaagtgcaggatgacggaaccatgaagatcaaagatgaggagcgcgacgatactctgacaatcctcctgaaggccacccttctggctgtcagtggcgtttatcccttgagcattccagcaacgctattcgtgtggtacttctggcagaagaagaagcagcggtctggcgtgctgtgggacactccttcacccccagaagtcgagagagccgtgctcgatgacgggatatataggatcatgcagcgtggactgcttggtcgcagccaggttggcgtaggggtgtttcaagaaaacgtcttccataccatgtggcacgtgacacggggagcggttttaatgtaccagggcaaaagactggagccgagttgggctagcgtgaagaaagacctcatttcctacggtgggggatggaggttgcagggctcttggaataccggcgaggaagtccaggtgatcgccgtagagcctgggaagaaccccaaaaatgtccaaacagcaccaggaacttttaagacccccgaaggtgaggtgggcgccattgctctggatttcaagcctgggacgtcgggaagcccaatcgttaaccgagaaggcaaaatagtgggtctctatgggaatggagtcgtgacaacttcaggcacctacgtttccgccatcgcacaggctaaggccagtcaggagggccccctgcctgagattgaagacgaggtgtttcggaaacgcaaccttacaatcatggatctgcacccggggtctggaaagaccagaaggtatttgccagcgattgtccgggaagccatcaaacgaaagctaagaactctgatactcgcacccacccgcgtggtagctagcgagatggccgaggctttaaagggtatgcctattaggtaccaaacaacggcagtgaaatccgagcatactggcaaggagatcgttgacctgatgtgccacgccaccttcacaatgcgtcttctgtcaccagtccgggtgcccaattataacatgatcattatggatgaagcccattttaccgacccttctagcatcgctgcgagagggtacataagtactagggtgggaatgggcgaggcagccgctattttcatgacagccaccccgcccggttccgtcgaagcatttccacagagcaatgccgtaatccaggatgaggaacgcgacattcctgagcgatcttggaactcagggtatgagtggatcacggatttccccggaaaaactgtgtggtttgttccatccataaagagtggcaatgacattgctaactgtctcaggaaaaatggcaagcgggtgatccagttgagcaggaagacattcgataccgaataccagaaaaccaagaacaacgactgggactacgtcgtgactacagatatctcggagatgggggcgaatttccgcgccgaccgtgttattgatcctagacggtgcctgaaacccgtgatcctcaaggacggaccagaaagggtcattctggcaggtccgatgcctgtgaccgtagcttctgccgcacagcgccgaggcagaatagggcggaaccacaataaagagggagatcagtatatctacatgggccagccccttaacaatgacgaggatcatgcccactggacagaagctaagatgctactggacaacattaatactccagagggtatcatccccgccttgtttgaacctgagagggaaaagtccgcggcaattgatggggagtatcgcttaagaggcgaggccaggaaaacgttcgtggaactgatgcggcgtggagacctcccagtttggctgagctacaaggtcgcttcagagggctttcaatatagtgatcgccgatggtgcttcgacggggaaagaaacaatcaggtgcttgaggaaaacatggatgtggagatatggaccaaagagggagaaaggaagaaactgcggccccgctggctcgacgccagaacatactctgaccctttggctctgagggagtttaaggagttcgcagccggtcggcgatccgtcagcggcgatctaatcctggagattgggaaactcccgcagcaccttactcagagagctcaaaatgccctggacaacttagttatgttgcataattcagaacagggaggccgcgcatataggcacgcgatggaggagctgccagataccatcgaaacactcatgctgcttgccctgattgctgtgctcaccggtggggtaactttgtttttcctgagtggccggggattaggcaagacgagcatcgggctactgtgtgtgatggcctcctctgtcctcctttggatggcaagcgtggagccccattggatagctgcctccatcattctggaatttttcttgatggttctgctcatccctgagcccgaccgtcagagaaccccacaggataaccaactggcatacgtggtcattggacttctctttatgatcctgacagtagccgctaatgagatgggtttgctggaaactaccaagaaagacttaggcatagggcacgtggcggttgagaaccaccatcacgccgcaatgctagatgtggacctgcatcctgcttcagcctggacactctacgccgtcgcaaccactattatcacacccatgatgaggcacacgattgaaaacaccactgctaatatctctcttacagccatagcgaaccaggctgccatcctgatgggattggataagggctggccaattagtaaaatggacatcggtgtgcctctgctcgcactggggtgctattcgcaggtcaatccgcttaccttaaccgccgctgtgctgatgctcgttgcacattacgccattatcggccccggattgcaagcgaaggctacacgcgaggcccagaaacggactgcagccggcataatgaagaacccaacggtggatgggattgtagctatcgacctggatcctgtggtctatgacgccaagttcgaaaaacagctaggacagatcatgctgctcattctttgtaccagccaaatcctgttgatgcgaacaacttgggcactgtgcgagtccataaccctcgctacaggccccctgaccactttatgggagggttctccagggaagttttggaatacgacaattgccgtttcaatggcgaacatcttcagaggaagctaccttgccggcgcaggtctggctttctccctcatgaaaagtctaggcgggggaaggcgcggcaccggggcccagggagaaactctgggcgagaagtggaaacggcagttgaatcagctgtctaagagcgaatttaacacctataagagatcaggtattatggaggtggaccgttccgaagcaaaagaggggctcaagaggggagagacaactaaacacgctgtcagtcggggcaccgccaaacttcgctggttcgtggaacgaaatctggtaaaacctgagggtaaggtgatcgatttgggctgtgggagaggaggctggagctactattgcgccgggctgaagaaagttacagaagtgaagggatacacgaaaggcggtcccgggcacgaggaaccgataccaatggcgacctacggatggaacctcgtcaagttacattctggcaaagacgtgtttttcatccctcccgagaagtgtgatactctgctttgcgacattggcgagtcctcaccaaatcccacaatcgaagaggggaggaccctgcgggtcctaaaaatggtggaaccttggctccgcggaaaccaattttgtattaagatcctgaatccgtatatgcccagcgttgtagagactttggagcagatgcagagaaagcacggtggcatgctggtgaggaacccactctcgcgaaattctacacatgaaatgtactgggtcagttgcgggaccggaaacattgtgtccgctgttaatatgacgagccggatgcttctgaaccgtttcaccatggcacacagaaaacctacatatgagcgcgatgtggacttaggcgccggtactaggcacgtcgctgtggaacccgaggtagccaacctggatatcatagggcagcggattgaaaatatcaagcatgagcacaaatcaacctggcattacgacgaggataacccttataagacatgggcataccacggatcctatgaagtgaaaccatctggcagcgccagttccatggttaatggcgtcgtgaagttgctcactaagccctgggacgtgatccctatggtcacccaaattgctatgacagataccactccatttgggcagcagagagttttcaaagagaaggtggacacgcgcacacccaaagcgaagaggggaaccgcccaaataatggaagtaactgcaaaatggctgtggggttttctaagccgaaacaagaagccgcggatctgtaccagagaggagttcacaaggaaagtgcgctctaatgctgccattggcgcagtctttgtggacgagaaccagtggaactcagccaaggaggctgttgaagatgagcgtttctgggaccttgtgcatcgggaaagagagctgcacaaacaggggaagtgcgccacgtgcgtctacaacatgatgggaaaaagggaaaagaagctcggcgagtttggtaaagcgaaggggagtcgcgcaatctggtacatgtggctgggagcccgattcttggagttcgaagctctgggctttatgaatgaggatcactggttctcccgggaaaacagcctctctggcgtggagggggagggacttcataaactgggttatattttaagagacatctcgaagatacctggcgggaatatgtacgccgatgacaccgcaggatgggatactaggatcacagaagacgatctgcagaacgaggctcgcattaccgacatcatggaaccagagcacgccttgctcgctagatcaatttttaaactgacttatcaaaataaggtagttcgggtgcagaggcccgccaaaaacggcacagtcatggatgtgatcagccgtcgagaccagcgcggttccggacaggtgggaacctacggcctaaatacattcactaacatggaagcacaacttataagacagatggagagtgagggcatattttctcctagcgaactggagaccccaatcctcgcggaacgggtcctggattggttggagaagtatggggttgaaaggttaaagcgcatggccatctccggagacgactgtgtggtaaaacccattgatgacagattcgctacggccctgaccgcactcaacgatatgggtaaggtgcggaaagacataccgcagtgggagccttcaaagggctggaatgattggcagcaagtccccttttgcagtcatcacttccaccagcttatcatgaaagacgggagggagattgtggttccatgtcgaaaccaggatgaactggtgggacgtgctagagtctctcagggcgccggttggagcctacgcgagacagcatgcctggggaagtcctacgcccaaatgtggcagctcatgtattttcatcggagggacttgagactggcggctaatgccatctgttcagcagtgcctgtagattggattcccactagccgcaccacatggtctatccacgcccatcaccagtggatgactaccgaagacatgctttccgtttggaaccgggtgtggatagaggaaaatccatggatggaggataagacgcatatcagtagctggggagacgtcccctacctgggcaaaagggaggaccaatggtgcggctcgctcattgggttaacagctcgagccacctgggcaactaacatccaggtggctattaatcaggttagacggctgatcggaaacgaaaattacttggattatatgacatccatgaagaggttcaaaaacgagtctgaccctgaaggtgccctgtggtga

SEQ ID NO: 13572 - RNA, 9879 nt, synthetic construct
  misc_feature 1..9879: note = derived and/or modified CDS sequence (opt3) from DENV-1__EU677171__SS-prME
  source 1..9879: mol_type = other RNA
agcgtgaccatgctgctcatgcttatgcccacggccctggctttccacttgactacgagaggaggggaacctcatatgatcgtctccaagcaggaaagaggaaaatctttactgtttaagacctcagccggtgttaatatgtgcacactaattgccatggacctcggcgaactgtgtgaagatactatgacctacaaatgcccacggattacagagaccgaaccggacgatgtggactgttggtgcaatgcgactgatacatgggtgacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccgggagcttcaaactggagaaggaagtcgccgagacgcagcacggtacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattgtgatcggtgccggggaaaaagctctgaagctctcctggttcaagaaaggctcaagtatcggaaagatgtttgaggccaccgcaagaggcgccaggcggatggctattctgggggatacagcctgggacttcggaagcatcggtggcgtttttacgtccgtggggaaacttgtccatcagattttcggaaccgcatacggcgtgctgttttctggtgtaagctggactatgaagatagggatcggcgtgttgctcacatggctgggattaaattcacgaagtacctccctgagcatgacatgtattgcggttggcctagtcactctctacctgggggtgatggtgcaggctgattctggatgcgtcatcaactggaaaggccgcgaacttaagtgtggttcagggatcttcgttaccaatgaggtgcacacgtggacagaacaatataagtttcaggccgacagtccgaaaagattgagcgcagccattggaaaggcttgggaggagggcgtgtgcggtataaggtccgccacccggctggaaaacatcatgtggaaacagatttctaacgagctcaatcatatcctgttagaaaacgacatgaagttcactgtagtcgtgggcgatgttgcagggattctggctcagggcaaaaagatgatccgccctcaacccatggagtacaaatattcgtggaaaagctggggcaaggccaagataatcggggcggacgtgcagaataccacatttattatcgatggaccaaacactcctgaatgtcccgacgatcagagagcctggaatatttgggaggtcgaggactacggcttcggtatctttaccacaaacatatggcttaagttgagggattcctatacacaggtgtgcgaccaccgtctcatgtcagctgcaattaaagatagtaaggccgttcacgctgacatggggtactggatcgaatctgagaaaaatgaaacctggaagctggcccgggcatccttcattgaggtgaagacttgtatctggccaaaatcccatacactatggtcaaacggagtactggaaagcgagatgataatccccaagatttatggcggtcctatctctcaacacaattaccgaccaggctacttcacccagactgcggggccgtggcatctcggaaaactggagcttgattttgacttgtgcgaaggcacaaccgtcgtggtggatgagcactgcgggaacagaggaccctccctgaggacgactaccgtcacaggcaagattatccacgaatggtgttgccgcagttgtaccttacctccactccggttcagaggtgaggacgggtgctggtatggaatggagataaggcccgttaaagaaaaggaggaaaatctggtaaagagcatggtatctgccggctccggtgaggtggactcatttagtcttggcctgttgtgtattagcatcatgatcgaagaggtcatgcgctcgcgatggtcccggaaaatgctcatgactgggacactggctgtgttctttctactgattatgggacagctcacctggaacgatctgatccgtctttgcattatggttggcgccaatgcatctgacagaatggggatgggaacaacttacttggctctgatggccaccttcaagatgaggcctatgtttgcagtgggcttactcttccgccggctgacgagcagagaggtccttctgctaacaataggtctctcactggtggccagtgttgaattgccaaactccctggaggaattaggggatggactcgctatgggcatcatgattctgaaacttctgaccgactttcaatctcatcagttgtgggcgactctcctgagcctaaccttcatcaagacaactttttccctgcactatgcctggaaaaccatggcaatggtgctttcaattgtcagcctcttccccctgtgtttgagtacgacatctcagaagaccacttggctgccggtattactcggctccctggggtgcaagcctcttacaatgtttctgatcgctgagaataaaatatggggaaggcgaagctggccattgaacgaaggtatcatggccgtgggcattgtttcgatcctcctgtcatctctactgaagaacgatgtgccccttgccgggcctctcattgctggaggcatgctgatcgcatgttacgtcataagtggttccagcgccgacttgtctttagagaaagcggctgaggtgagctgggaagaggaagccgagcattccggggcatcacacaatattctggtagaagtgcaggatgacggaaccatgaagatcaaagatgaggagcgcgacgatactctcacaatcctgcttaaggccaccctgttggctgtcagtggcgtttatcccctaagcattccagcaacgctgttcgtgtggtacttctggcagaaaaagaagcagcggtctggcgtgctctgggacactccttcacccccagaagtcgagagagccgtgctggatgacgggatatataggatcatgcagcgtggacttttaggtcgcagccaggttggcgtaggggtgtttcaagaaaacgtcttccataccatgtggcacgtgacacggggagcggttctgatgtaccagggcaaaagactcgagccgagttgggctagcgtgaagaaagacttgatttcctacggtgggggatggaggctgcagggctcttggaataccggcgaggaagtccaggtgatcgccgtagagcctgggaagaaccccaaaaatgtccaaacagcaccaggaacttttaagacccccgaaggtgaggtgggcgccattgctctcgatttcaagcctgggacgtcgggaagcccaatcgttaaccgagaaggcaaaatagtgggtctgtatgggaatggagtcgtgacaacttcaggcacctacgtttccgccatcgcacaggctaaggccagtcaggagggcccccttcctgagattgaagacgaggtgtttcggaaacgcaacctgacaatcatggatttgcacccggggtctggaaagaccagaaggtatctaccagcgattgtccgggaagccatcaaacgaaagctgagaactctcatattagcacccacccgcgtggtagctagcgagatggccgaagctctgaagggtatgcctattaggtaccaaacaacggcagtgaaatccgagcatactggcaaggagatcgttgaccttatgtgccacgccaccttcacaatgcgtctgctctcaccagtccgggtgcccaattataacatgatcattatggatgaagcccattttaccgacccttctagcatcgctgcgagagggtacataagtactagggtgggaatgggcgaggcagccgctattttcatgacagccaccccgcccggttccgtcgaagcatttccacagagcaatgccgtaatccaggatgaggaacgcgacattcctgagcgatcttggaactcagggtatgagtggatcacggatttccccggaaaaactgtgtggtttgttccatccataaagagtggcaatgacattgctaactgtttgaggaaaaatggcaagcgggtgatccagctgagcaggaagacattcgataccgaataccagaaaaccaagaacaacgactgggactacgtcgtgactacagatatctcggagatgggggcgaatttccgcgccgaccgtgttattgatcctagacggtgcctcaaacccgtgatcctgaaggacggaccagaaagggtcattcttgcaggtccgatgcctgtgaccgtagcttctgccgcacagcgccgaggcagaatagggcggaaccacaataaagagggagatcagtatatctacatgggccagcccctaaacaatgacgaggatcatgcccactggacagaagctaagatgctgttggacaacattaatactccagagggtatcatccccgccttatttgaacctgagagggaaaagtccgcggcaattgatggggagtatcgcctgagaggcgaggccaggaaaacgttcgtggaactcatgcggcgtggagacctgccagtttggcttagctacaaggtcgcttcagagggctttcaatatagtgatcgccgatggtgcttcgacggggaaagaaacaatcaggtgctggaggaaaacatggatgtggagatatggaccaaagagggagaaaggaagaaactccggccccgctggttggacgccagaacatactctgaccctctggctctaagggagtttaaggagttcgcagccggtcggcgatccgtcagcggcgatctgatcctcgagattgggaaacttccgcagcacctgactcagagagctcaaaatgccttagacaacttggttatgctgcataattcagaacagggaggccgcgcatataggcacgcgatggaggagctcccagataccatcgaaacactgatgcttctggccctcattgctgtgttgaccggtggggtaactctgtttttcttaagtggccggggactaggcaagacgagcatcgggctgctctgtgtgatggcctcctctgtccttctgtggatggcaagcgtggagccccattggatagctgcctccatcattttggaatttttcctgatggttctcctgatccctgagcccgaccgtcagagaaccccacaggataaccaacttgcatacgtggtcattggactcctgtttatgatcttgacagtagccgctaatgagatgggtctgttagaaactaccaagaaagacctaggcatagggcacgtggcggttgagaaccaccatcacgccgcaatgctggatgtggacctccatcctgcttcagcctggacactttacgccgtcgcaaccactattatcacacccatgatgaggcacacgattgaaaacaccactgctaatatctctctgacagccatagcgaaccaggctgccatcttgatgggactggataagggctggccaattagtaaaatggacatcggtgtgcctctcctggcacttgggtgctattcgcaggtcaatccgttaaccctgaccgccgctgtgctcatgttggttgcacattacgccattatcggccccggactgcaagcgaaggctacacgcgaggcccagaaacggactgcagccggcataatgaagaacccaacggtggatgggattgtagctatcgacctagatcctgtggtctatgacgccaagttcgaaaaacagctgggacagatcatgctccttattctgtgtaccagccaaatcttgctgatgcgaacaacttgggcactctgcgagtccataaccctggctacaggccccttaaccactctttgggagggttctccagggaagttttggaatacgacaattgccgtttcaatggcgaacatcttcagaggaagctacctggccggcgcaggtctcgctttctccctaatgaaaagtctgggcgggggaaggcgcggcaccggggcccagggagaaactttgggcgagaagtggaaacggcagctgaatcagctctctaagagcgaatttaacacctataagagatcaggtattatggaggtggaccgttccgaagcaaaagaggggcttaagaggggagagacaactaaacacgctgtcagtcggggcaccgccaagctgcgctggttcgtggaacgaaatttggtaaaacctgagggtaaggtgatcgatctgggctgtgggagaggaggctggagctactattgcgccgggctcaagaaagttacagaagtgaagggatacacgaaaggcggtcccgggcacgaggaaccgataccaatggcgacctacggatggaacttagtcaagctgcattctggcaaagacgtgtttttcatccctcccgagaagtgtgatactcttctgtgcgacattggcgagtcctcaccaaatcccacaatcgaagaggggaggaccctacgggtcctcaaaatggtggaaccttggctgcgcggaaaccaattttgtattaagatcttgaatccgtatatgcccagcgttgtagagactctggagcagatgcagagaaagcacggtggcatgctcgtgaggaacccactttcgcgaaattctacacatgaaatgtactgggtcagttgcgggaccggaaacattgtgtccgctgttaatatgacgagccggatgctgttaaaccgtttcaccatggcacacagaaaacctacatatgagcgcgatgtggacctgggcgccggtactaggcacgtcgctgtggaacccgaggtagccaacttggatatcatagggcagcggattgaaaatatcaagcatgagcacaaatcaacctggcattacgacgaggataacccttataagacatgggcataccacggatcctatgaagtgaaaccatctggcagcgccagttccatggttaatggcgtcgtgaagctcctgactaagccctgggacgtgatccctatggtcacccaaattgctatgacagataccactccatttgggcagcagagagttttcaaagagaaggtggacacgcgcacacccaaagcgaagaggggaaccgcccaaataatggaagtaactgcaaaatggctatggggttttcttagccgaaacaagaagccgcggatctgtaccagagaggagttcacaaggaaagtgcgctctaatgctgccattggcgcagtctttgtggacgagaaccagtggaactcagccaaggaggctgttgaagatgagcgtttctgggacctggtgcatcgggaaagagagctccacaaacaggggaagtgcgccacgtgcgtctacaacatgatgggaaaaagggaaaagaagctgggcgagtttggtaaagcgaaggggagtcgcgcaatctggtacatgtggttgggagcccgattcctggagttcgaagctctcggctttatgaatgaggatcactggttctcccgggaaaacagcctttctggcgtggagggggagggactgcataaattaggttatattctgagagacatctcgaagatacctggcgggaatatgtacgccgatgacaccgcaggatgggatactaggatcacagaagacgatttgcagaacgaggctcgcattaccgacatcatggaaccagagcacgccctcctggctagatcaatttttaaactaacttatcaaaataaggtagttcgggtgcagaggcccgccaaaaacggcacagtcatggatgtgatcagccgtcgagaccagcgcggttccggacaggtgggaacctacggccttaatacattcactaacatggaagcacaactgataagacagatggagagtgagggcatattttctcctagcgaactcgagaccccaaacctggcggaacgggtcttggattggttagagaagtatggggttgaaaggctgaagcgcatggccatctccggagacgactgtgtggtaaaacccatcgatgacagattcgctacggccctcaccgcacttaatgatatgggtaaggtgcggaaagacattccgcagtgggagccttcaaagggctggaacgattggcagcaagtccccttttgcagtcatcacttccaccagctgataatgaaagacgggagggagatcgtggttccatgtcgaaatcaggatgagctagtgggacgtgctagagtctctcagggcgccggttggagcctgcgcgagacagcatgcctcgggaagtcctacgcccaaatgtggcagttgatgtattttcatcggagggacctgagacttgcggctaacgccatttgttcagcagtgcctgtagattggatccccactagccgcaccacatggtctattcacgcccatcaccagtggatgactaccgaagacatgctgtccgtttggaatcgggtgtggatcgaggaaaacccatggatggaggataagacgcatataagtagctggggagacgtcccctacctcggcaaaagggaggaccaatggtgcggctcgttaatcgggctgacagctcgagccacctgggcaactaatattcaggtggctatcaaccaggttagacggttgattggaaatgaaaactacctggattatatgacatccatgaagaggttcaaaaatgagtctgaccctgaaggtgccctctggtga

SEQ ID NO: 13573 - RNA, 9879 nt, synthetic construct
  misc_feature 1..9879: note = derived and/or modified CDS sequence (opt3) from DENV-1__EU677172__SS-prME
  source 1..9879: mol_type = other RNA
tccgtgaccatgctgctcatgcttatgcccacggccctggctttccacttgactacgagaggaggggaacctcatatgatcgtctccaagcaggaaagaggaaaatctttactgtttaagacctcagccggtgttaatatgtgcacactgattgccatggacctcggcgagctgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccggtagcttcaaactggagaaggaacttgccgagacgcagcacggaacagtcttggtgcagataaagtacgagggcaccgacgctccttgcaaaatcccattctcgactcaagatgaaaagggggttacacagaacggacgcctgattaccgcgaatcccatcgtgactgacaaagagaagcctgtaaacatagaagcagagccaccctttggcgagtcttatattgtcatcggtgccggggaaaaagctctcaagctgtcctggttcaagaaaggctcaagtatcggaaagatgtttgaggccaccgcaagaggcgccaggcggatggctattcttggggatacagcctgggacttcggaagcatcggtggcgtgtttacgtccgttgggaaactggtgcatcagattttcggaaccgcatacggcgtcttgttttctggtgtgagctggactatgaagatagggatcggcgtactcctgacatggttaggactaaattcacgaagtacctccctaagcatgacatgtattgcggtgggcctcgttactctgtaccttggggtcatggtgcaggctgattctggatgcgtgatcaactggaaaggccgcgaattgaagtgtggttcagggatcttcgtcaccaatgaggttcacacgtggacagaacaatataagtttcaggccgacagtccgaaaagactgagcgcagccattggaaaggcttgggaggagggcgtgtgcggtataaggtccgccacccggctcgaaaacatcatgtggaaacagatttctaacgagctgaatcatatcttactggaaaacgacatgaagttcactgtggtagtcggcgatgtggcagggattcttgctcagggcaagaagatgatccgccctcaacccatggagtacaaatattcgtggaaaagctggggcaaggccaagataatcggggcggacgcccagaataccacatttattatcgatggaccaaacactcctgaatgtcccgacgatcagagagcttggaatatttgggaggttgaggactacggcttcggtatctttaccacaaacatatggttgaagctcagggattcctatacacaggtgtgcgaccaccgtctgatgtcagcagccattaaagatagtaaggctgtccacgccgacatggggtactggatcgaatctgagaaaaatgaaacctggaagctagcacgggcgagcttcattgaggtgaagacttgtatctggccaaaatcccatacactgtggtcaaacggagttctcgaaagcgagatgataatccccaagatttatggcggtcctatctctcaacacaattaccgaccaggctacttcacccagactgccgggccgtggcatctgggaaaacttgagttggattttgacctgtgcgaaggcacaaccgtggtagtcgatgagcactgcgggaacagaggaccctccttaaggacgactaccgtgacaggcaagattatccacgaatggtgttgccgcagttgtaccctccctccactgcggttcagaggtgaggacgggtgctggtatggaatggagataaggcccgtgaaagaaaaggaggaaaatcttgtcaagagcatggtttctgctggctccggtgaggtggactcatttagtctgggcttgctctgtattagcatcatgatcgaagaggtaatgcgctcgcgatggtcccggaaaatgctgatgactgggacactagccgtgttctttctgctcaccatgggacagctgacatggaacgatcttattcgtttgtgcatcatggtcggcgcaaatgcttctgacagaatggggatgggaactacctacctggccttaatggcaacgttcaagatgaggcctatgtttgccgtgggcctcctgttccgccggcttacaagcagagaggttctgctactcaccattggtctgtcattggtggctagtgtcgaactgccaaactccttagaggaactcggggatggactggcgatgggcataatgatccttaaactgttgactgactttcaatctcatcagctctgggccaccctgctaagcctgacattcattaagactaccttttcccttcactatgcatggaaaacgatggctatggtgctctcaatcgttagcctgttccccttgtgtctgagtacaacctctcagaagactacatggttaccggtgctcctgggctcccttgggtgcaagcctctgaccatgtttttgattgccgagaataaaatctggggaaggcgaagctggccactcaacgaaggtataatggccgtcggcatcgtatcgattctgctatcatctctgcttaagaacgatgtgcccctcgctgggcctctgatcgcaggaggcatgttgattgcctgttacgttatcagtggttccagcgcggacttatctctggagaaagctgccgaggtgagctgggaagaggaagcagagcattccggggcctcacacaatatactcgtcgaagtgcaggatgacggaactatgaagattaaagatgaggagcgcgacgatacactgaccatccttctgaaggctacgttgctagcagtaagtggcgtgtatcccctgagcatcccagccactctcttcgtctggtacttctggcagaagaagaagcagcggtctggcgttctgtgggacaccccttcacccccagaagtggagagagcggtgcttgatgacgggatttataggataatgcagcgtggattactgggtcgcagccaggtcggcgtgggggtttttcaagaaaacgtattccatacaatgtggcacgtgacccggggagctgtcctcatgtaccagggcaaaagattggagccgagttgggccagcgtgaagaaagacctgatctcctacggtgggggatggaggctccagggctcttggaatacaggcgaggaagttcaggtgattgcagtcgagcctgggaagaaccccaaaaatgtgcaaactgccccaggaacctttaagacgcccgaaggtgaggtaggcgctatcgccctggatttcaagcctgggacatcgggaagcccaattgtcaaccgagaaggcaaaatcgtgggtctttatgggaatggagttgtgactacctcaggcacatacgtctccgcaatagctcaggccaaggcgagtcaggagggccccctgcctgagatcgaagacgaggtgtttcggaaacgcaacttgaccattatggatctacacccggggtctggaaagactagaaggtatctgccagccatcgttcgggaagcaattaaacgaaagctcagaaccttaatcctggctcccacacgcgtggtcgccagcgagatggctgaagcacttaagggtatgcctataaggtaccaaacgactgccgtgaaatccgagcataccggcaaggagattgtagacctgatgtgccacgccacattcaccatgcgtctcttgtcaccagtgcgggttcccaattataacatgatcatcatggatgaagctcattttactgacccttctagcattgcggcaagagggtacatcagtacaagggtcggaatgggcgaggccgctgccatattcatgaccgcaacgccgcccggttccgtggaagcctttccacagagcaatgctgtgattcaggatgaggaacgcgacatccctgagcgatcttggaactcagggtatgagtggattactgatttccccggaaaaacagtctggtttgtaccatccatcaagagtggcaatgacatagcgaactgtctgaggaaaaatggcaagcgggtgattcagctcagcaggaagaccttcgataccgaataccagaaaactaagaacaacgactgggactacgttgtgacaaccgatatctcggagatgggggccaatttccgcgcagaccgtgtcatcgatcctagacggtgcctgaaacccgtgattcttaaggacggaccagaaagggttatcctagctggtccgatgcctgtgacagtcgcctctgcagcccagcgccgaggcagaattgggcggaaccacaataaagagggagatcagtatatatacatgggccagcccctgaacaatgacgaggatcatgctcactggactgaagccaagatgttgttagacaacatcaatacgccagagggtattatccccgcgctgtttgaacctgagagggaaaagtccgcagccatcgatggggagtatcgcctcagaggcgaggctaggaaaaccttcgtggaactgatgcggcgtggagaccttccagtatggctgagctacaaggtggcctcagagggctttcaatatagtgatcgccgatggtgcttcgacggggaaagaaacaatcaggttctcgaggaaaacatggatgtcgagatttggacaaaagagggagaaaggaagaaattgcggccccgctggctggacgctagaacttactctgaccctctagcactgagggagtttaaggagttcgccgctggtcggcgatccgtgagcggcgatctcatacttgagatcgggaaactgccgcagcacttaacccagagagcccaaaatgcattggacaacctggtgatgctccataattcagaacagggaggccgcgcgtataggcacgccatggaggagctgccagatacaattgaaacccttatgctgctcgctttgatcgccgtcctgactggtggggttacgttatttttcctaagtggccggggactgggcaagaccagcattgggctcctttgtgtgatggcatcctctgtactgttgtggatggctagcgtggagccccattggatcgccgcatccataatcctggaatttttcctcatggtcctgcttattcctgagcccgaccgtcagagaacaccacaggataaccaactcgcctacgtggttatcggactgttgtttatgattctgactgtggctgcgaatgagatgggtttactagaaaccacaaagaaagacctgggcatcgggcacgtcgccgtagagaaccaccatcacgcagctatgctcgatgtggaccttcatcctgcctcagcctggaccctgtacgcagttgctactacaataattacgcccatgatgaggcacaccatcgaaaacactacagccaatatttctttgaccgcgatcgctaaccaggccgcaatactgatgggactcgataagggctggccaatcagtaaaatggacattggtgtgcctctgcttgccttagggtgctattcgcaggtcaatccgctgaccctcacagctgcagtgttgatgctggtcgcccattacgcgatcattggccccggactacaagctaaggccactcgcgaggcacagaaacggacggccgctggcatcatgaagaacccaaccgtggatgggatagttgccattgacctggatcctgtggtatatgacgcaaagttcgaaaaacagctcggacagatcatgcttctgatcttgtgtacaagccaaattctgctcatgcgaactacctgggctctgtgcgagtccatcacattagccaccggcccccttactacgctgtgggagggttctccagggaagttttggaatacaaccatagcggtgtcaatggccaacattttcagaggaagctacctcgcaggcgctggtctagccttctccctgatgaaaagtttgggcgggggaaggcgcggcactggggcacagggagaaaccctgggcgagaagtggaaacggcagctcaatcagctttctaagagcgaatttaacacatataagagatcaggtatcatggaggtcgaccgttccgaagctaaagaggggctgaagaggggagagactaccaaacacgccgttagtcggggcacagccaagttgcgctggttcgtggaacgaaatctggtcaaacctgagggtaaggtgattgatctcggctgtgggagaggaggctggagctactattgcgcggggttaaagaaagtaacggaagtgaagggatacaccaaaggcggtcccgggcacgaggaaccgatcccaatggctacttacggatggaacctggttaaacttcattctggcaaagacgtgtttttcatacctcccgagaagtgtgatacactgctatgcgacatcggcgagtcctcaccaaatcccaccattgaagaggggaggactctccgggtcctgaaaatggtggaaccttggttgcgcggaaaccaattttgtatcaagattctgaatccgtatatgcccagcgtcgtggagacactcgagcagatgcagagaaagcacggtggcatgcttgttaggaacccactgtcgcgaaattctacccatgaaatgtactgggtaagttgcgggacgggaaacatcgtgtccgcagtcaatatgaccagccggatgttactgaaccgtttcacaatggcccacagaaaacctacttatgagcgcgatgtggacttgggcgctggtaccaggcacgttgccgtggaacccgaggtcgcaaacctcgatattatcgggcagcggatagaaaatattaagcatgagcacaaatcaacatggcattacgacgaggataacccttataagacttgggcctaccacggatcctatgaagtgaaaccatctggcagcgctagttccatggtaaatggcgtggttaagctgctaaccaagccctgggacgtcatccctatggtgacacaaatcgcgatgaccgatactacgccatttgggcagcagagagtgttcaaagagaaggtcgacacacgcacccccaaagccaagaggggaactgcacaaattatggaagttaccgctaaatggctttggggttttctgagccgaaacaagaagccgcggatatgtacaagagaggagttcacgaggaaagtgcgctctaatgccgcaatcggcgccgtatttgtggacgagaaccagtggaactcagctaaggaggccgtcgaagatgagcgtttctgggacctcgtgcatcgggaaagagagctgcacaaacaggggaagtgcgcgacctgcgtttacaacatgatgggaaaaagggaaaagaagttgggcgagtttggtaaagcaaaggggagtcgcgccatttggtacatgtggctgggagctcgattcctcgagttcgaagcccttggctttatgaatgaggatcactggttctcccgggaaaacagcctgtctggcgtggagggggagggattacataaactgggttatatcttgagagacatttcgaagatccctggcgggaatatgtacgcagatgacactgctggatgggatacaaggataaccgaagacgatctccagaacgaggcccgcatcactgacattatggaaccagagcacgctctgctagccaaatcaatctttaaacttacatatcaaaataaagtcgtgagagtacagcggcccgcaaagaacggcaccgttatggatgtgattagcaggcgtgaccagcgaggttccgggcaggtcggaacatacggcctgaatactttcaccaacatggaagcgcaactcatccgccagatggagagtgagggcatattttctcctagcgaactggagacgccaaacttggccgaaagagtgttagattggctggagaagtatggggtggaacggctcaaaaggatggctatttccggagacgactgtgtcgttaagcccatcgatgaccgcttcgccaccgcacttacagctctgaatgatatgggtaaagtgagaaaggacatcccgcagtgggagccttcaaaaggctggaacgattggcagcaagtacccttttgcagtcatcacttccaccagctaattatgaaggacgggcgggagatagtggtcccatgtaggaatcaggatgaactggtgggacgagcccgtgtttctcagggcgcaggttggagcctcagagagactgcctgcttggggaagtcctacgcgcaaatgtggcagctgatgtattttcatcgccgggaccttaggctggctgccaacgcaatctgttcagccgtgcctgtcgattggattcccaccagcagaacaacttggtctatccacgctcatcaccagtggatgaccacggaagacatgctctccgtgtggaatcgcgtatggattgaggaaaacccatggatggaggataaaacacatatcagtagctggggagacgttccctacttaggcaagcgggaggaccaatggtgcggctcgctgatagggttgaccgccagggcaacttgggctacaaatatccaggtggccattaaccaggtccgaagactgatcggaaatgaaaactacctcgattatatgacctccatgaaacggttcaagaatgagtctgaccctgaaggtgcgctttggtga

SEQ ID NO: 13574 - RNA, 9879 nt, synthetic construct
  misc_feature 1..9879: note = derived and/or modified CDS sequence (opt3) from DENV-1__EU677173__SS-prME
  source 1..9879: mol_type = other RNA
agcgtgaccatgctgctcatgcttatgcccacagccctggctttccacttgactacgagaggcggggagcctcatatgatcgtcaccaagcaggaaaggggaaaatccttactgtttaagacatctgcaggtgttaacatgtgcactctaattgccatggacctcggcgagctgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagagcaggacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattaccccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcaactacatcacaagagacctggaatcggcaggacctgttggtgacattcaaaactgctcacgccaagaagcaggaagtagttgtgctcggtagccaagagggggctatgcacaccgccctgacgggcgcaaccgaaatccagacaagtggaactaccacaatttttgccggccatttaaaatgccgtctgaagatggataaactaactctcaaggggatgtcttatgtcatgtgtaccggatccttcaaactggagaaggaagtggctgagacgcagcacggtacagtccttgtgcagataaagtacgagggcaccgacgcgccttgcaaaatcccattcagcactcaagatgaaaagggggttacacagaacggacgcttgattaccgcaaatcccatcgtgactgacaaagagaagcctgtaaacatagaagccgagccaccctttggcgagtcgtatattgtcatcggtgctggggaaaaagccctgaagctctcttggttcaagaaaggctcctcaatcggaaagatgtttgaggcaaccgccagaggcgctaggcggatggccattctgggggatacagcatgggacttcggaagtatcggtggcgtgtttacgagcgttgggaaacttgtgcatcagattttcggaaccgcgtacggcgtcctgttttccggtgtgtcttggactatgaagatagggatcggcgtattgctcacatggctgggattaaatagccgatcaaccagtctgtccatgacatgtattgctgtgggcctagttactctctacctgggggtcatggtgcaggccgatagcggatgcgtgatcaactggaaaggccgcgaacttaagtgtggttctgggatcttcgtcaccaatgaggttcacacgtggacagaacaatataagtttcaggcagactcaccgaaaagattgagtgccgctattggaaaggcctgggaggagggcgtgtgcggtataaggagcgcaacccggctggaaaacatcatgtggaaacagatttccaacgagctcaatcatatcctgttagaaaacgacatgaagttcactgtggtagtcggcgatgtggttgggattctggctcagggaaaaaagatgatccgccctcaacccatggagcacaaatactcttggaagtcgtggggcaaggccaaaataatcggggcggacgtgcagaataccacatttattatcgatggaccaaacactcctgaatgtcccgacgatcagagagcctggaatatttgggaggtcgaggactatggcttcggtatctttaccacaaacatatggcttaagttgagggatagctacacgcagatgtgcgaccaccgtctcatgtccgctgcaattaaagattcaaaggccgtgcatgctgacatggggtattggatcgaaagtgagaaaaatgaaacctggaagctggcccgggcatctttcattgaggttaagacttgtatctggccaaaaagccacacactatggtccaacggagtgctggaatcagagatgataatccccaagatttacggcggtcctatcagccaacataattatcgaccaggctacttcacccagactgcggggccgtggcacctcggaaaactggagcttgattttgacttgtgcgaaggcacaaccgtagtcgtggatgagcactgcgggaacagaggaccctctctgaggacgactaccgtgacaggcaagattatccatgaatggtgttgccgctcctgtaccttacctccactccggttcaaaggtgaggacgggtgctggtacggaatggagataagacccgtcaaggaaaaggaggaaaatctggttaaaagtatggtgagcgccggctctggtgaggtagactccttttcacttggcctgttgtgtattagtatcatgatcgaagaggtgatgaggagccgctggtcgcgaaagatgctcatgactgggacactggctgtcttcctactgctcattatgggacagctgacctggaacgatcttatccggttgtgcattatggtgggcgccaatgcatccgaccgtatggggatgggaacaacttatctggctttaatggccacctttaaaatgagacctatgttcgcagttggcctcctgtttaggcgccttacgtctcgggaggtgctgctactcacaataggtctgagcttggtcgcctcagtggaactgccaaacagtttagaggaactcggggatggactggctatgggcatcatgattcttaagctgttgaccgacttccaatcccaccagctctgggcgactctgctatctctgacctttatcaaaacaactcttagcctccattacgcctggaagaccatggcaatggttctgtccattgtgtcattgttccccctgtgtttaagcacgacaagtcagaagaccacttggctcccggtcctgcttggctctctggggtgcaaacctttgacaatgtttctcatcaccgagaataagatatggggaagaaaatcctggccactgaacgaaggtatcatggctgtaggcgtggttagcattctactgtcgtcacttctcaagaacgatgtgcccctggccgggcctttgatcgccggaggcatgttaattgcttgttatgtcatctctggtagttccgcagacctgagcctcgagaaagccgcggaggtgtcttgggaagaggaagctgagcacagcggggcctcccataatatactggtagaagtgcaggatgacggaactatgaagattaaagatgaggagagggacgatacacttaccatcctgttgaaggcaacgctactggccgtctcaggcgtttaccccctcagtatcccagctactctgttcgtgtggtatttttggcaaaagaaaaagcagcgaagcggcgtgctttgggacaccccttctcccccagaagtcgagcgcgcagtgttagatgacgggatttaccggataatgcagagaggactgctcggtaggtcccaggttggcgtaggggtgttccaagaaaacgtcttccacacaatgtggcacgtgacccgtggagccgttttgatgtatcagggcaaacgcctggagccgtcatgggcgagtgtgaagaaagacctcatcagctacggtgggggatggcggctgcagggctcctggaatgctggcgaggaagtccaggtgattgccgtagagcctgggaagaaccccaagaatgtccaaacagcaccaggaacttttaaaacccccgaaggtgaggtgggcgccatcgctcttgatttcaagcctgggacgtctggatcgccaattgttaacagagaaggcaaaatcgtgggtctgtacgggaatggagtcgtgacaactagcggcacctatgtttcagccatagcacaggctaaggcctcccaggagggccccttgcctgagatcgaagacgaggtgtttaggaaacgaaacctaacaattatggatctgcatccggggagtggaaagacccggcgctacctcccagcgatcgtcagagaagccattaagaggaaattacggactctgatccttgcacccacccgagtggtagcttctgagatggccgaagctctgaagggtatgcctataagatatcaaacaacggcagtgaaaagcgagcacactggcaaggagattgttgacctcatgtgccatgccaccttcacaatgcgcttgctgtccccagtcagggtgcccaattacaacatgatcatcatggatgaagcccactttaccgacccttcatctattgctgcgcgtgggtatatcagcactcgggtgggaatgggcgaggcagccgctatattcatgacagccaccccgcccggtagtgtcgaagcatttccacagtccaatgccgtaattcaggatgaggaaagagacatccctgagaggagctggaactctgggtacgagtggattacggatttccccggaaaaactgtgtggtttgttccatcaatcaagtccggcaatgacatagctaactgtctccgcaagaatggcaaacgagtgattcagctgagtagaaagacattcgataccgaatatcaaaaaaccaagaacaacgactgggactacgtcgtgactacagatatcagcgagatgggggcgaattttcgggccgacagggttatcgatcctcgccgttgccttaaacccgtgattctaaaggacggaccagaaagagtcatcctggcaggtccgatgcctgtgaccgtagcttcggccgcacagcggaggggccgcattgggcgaaaccataataaggagggagatcagtacatatatatgggccagcccttgaacaatgacgaggatcacgcccactggacagaagctaaaatgttactggacaacatcaatactccagagggtattatccccgccctcttcgaacctgagagagaaaagtctgcggcaatcgatggggagtaccggctgaggggcgaggcccgcaaaacgttcgtggaacttatgagaaggggagacctgccagtttggctctcctataaggtcgctagcgagggctttcaatactcagatcggcgttggtgcttcgacggggaacgcaacaatcaggtgttggaggaaaacatggatgtggagatttggaccaaagagggagaacgaaagaaactgagacccaggtggctagacgcccggacatatagtgaccctctggctctccgcgagtttaaggaattcgcagccggtagaaggtctgtctccggcgatcttatactggagatcgggaagttaccgcagcatttgactcagcgggctcaaaatgccctggacaacctcgttatgctgcacaatagcgaacagggaggccgagcatacagacatgcgatggaggagcttccagataccattgaaacactgatgctcttggccctgatcgctgtgttaaccggtggggtaactctatttttcctgtcaggccgcggactcggcaaaacgagtattgggcttctgtgtgtgatggccagctccgtcttgctgtggatggcatctgtggagccccactggatcgctgccagcataatcctcgaatttttcctgatggttcttctcattcctgagcccgacaggcagcggaccccacaggataaccaactggcatatgtggtcatcggattgctgtttatgattttaacagtagccgctaatgagatgggtctactggaaactaccaagaaagacctcggcatcgggcacgtggcggttgagaaccatcaccatgccacaatgcttgatgtggacctgcaccctgcatccgcttggaccttgtacgccgtcgccactacaataattacgcccatgatgcgtcataccatcgaaaacactacagcaaatatttcactgaccgctatcgccaaccaggcggctatactcatgggactggataagggctggccaatctctaaaatggacattggtgtgcctcttttagccctggggtgctacagtcaggtcaatccgctcaccttgacagcagccgtgctgatgctagttgctcactatgcaatcattggccccggactgcaagccaaggcgactagagaggctcagaagaggacggccgcaggcatcatgaaaaacccaaccgtggatgggatagtagccattgacctcgatcctgtggtctacgacgctaagttcgaaaaacagcttggacagatcatgctgttgatcctgtgtacatcgcaaattctcctgatgcgcactacctgggccttatgcgagagcatcacacttgcaaccggccccctgactacgctctgggagggttccccagggaagttttggaatacaaccatagctgtttctatggccaacattttccggggatcatatctagcgggcgccggtctggcatttagcttgatgaaatccctgggcgggggacgaagaggcactggggctcagggagaaaccctcggcgagaagtggaagaggcagcttaatcagctgagtaaatctgaattcaacatctacaagcgcagcggtattatggaggtggaccggtcagaagccaaagaggggttgaagagaggagagacaactcgtcacgcagtctccaggggcaccgctaaactgcggtggttcgtggaacgcaatctcgtaaagcctgagggtaaggtgatcgatttaggctgtgggcgaggaggctggagttattactgcgccgggctgaaaaaggttacagaagtgaaaggatatacgaagggcggtcccgggcatgaggaaccgataccaatggccacctacggatggaaccttgtcaaactgcacagcggcaaggacgtgtttttcactcctcccgagaaatgtgatacactactctgcgacatcggcgagtcttccccaaatcccaccattgaagaggggagaactctgagggtcttgaagatggtggaaccttggctgcggggaaaccaattttgtatcaagattctcaatccgtacatgccctcagttgtagagacacttgagcagatgcagcgcaaatatggtggcatgctggtgagaaacccattaagcaggaattcgacccatgaaatgtactgggtctcttgcgggacgggaaacatcgtgagtgcggttaatatgacctcccgaatgctgttgaaccggttcacaatggctcaccgtaagcctacttatgagagagatgtggacctcggcgcaggtacccgccacgtcgccgtggaacccgaggtagctaacctggatattatcgggcagaggatagaaaatattaaacatgagcacaagagcacatggcattacgacgaggataacccttataaaacttgggcctaccacggatcatatgaagtgaagccatccggctctgcaagcagtatggttaatggcgtcgtgaagctacttaccaaaccctgggacgtgatccctatggtcacacaaatcgccatgaccgatactacgccatttgggcagcagcgggttttcaaggagaaagtggacacaagaacccccaaggctaaacgcggaactgcgcaaattatggaagtaaccgccaggtggctgtggggttttctctcccgaaacaagaagccgcggatatgtacaagagaggaattcacgaggaaagtgcgcagcaatgcagctatcggcgccgtctttgtggacgagaaccagtggaattctgcaaaggaggccgttgaagatgagcgtttctgggacctggtgcagaaagaacgggagttgcataagcaggggaaatgcgctacctgcgtctacaacatgatgggaaagagagaaaagaaactgggcgagtttggtaaggccaaagggtcaagggcgatttggtacatgtggctcggagcacgcttccttgagtttgaagccctgggcttcatgaatgaggatcactggttcagtcgagaaaactccttaagcggcgtggagggggagggactgcacaagttgggttatatcctccgggacatttctaaaatccctggcgggaatatgtacgctgatgacactgccggatgggatacaagaataaccgaagacgatctgcaaaacgaggcaaagatcactgacattatggaaccagagcatgctctacttgccacatcgatctttaaactgacctatcagaataaggtagttagggtgcagcgccccgctaagaacggcacagtcatggatgtgatttcaagacgggaccagaggggtagcgggcaagtgggaacttacggcctcaataccttcacgaacatggaagcccagctgatccgtcagatggagtccgagggcatatttttgcctagtgaattagagaccccaaacctggcagaacgagtcctcgattggcttgagaaatatggggttgaacgcctgaagagaatggcgatttctggagacgactgtgtggtaaaacccatcgatgaccggttcgccacagctctaactgccctgaatgatatgggtaaggtgaggaaagacatcccgcagtgggagcctagcaagggctggaacgattggcaacaggtccccttttgctcccaccatttccaccagctcattatgaaggacgggcgcgagatagtggttccatgtagaaatcaggatgaattggtgggacgggcaagggtctcacaaggcgctggttggagtctgcgagagaccgcctgccttgggaaatcttacgcacagatgtggcagctgatgtattttcaccgtagagacctccgcttagccgcgaacgctatctgtagcgccgtgcctgtagattgggttcccacatcccggactacctggtcaattcatgcacaccatcaatggatgacgacagaagacatgctgagcgtgtggaatagggtctggatcgaggaaaacccatggatggaggataagacccacgtgtcttcctggggagacgttccctacttgggcaaaagagaggaccagtggtgcggcagtctgattgggctcactgcccgcgctacatgggccagcaatatccaggtggcaataaaccaggtccggaggcttatcggaaatgaaaactacctggattatatgacctcgatgaagcgattcaaaaatgagggtgaccctgaaggcgctctatggtga

SEQ ID NO: 13575 - RNA, 9879 nt, synthetic construct
  misc_feature 1..9879: note = derived and/or modified CDS sequence (opt3) from DENV-1__EU726779__SS-prME
  source 1..9879: mol_type = other RNA
agcgtgaccatgctgctcatgcttatgcccacggccctggctttccacttgactacgagaggaggggagcctcatatgatcgtctccaagcaggaaagaggaaaatctttactgtttaagacctcagccggtgttaatatgtgcacactaattgccatggacctcggcgagctgtgtgaagatactatgacctacaaatgcccacggataacagagaccgaaccggacgatgtggactgttggtgcaatgcgactgatacatgggtgacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccggtagcttcaaactggagaaggaagtcgccgagacgcagcacggaacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattgtgatcggtgccggggaaaaagctctgaagctctcctggttcaagaaaggctcaagtatcggaaagatgtttgaggccaccgcaagaggcgccaggcggatggctattctgggggatacagcctgggacttcggaagcatcggtggcgtttttacgtccgtggggaaacttgtccatcagattttcggaaccgcatacggcgtgctgttttctggtgtaagctggactatgaagatagggatcggcgtgttgctcacatggctgggattaaattcacgaagtacctccttcagcatgacatgtattgcggttggcctggtcactctatacctcggggtgatggtgcaggctgattctggatgcgtcatcaactggaaaggccgcgaactgaagtgtggttcagggatctttgttaccaatgaggtgcacacgtggacagaacaatataagttccaggccgacagtccgaaaagacttagcgcagccattggaaaggcttgggaggagggcgtgtgcggtataaggtccgccacccggttggaaaacatcatgtggaaacagatttctaacgagctgaatcatatcctcctggaaaacgacatgaagtttactgtagtcgtgggcgatgttgcagggattttagctcagggcaagaagatgatccgccctcaacccatggagtacaaatattcgtggaaaagctggggcaaggccaagataatcggggcggacgtgcagaataccacattcattatcgatggaccaaacactcctgaatgtcccgacgatcagagagcctggaatatttgggaggtcgaggactacggctttggtatcttcaccacaaacatatggctgaaacttagggattcctatacacaggtgtgcgaccaccgtttgatgtcagctgcaattaaagatagtaaggccgttcacgctgacatggggtactggatcgaatctgagaaaaatgaaacctggaagctcgcccgggcatccttcattgaggtgaagacttgtatctggccaaaatcccatacactgtggtcaaacggagtactagaaagcgagatgataatccccaagatttatggcggtcctatctctcaacacaattaccgaccaggctactttacccagactgcggggccgtggcatctgggaaaactcgagctggatttcgacctttgcgaaggcacaaccgtcgtggtggatgagcactgcgggaacagaggaccctccttgaggacgactaccgtcacaggcaagattatccacgaatggtgttgccgcagttgtaccctgcctccattacggtttagaggtgaggacgggtgctggtatggaatggagataaggcccgttaaagaaaaggaggaaaatctcgtaaagagcatggtatctgccggctccggtgaggtggactcattcagtctgggccttctgtgtattagcatcatgatcgaagaggtcatgcgctcgcgatggtcccggaaaatgttgatgactgggacactcgctgtgtttttcctgctaattatgggacagctgacctggaacgatctcatccgtctgtgcattatggttggcgccaatgcatctgacagaatggggatgggaacaacttaccttgctttgatggccacctttaagatgaggcctatgttcgcagtgggcctgttatttcgccggctcacgagcagagaggtcctgcttctgacaataggtctatcactcgtggccagtgttgaactgccaaactccttggaggaactgggggatggattagctatgggcatcatgattctcaaactgcttaccgacttccaatctcatcagctgtgggcgactttgctcagcctgacctttatcaagacaactttctccctacactatgcctggaaaaccatggcaatggtgctgtcaattgtcagcctttttcccctctgtctgagtacgacatctcagaagaccacttggttgccggtactgttaggctccctcgggtgcaagcctctgacaatgttccttatcgctgagaataaaatatggggaaggcgaagctggccactgaacgaaggtatcatggccgtgggcattgtttcgatcttgctctcatctctgctaaagaacgatgtgcccctggccgggcctcttattgctggaggcatgctcatcgcatgttacgtcataagtggttccagcgccgacctgtctttggagaaagcggctgaggtgagctgggaagaggaagccgagcattccggggcatcacacaatattttagtagaagtgcaggatgacggaaccatgaagatcaaagatgaggagcgcgacgatactctgacaatcctcctgaaggccacccttctggctgtcagtggcgtttatcccttgagcattccagcaacgctattcgtgtggtacttttggcagaagaagaagcagcggtctggcgtgctgtgggacactccttcacccccagaagtcgggagagccgtgctcgatgacggaatatataggatcatgcagcgtggtctgcttggccgcagccaggttggggtaggagtgttccaagagaacgtctttcataccatgtggcacgtgacacggggcgcggttttaatgtaccagggtaaaagactggaaccgagttgggctagcgtgaagaaagacctcatttcctacgggggaggctggaggttgcagggctcttggaataccggggaggaggtccaggtgatcgccgtagaacctggaaagaaccccaaaaatgtccaaacagcaccaggtactttcaagacccccgagggcgaagtgggggccattgctctggattttaagcctggaacgtcgggcagcccaatcgttaaccgagagggtaaaatagtggggctctatggaaatggcgtcgtgacaacttcaggcacctacgtttccgccatcgcacaggctaaggccagtcaggaagggcccctgcctgagattgaggacgaagtgttccggaaacgcaaccttacaatcatggatctgcacccgggatctggtaagaccagaaggtatttgccagcgattgtccgggaggccatcaaacgaaagctaagaactctgatactcgcacccacccgcgtggtagctagcgaaatggccgaggctttaaagggcatgcctattaggtaccaaacaacggcagtgaaatccgaacatactgggaaggagatcgttgacctgatgtgccacgccacctttacaatgcgtcttctgtcaccagtccgggtgcccaattataacatgatcattatggatgaggcccatttcaccgacccttctagcatcgctgcgagaggatacataagtactagggtgggcatgggtgaagcagccgctatttttatgacagccaccccgcccgggtccgtcgaggcattcccacagagcaatgccgtaatccaggatgaagaacgcgacattcctgaacgatcttggaactcaggatatgagtggatcacggattttcccggcaaaactgtgtggttcgttccatccataaagagtggcaatgacattgctaactgtctcaggaaaaatgggaagcgggtgatccagttgagcaggaagacattcgataccgagtaccagaaaaccaagaacaacgactgggactacgtcgtgactacagatatctcggaaatgggagcgaattttcgcgccgaccgtgttattgatcctagacggtgcctgaaacccgtgatcctcaaggacggtccagagagggtcattctggcaggcccgatgcctgtgaccgtagcttctgccgcacagcgccgagggagaataggacggaaccacaataaagaaggcgatcagtatatctacatgggtcagccccttaacaatgacgaggatcatgcccactggacagaggctaagatgctactggacaacattaatactccagaagggatcatccccgccttgttcgagcctgaaagggagaagtccgcggcaattgatggcgaatatcgcttaagaggagaggccaggaaaacgtttgtggagctgatgcggcgtggcgacctcccagtttggctgagctacaaggtcgcttcagaagggttccaatatagtgatcgccgatggtgctttgacggagagagaaacaatcaggtgcttgaagagaacatggatgtggaaatatggaccaaagagggtgagaggaagaaactgcggccccgctggctcgacgccagaacatactctgaccctttggctctgagggagttcaaggagtttgcagccggccggcgatccgtcagcggggatctaatcctggaaattggaaaactcccgcagcaccttactcagagagctcaaaatgccctggacaacttagttatgttgcataattcagagcagggcggtcgcgcatataggcacgcgatggaggaactgccagataccatcgagacactcatgctgcttgccctgattgctgtgctcaccgggggcgtaactttgttctttctgagtggacggggcttagggaagacgagcatcggactactgtgtgtgatggcctcctctgtcctcctttggatggcaagcgtggaaccccattggatagctgcctccatcattctggagttctttttgatggttctgctcatccctgaacccgaccgtcagagaaccccacaggataaccaactggcatacgtggtcattggtcttctcttcatgatcctgacagtagccgctaatgagatgggcttgctggagactaccaagaaagacttagggataggacacgtggcggttgaaaaccaccatcacgccgcaatgctagatgtggacctgcatcctgcttcagcctggacactctacgccgtcgcaaccactattatcacacccatgatgaggcacacgattgagaacaccactgctaatatctctcttacagccatagcgaaccaggctgccatcctgatgggcttggataagggttggccaattagtaaaatggacatcggggtgcctctgctcgcactgggctgctattcgcaggtcaatccgcttaccttaaccgccgctgtgctgatgctcgttgcacattacgccattatcggacccggcttgcaagcgaaggctacacgcgaagcccagaaacggactgcagccgggataatgaagaacccaacggtggatggaattgtagctatcgacctggatcctgtggtctatgacgccaagtttgagaaacagctaggccagatcatgctgctcattctttgtaccagccaaatcctgttgatgcgaacaacttgggcactgtgcgaatccataaccctcgctacaggtcccctgaccactttatgggaggggtctccaggaaagttctggaatacgacaattgccgtttcaatggcgaacatcttcagaggcagctaccttgccggtgcaggcctggctttttccctcatgaaaagtctagggggaggcaggcgcgggaccggagcccagggcgagactctgggtgaaaagtggaaacggcagttgaatcagctgtctaagagcgagttcaacacctataagagatcagggattatggaagtggaccgttccgaggcaaaagaaggactcaagaggggcgagacaactaaacacgctgtcagtcggggtaccgccaaacttcgctggtttgtggagcgaaatctggtaaaacctgaaggcaaggtgatcgatttggggtgtggaagaggcgggtggagctactattgcgccggactgaagaaagttacagaggtgaagggctacacgaaaggtgggcccggacacgaggaaccgataccaatggcgacctacggctggaacctcgtcaagttacattctggcaaagacgtgttctttatccctcccgaaaagtgtgatactctgctttgcgacattggggagtcctcaccaaatcccacaatcgaggaaggaaggaccctgcgggtcctaaaaatggtggagccttggctccgcggtaaccaattctgtattaagatcctgaatccgtatatgcccagcgttgtagaaactttggagcagatgcagagaaagcacggcgggatgctggtgaggaacccactctcgcgaaattctacacatgagatgtactgggtcagttgcggaaccggcaacattgtgtccgctgttaatatgacgagccggatgcttctgaaccgttttaccatggcacacagaaaacctacatatgaacgcgatgtggacttaggtgccgggactaggcacgtcgctgtggagcccgaagtagccaacctggatatcataggacagcggattgagaatatcaagcatgaacacaaatcaacctggcattacgacgaggataacccttataagacatgggcataccacggctcctatgaggtgaaaccatctggcagcgccagttccatggttaatggggtcgtgaagttgctcactaagccctgggacgtgatccctatggtcacccaaattgctatgacagataccactccattcggacagcagagagtttttaaagaaaaggtggacacgcgcacacccaaagcgaagaggggtaccgcccaaataatggaggtaactgcaaaatggctgtggggcttcctaagccgaaacaagaagccgcggatctgtaccagagaagagtttacaaggaaagtgcgctctaatgctgccattggggcagtcttcgtggacgaaaaccagtggaactcagccaaggaggctgttgaggatgaacgtttttgggaccttgtgcatcgggagagagaactgcacaaacagggaaagtgcgccacgtgcgtctacaacatgatgggcaaaagggagaagaagctcggtgagttcgggaaagcgaagggaagtcgcgcaatctggtacatgtggctgggcgcccgattcttggagtttgaggctctgggcttcatgaatgaagatcactggttttcccgggagaacagcctctctggggtggaaggagagggtcttcataaactgggctatattttaagagacatctcgaatatacctgggggaaacatgtacgccgatgacaccgcaggctgggatactaggatcacagaggacgatctgcagaatgaagctcgcattaccgacatcatggagccagaacacgccttgctcgctaagtcaattttcaaactgacttatcaaaacaaggtagttagagtgcagcggcccgccaaaaatggtacagtcatggatgtgatcagcaggcgtgaccagcgagggtccggacaggtgggcacctacggcctaaacacatttactaacatggaggcacaacttatacgccagatggaaagtgaggggattttctctcctagcgagctggaaaccccaaatctcgcggagagagtcctggattggttggaaaagtatggagttgagcggttaaagaggatggccatctccggtgacgactgtgtggtaaaacccatcgatgaccgctttgctacggccctgaccgcactcaacgatatgggcaaggtgagaaaagacattccgcagtgggaaccttcaaaggggtggaatgattggcagcaagtccccttctgcagtcatcactttcaccagcttataatgaaagacggacgggagatcgtggttccatgtaggaaccaggatgagctggtgggccgagctcgtgtctctcagggtgccgggtggagcctaagagaaacagcatgcctgggaaagtcctacgcccaaatgtggcagctcatgtatttccatcgccgggacttgaggctggcggctaatgccatttgttcagcagtgcctgtagattggatccccactagcagaaccacatggtctattcacgcccatcaccagtggatgactaccgaggacatgctttccgtttggaaccgcgtgtggatcgaagagaatccatggatggaagataagacgcatataagtagctggggcgacgtcccctacctgggcaaacgggaggaccaatggtgcgggtcgctcatcggattaacagctagggccacctgggcaactaacattcaggtggctatcaatcaggttcgaagactgattggtaacgagaattacttggattatatgacatccatgaagcggtttaaaaacgaatctgaccctgagggcgccctgtggtga

SEQ ID NO: 13576 - RNA, 9879 nt, synthetic construct
  misc_feature 1..9879: note = derived and/or modified CDS sequence (opt3) from DENV-1__EU677176__SS-prME
  source 1..9879: mol_type = other RNA
agcgtgaccatgctgctcatgcttatgcccacagcactggctttccacttgactacgagaggaggggaacctcatatgatcgtctccaagcaggaaagggggaaatctttactgtttaagacctcagccggtgttaacatgtgcacattaattgccatggacctcggcgagctgtgtgaagatactatgacctacaaatgcccacggataacagaggtggaaccggacgatgtagactgttggtgcaataccactgatacatgggtgacctatgggacgtgtagccaaactggagagcaccgccgagacaagcgtagcgtcgcgcttgctccccatgtgggcctgggtttggagaccagagccgaaacatggatgtcctctgagggggcatggaaacagatccagaaggttgaaacttgggccctcaggcaccctggattcaccgtgattgctctgtttctggcacatgccatcggcacatcgattacccagaagggcatcatattcatcctcttaatgctggtcacgccatcaatggctatgcggtgcgtggggattggaagccgcgattttgtagagggtcttagtggcgccacttgggttgacgtggtcttggagcacgggtcctgtgtgacaaccatggcgaaagataagcccactctggacatcgaactgctcaaaacagaggtgaccaaccctgcagtcctgagaaaactttgcattgaagccaaaatctctaatacgaccacagatagtaggtgtccaactcaaggagaggctaccctggttgaagaacaagacgccaacttcgtgtgccggcgcacatttgtagatcgaggctggggtaatgggtgtggattgttcggcaagggctccctcataacttgcgcaaagtttaaatgcgtgaccaagctggaggggaaaattgtccagtacgaaaacttaaagtattcagtgatcgttacagtgcacaccggagaccagcatcaagtcggtaatgagagtactgaacacggcacgacagctaccattactccccaggcccctaccagcgagatccagctgacagactacggggcgctcacccttgattgttctccaagaactggactggacttcaacgaaatggtgttgctaacaatgaaagagaagtcctggctggtacataaacagtggtttctcgatctgccgcttccctggacgtcaggcgccagcaccagtcaagagacttggaataggcaggacctgttggttacattcaagaccgcacacgctaagaaacaggaagtggtcgtgctcggttctcaagagggggccatgcacacagctctgactggcgccaccgaaatccagacgtccggaaccacaactatttttgcaggccatttaaagtgccggctgaaaatggataagctaaccctcaaagggatgagctatgtcatgtgtacaggactgttcaaacttgagaaggaagtggccgagactcagcacggtaccgttttggtgcagataaaatacgagggcacggacgctccttgcaagatcccattctcgacacaagatgaaaaaggggtaacccagaacggacgtctgattactgcgaatcccatcgtcacagacaaggagaaacctgtgaacatagaagcagagccaccctttggcgagtcttatattgttatcggtgccggggaaaaggctctcaagctgtcctggttcaaaaagggctcaagtatcggaaaaatgtttgaggccaccgcacgcggcgccagaaggatggctattcttggggatactgcctgggacttcggaagcatcggtggcgtgtttacctccgtcgggaagctggtgcatcagattttcggaacagcatacggcgtattgttttctggtgtgagctggacgatgaaaatagggatcggcgttctcctgacctggttaggactaaattcacggagtacttccctaagcatgacatgtattgcggtcggcctcgtgaccctgtaccttggggtgatggtccaggctgattctggatgcgttatcaactggaagggccgagaattgaagtgtggttcagggatcttcgtgacaaatgaggtgcacacttggaccgaacaatataaatttcaggccgacagtccgaagcgcctgagcgcagccattggaaaggcttgggaggagggcgtatgcggtataagatccgccacgaggctcgaaaacatcatgtggcggcagatttctaacgagctgaatcatatcttactggaaaacgacatgaagttcacagtcgtggttggcgatgtggtcgggattcttgcacagggcaagaagatgatccgccctcaacccatggagcacaaatactcgtggaaaagctggggcaaggctaagataatcggggccgacgtgcagaataccacttttattatcgatggaccaaacacccctgaatgtcccgacgatcagagagcgtggaatatttgggaggttgaggactatggcttcggtatctttacaactaacatatggttgaagctcagggattcctacacccaggtgtgcgaccaccgtctgatgtcagccgctattaaagatagtaaggcagtacatgccgacatggggtattggatcgaatctgagaaaaatgaaacatggaagctagctcgggccagcttcattgaggtcaagacgtgtatctggccaaaatcccacaccctgtggtcaaacggagtgctcgaaagcgagatgataatccccaagatttacggcggtcctatctctcaacataattatcgaccaggctacttcactcagacagcagggccgtggcacctgggaaaacttgagttggattttgacctgtgcgaaggcaccactgtggtcgttgatgagcactgcgggaacagaggaccctccttaaggacaaccacggtgactggcaagattatccatgaatggtgttgccgcagttgtaccctccctccactgcggttcaaaggtgaggacgggtgctggtacggaatggagataagacccgtaaaggaaaaggaggaaaatcttgtgaaaagcatggtctctgcgggctccggtgaggtggactcatttagtctgggcttgctctgtattagcatcatgatcgaagaggttatgaggtcgcgctggtcccgaaagatgctgatgacagggaccctagccgtgttctttctgctcattatgggacagctgacttggaacgatcttatccggtcttgcattatggtcggcgctaatgccagcgaccgtatggggatgggaacaacctatttggcactgatggctacattcaaaatgagacctatgtttgccgtgggcttactcttcaggcgcctgacttcacgggaggttcttctgctaaccataggtctcagtctggtggcatccgtcgaattgccaaactctctggaggaattaggggatggactcgccatgggcatcatgattctgaaacttctgacggactttcaaagctaccagttgtgggctacactcctgtccctaaccttcatcaaaactaccttttcactgcactatgcgtggaagacaatggccatggtacttagcattgtgagtctcctgcccttgtgtctgtctactacctcccagaagacgacatggttaccggttctcctgggcagccttgggtgcaaacctctgaccatgttcttgatcgcagagaataagatatggggaagaaaatcgtggccactcaacgaaggtatcatggctgtgggcattgtctcaatcctgctatctagtctgcttaagaacgatgtgcccctcgccgggcctctgattgccggaggcatgttgatcgcttgttacgtaatatccggtagctctgcagacttaagcctggagaaagccgcggaggtgtcctgggaagaggaagctgagcattcaggggccagtcacaatattctcgtcgaagttcaggatgacggaactatgaagatcaaagatgaggagagggacgatacactgaccatccttctgaaggcaactttgctagccgtgagcggcgtgtatcccctgtctattccagctacactctttgtctggtacttctggcaaaagaaaaagcagcgatccggcgtgctgtgggacaccccttcacccccagaagttgagcgcgcagtacttgatgacgggatatatcggatcatgcagagaggattactgggtaggagtcaggtgggcgtcggggtgttccaagaaaacgtttttcatacgatgtggcacgtgactcgtggagccgtcctcatgtaccagggcaaacgcttggagccgagctgggcgtccgtgaagaaagacctgatttcttacggtgggggatggcggctccagggctcgtggaataccggcgaggaagtacaggtcatcgctgtggagcctgggaagaaccccaagaatgttcaaacagccccaggaaccttcaaaacacccgaaggtgaggtgggcgcaattgccctggattttaagcctgggactagcggatcaccaatcgtcaacagagaaggcaaaatagtgggtctttatgggaatggagttgtgaccacgtccggcacatacgtcagtgctatcgcccaggcaaaggcttctcaggagggccccctgcctgagattgaagacgaggtgttcaggaaacgaaacttgactatcatggatctacacccggggagcggaaagaccaagcggtatctgccagccattgtacgcgaagcgatcaaaagaaagctcaggacattaatactggcccccacccgggtggttgcatccgagatggctgaagcccttaaaggtatgcctattcgataccaaactaccgctgtcaagtcagagcatacaggcagagagatcgtggacctgatgtgccacgcaacgtttactatgcgcctcttgtctccagtgagggtccccaattataacatgatcattatggatgaagcccatttcaccgaccctagcagtatcgccgctcgtgggtacatatccacacgggtaggaatgggcgaggcggcagccatttttatgaccgctactccgcccggtagcgtggaagccttcccacagtctaatgcagttatccaggatgaggaaagagacattcctgagaggtcatggaactccgggtatgagtggatcacagattttcccggaaaaaccgtgtggttcgtcccaagtataaagagcggcaatgacattgccaactgtctgcgcaagaatggcaaacgagtgatccagctctcgagaaagacgtttgatactgaataccagaagacaaagaacaacgactgggactacgttgtgaccaccgatatctctgagatgggggctaatttccgggcggacagggtcattgatcctcgccgttgcctgaaacccgtgatccttaaggacggaccagaaagagtaattctagccggtccgatgcctgtgactgttgcatccgctgcccagcggaggggccgcatagggcgaaaccacaataaggagggagatcagtatatctacatgggccagcccctgaacaatgacgaggatcatgcacactggacagaagccaaaatgttgttagacaacattaataccccagagggtatcatccccgctctgttcgaacctgagagagaaaagagcgccgcgattgatggggagtatcggctcaggggcgaggcacgcaaaacatttgtcgaactgatgagaaggggagaccttccagtgtggctgtcatacaaggtggccagtgagggcttccaatattctgatcggcgttggtgctttgacggggaacgcaacaatcaggtcctcgaggaaaacatggatgttgagatatggactaaagagggagaacgaaagaaattgagacccaggtggctggacgctcggacgtactccgaccctctagccctgcgcgagttcaaggaatttgctgcaggtagaaggagcgtgtcaggcgatctcatccttgagattgggaagctgccgcagcacttaacccagcgggcccaaaatgctttggacaacctggtaatgctccataatagtgaacagggaggccgagcctatagacacgcaatggaggagctgccagatacaatcgaaactcttatgctgctcgcgttgattgccgtgctgaccggtggggtcacattattctttctaagcggccgcggactgggcaaaacctccatcgggctcctttgtgtgatggcttctagcgccctgttgtggatggcatccgttgagccccattggatagctgcctcaatcattctggagttctttctcatggtgctgcttatccctgagcccgacaggcagcggactccacaggataaccaactcgcatacgtcgtaattggactgttgttcatgatcctgacggtggccgctaatgagatgggtttactagaaaccacaaagaaagacctgggcatagggcacgttgcggtggagaaccaccatcacgccactatgctcgatgtcgaccttcatcctgcatctgcttggaccctgtacgccgtggccacaaccattatcactcccatgatgcgtcacacaattgaaaacacgaccgcaaatatcagtttgactgctatagccaaccaggcggctatcctgatgggactcgataagggctggccaatttcgaaaatggacatcggtgtccctctgcttgccttagggtgctatagccaggtgaatccgctgacactcaccgcagccgttttgatgctggtggctcattacgcaattatcggccccggactacaagccaaggcgaccagagaggctcagaagaggacagccgcaggcataatgaaaaacccaactgtagatgggattgtggccatcgacctggatcctgtcgtttatgacgctaagtttgaaaaacagctcggacagatcatgcttctgattttgtgtacgtcccaaatcctgctcatgcgcaccacatgggccctgtgcgagtctataactttagcaaccggcccccttacaaccctgtgggagggttcaccagggaagttctggaatactacgattgctgtgagcatggccaacatctttcggggatcctacctcgcgggcgccggtctagcattcagtctgatgaaatctttgggcgggggacgaagaggcacaggggctcagggagaaaccctgggcgagaagtggaagaggcagctcaatcagcttagcaaatcagagttcaacacttataagcgctccggtattatggaggtcgaccggagtgaagccaaagaggggctgagacgtggagagaccacaaagcacgcagtgagcaggggcactgctaaattgcggtggtttgtagaacgcaatctggtgaagcctgagggtaaggttatcgatctcggctgtgggcgaggaggctggtcttactattgcgccgggctaaagaaggtgaccgaagtcaaaggatacacaaagggcggtcccgggcacgaggaaccgataccaatggccacgtacggatggaacctggtgaaacttcattccggcaaggacgtcttctttatccctcccgagaaatgtgataccctgctatgcgacattggcgagtcaagcccaaatcccactatcgaagaggggagaacactcagggtgctgaagatggttgaaccttggttgcggggaaaccaattctgtattaagatcctgaatccgtatatgccctcggtagtggagaccctcgagcagatgcagcgcaaacacggtggcatgcttgtcagaaacccactgtctaggaatagtactcatgaaatgtactgggtgtcctgcgggacaggaaacattgttagcgcggtgaatatgacctcacgaatgttactgaaccggtttacgatggctcaccgtaagcctacctatgagagagatgtcgacttgggcgcaggtacacgccacgtggccgtagaacccgaggtggctaacctcgatatcatagggcagaggattgaaaatatcaaacatgagcacaagtccacttggcattacgacgaggataacccttataaaacctgggcctaccacggatcttatgaagttaagccaagcggcagtgcatccagcatggtcaatggcgtggtgaagctgctaacaaaaccctgggacgtcatccctatggttactcaaattgccatgaccgatacaaccccattcgggcagcagcgggtgtttaaggagaaagtagacactagaacgcccaaggctaaacgcggaacagcgcaaataatggaagtgaccgccaggtggctttggggtttcctgtctcgaaacaagaagccgcggatctgtactagagaggaatttaccaggaaagtccgctcaaatgcagctattggcgccgtgttcgttgacgagaaccagtggaatagtgcaaaggaggccgtggaagatgagcgtttttgggacctcgtccatcgggaaagagagctgcacaaacaggggaagtgcgctacatgcgtgtacaacatgatgggaaaaagggaaaagaagttgggcgagttcggtaaagccaaggggtcccgcgcgatctggtacatgtggctgggagcacgatttctcgagttcgaagcccttggcttcatgaatgaggatcactggtttagccgggaaaactctctgtcgggcgtagagggggagggattacataaactgggttatattttgagagacatctcaaagatacctggcgggaatatgtacgctgatgacacggccggatgggataccaggatcactgaagacgatctccagaacgaggcaaaaattacagacatcatggaaccagagcacgctctgctagccaccagcattttcaaacttacttatcaaaataaagttgtgcgcgtccagagacccgctcggaacggcacagtgatggatgtgatctccaggcgtgaccagcgaggtagtgggcaggtcggaacctacggcctgaatacatttactaacatggaagcccaactcatacgccagatggagtctgagagaattttcagcccttccgaactggagaccccaaacttggcagaacgggttttagattggctggagaagcatggcgtggaaaggctcaagcgcatggcgatctcaggggacgactgtgtagtgaaacccatcgatgacagatttgccacggctcttagtgccctgaatgatatgggaaaggtccggaaagacattccgcagtgggagccttctaagggttggaacgattggcagcaagtgcccttctgcagccaccactttcatcagctaataatgaaagacggcagggagatcgttgtgccatgtcgaaatcaggatgaactggtcgggcgtgcaagagtgtcccagggagctggctggtcactccgcgagaccgcctgcttgggtaagagctatgcacaaatgtggcagctgatgtacttccaccggagggaccttagactggccgcgaacgctatttgttctgccgtacctgttgattgggtgcccacatcccgcactacctggagtatccatgcacaccatcagtggatgacaactgaagacatgctcagcgtctggaatcgggtgtggattgaggaaaacccatggatggaggataagacccacatctcgtcctggggagacgttccctatttaggaaaaagggaggaccaatggtgcggctctctgataggcttgacggcccgagctacatgggccaccaatatccaggtggcaattaaccaggtcagacggctgatcgggaatgaaaactacctcgattacatgacttcaatgaagaggtttaaaaatgacagcgatcctgagggagctctttggtga

SEQ ID NO: 13577 - RNA, 9879 nt, synthetic construct
  misc_feature 1..9879: note = derived and/or modified CDS sequence (opt3) from DENV-1__EU726780__SS-prME
  source 1..9879: mol_type = other RNA
agcgtgaccatgctgctcatgcttatgcccacagccctggctttccacttgactacgagaggaggggaacctcatatgatcgtctccaagcaggaaagaggaaaatctttactgtttaagacctcagccggtgttaacatgtgcacactaattgccatggacctcggcgaactgtgtgaagatactatgacctacaaatgcccacggataacagaaaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcccatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccggtagcttcaaactggagaaggaagtcgccgagacgcagcacggaacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattgtgatcggtgccggggagaagaccctgaagctctcctggttcaagaaaggctcaagtatcggaaagatgtttgaggctacagccagaggcgcaaggcggatggccattctgggggatacggcttgggacttcggaagcatcggtggcgtttttacctccgtggggaaacttgtccatcagattttcggaactgcctacggcgtgctgttttctggtgtaagctggacaatgaagatagggatcggcgtgttgctcacctggctgggattaaattcacgaagtacatccctgagcatgacttgtattgcagttggcctagtcaccctctacctgggggtgatggtgcaggcggattctggatgcgtcatcaactggaaaggccgcgaacttaagtgtggttcagggatcttcgttacgaatgaggtgcacacatggaccgaacaatataagtttcaggctgacagtccgaaaagattgagcgccgcaattggaaaggcctgggaggagggcgtgtgcggtataaggtccgctactcggctggaaaacatcatgtggaaacagatttctaacgagctcaatcatatcctgttagaaaacgacatgaagttcaccgtagtcgtgggcgatgttgccgggattctggcacagggcaaaaagatgatccgccctcaacccatggagtacaaatattcgtggaaaagctggggcaaggctaagataatcggggccgacgtgcagaatacaacttttattatcgatggaccaaacacccctgaatgtcccgacgatcagagagcgtggaatatttgggaggtcgaggactacggcttcggtatctttacaacgaacatatggcttaagttgagggattcctatacccaggtgtgcgaccaccgtctcatgtcagccgctattaaagatagtaaggcagttcacgccgacatggggtactggatcgaatctgagaaaaatgaaacttggaagctggctcgggccagcttcattgaggtgaagacatgtatctggccaaaatcccataccctatggtcaaacggagtactggaaagcgagatgataatccccaagatttatggcggtcctatctctcaacacaattaccgaccaggctacttcactcagacagcagggccgtggcatctcggaaaactggagcttgattttgacttgtgcgaaggcaccacggtcgtggtggatgagcactgcgggaacagaggaccctccctgaggactaccacagtcaccggcaagattatccacgaatggtgttgccgcagttgtactttacctccactccggttcagaggtgaggacgggtgctggtatggaatggagataaggcccgttaaagaaaaggaggaaaatctggtgaagtccatggtatctgcgggctccggtgaggtggactcatttagtcttggcctgttgtgtattagcatcatgatcgaagaggtcatgcgctcgcgatggtcccggaaaatgctcatgacagggaccctggccgtgttctttctactgattatgggacagctcacatggaacgatctgatccgtctttgcattatggttggcgctaatgcctctgacagaatggggatgggaactacctacttggcactgatggctacgttcaagatgaggcctatgtttgccgtgggcttactcttccgccggctgacaagcagagaggtccttctgctaaccataggtctctcactggtggcaagtgttgaattgccaaactccctggaggaattaggggatggactcgccatgggcatcatgattctgaaacttctgactgactttcaatctcatcagttgtgggtgaccctcctgagcctaacattcatcaagactaccttttccctgcactatgcttggaaaacgatggcgatggtcctttcaattgtaagcctcttccccctgtgtttgagtacaacctctcagaagactacatggctgccggtgttactcggctccctggggtgcaagcctcttaccatgtttctgatcgccgagaataaaatatggggaaggcgaagctggccattgaacgaaggtatcatggcagttggcattgtgtcgatcctcctgtcatctctactgaagaacgatgtcccccttgctgggcctctcattgccggaggcatgctgatcgcctgttacgtgataagtggttccagcgctgacttgtctttagagaaagcagccgaggtaagctgggaagaggaagcggagcattccggggcttcacacaatattctggtggaagtccaggatgacggaactatgaagatcaaagatgaggagcgcgacgatacactcaccatcctgcttaaggccacgctgttggcagttagtggcgtgtatcccctaagcattccagccactctgttcgtgtggtacttctggcagaaaaagaagcagcggtctggcgtcctctgggacaccccttcacccccagaagtggagagagctgttctggatgacgggatatataggatcatgcagcgtggacttttaggtcgcagccaggtaggcgtgggggtctttcaagaaaacgtgttccatacaatgtggcacgttacccggggagcagtgctgatgtaccagggcaaaagactcgagccgagttgggccagcgtcaagaaagacttgatttcctacggtgggggatggaggctgcagggctcttggaatacaggcgaggaagtgcaggtaatcgcggtcgagcctgggaagaaccccaaaaatgtgcaaactgctccaggaacctttaagacgcccgaaggtgaggttggcgccattgcactcgatttcaagcctgggacatcgggaagcccaatcgtgaaccgagaaggcaaaatagtcggtctgtatgggaatggagtggttactacctcaggcacatacgtgtccgccatcgctcaggccaaggcaagtcaggagggcccccttcctgagattgaagacgaggtctttcggaaacgcaacctgaccatcatggatttgcacccggggtctggaaagactagaaggtatctaccagctattgtgcgggaagccatcaaacgaaagctgagaaccctcatattagcgcccacacgcgtagtggccagcgagatggcagaagctctgaagggtatgcctattaggtaccaaacgactgccgttaaatccgagcataccggcaaggagatcgtcgaccttatgtgccacgctacattcaccatgcgtctgctctcaccagtgcgggtgcccaattataacatgatcattatggatgaagcacattttactgacccttctagcatcgccgccagagggtacataagtacaagggtcggaatgggcgaggctgcggcaattttcatgaccgccacgccgcccggttccgtagaggcttttccacagagcaatgccgtgatccaggatgaggaacgcgacattcctgagcgatcttggaactcagggtatgagtggatcactgatttccccggaaaaacagtttggtttgtgccatccataaagagtggcaatgacattgcaaactgtttgaggaaaaatggcaagcgggtcatccagctgagcaggaagaccttcgataccgaataccagaaaactaagaacaacgactgggactacgtggttacaaccgatatctcggagatgggggccaatttccgcgctgaccgtgtgattgatcctagacggtgcctcaaacccgtcatcctgaaggacggaccagaaagggtgattcttgcgggtccgatgcctgtaacagtggcctctgcagctcagcgccgaggcagaatagggcggaaccacaataaagagggagatcagtatatctacatgggccagcccctaaacaatgacgaggatcatgcccactggactgaagcaaagatgctgttggacaacattaatacgccagagggtatcatccccgccttatttgaacctgagagggaaaagtccgctgccattgatggggagtatcgcctgagaggcgaggcgaggaaaaccttcgttgaactcatgcggcgtggagacctgccagtctggcttagctacaaggtggcatcagagggctttcaatatagtgatcgccgatggtgcttcgacggggaaagaaacaatcaggtgctggaggaaaacatggatgtcgagatatggacaaaagagggagaaaggaagaaactccggccccgctggttggacgccagaacttactctgaccctctggctctaagggagtttaaggagttcgccgctggtcggcgatccgttagcggcgatctgatctcagagattgggaaactcccgcagcaccttacccagagagcacaaaatgccctggacaacttagtgatgttgcataatagtgaacagggaggccgcgcttataggcacgccatggaggagctgccagatacaatcgaaaccctcatgctgcttgcactgattgcggtactcactggtggggtgacgttgtttttcctgagcggccggggattaggcaagacctccatcgggctactgtgtgtcatggcctctagcgtgctcctttggatggcttccgttgagccccattggatagccgcatcaatcattctggaatttttcttgatggtgctgctcatccctgagcccgaccgtcagagaacaccacaggataaccaactggcttacgtcgtaattggacttctctttatgatcctgactgtggccgcaaatgagatgggtttgctggaaaccacaaagaaagacttaggcatagggcacgttgccgtggagaaccaccatcacgctgcgatgctagatgtcgacctgcatcctgcctctgcatggaccctctacgctgtggccactacaattatcacgcccatgatgaggcacaccattgaaaacactacagccaatatcagtcttaccgcaatagctaaccaggccgcgatcctgatgggattggataagggctggccaatttcgaaaatggacatcggtgtccctctgctcgctctggggtgctatagccaggtgaatccgcttaccttaacagccgcagttctgatgctcgtggcccattacgctattatcggccccggattgcaagcaaaggccactcgcgaggcgcagaaacggacggctgccggcataatgaagaacccaaccgtagatgggattgtggcaatcgacctggatcctgtcgtttatgacgccaagttcgaaaaacagctaggacagatcatgctgctcattctttgtacatcccaaatcctgttgatgcgaactacctgggctctgtgcgagtctataacactcgccaccggccccctgactacgttatgggagggttcaccagggaagttttggaatacaaccattgcagtgagcatggctaacatcttcagaggatcctaccttgccggcgcgggtctggccttcagtctcatgaaatctctaggcgggggaaggcgcggcactggggcacagggagaaaccctgggcgagaagtggaaacggcagttgaatcagctgagcaagtcagaatttaacacatataagagatccggtattatggaggtcgaccgtagtgaagctaaagaggggctcaagaggggagagactaccaaacacgccgtgagccggggcacagcaaaacttcgctggttcgtagaacgaaatctggtgaaacctgagggtaaggttatcgatttgggctgtgggagaggaggctggtcttactattgcgctgggctgaagaaagtgacggaagtcaagggatacaccaaaggcggtcccgggcacgaggaaccgataccaatggccacttacggatggaacctcgtgaagttacattccggcaaagacgtctttttcatccctcccgagaagtgtgatacactgctttgcgacattggcgagtcaagcccaaatcccaccatcgaagaggggaggactctgcgggtgctaaaaatggttgaaccttggctccgcggaaaccaattttgtattaagatcctgaatccgtatatgccctcggtagtggagacattggagcagatgcagagaaagcacggtggcatgctggtcaggaacccactctctcgaaatagtacccatgaaatgtactgggtgtcctgcgggacgggaaacattgttagcgccgtgaatatgacctcacggatgcttctgaaccgtttcacaatggcgcacagaaaacctacttatgagcgcgatgtcgacttaggcgctggtaccaggcacgtggcagtagaacccgaggtggccaacctggatatcatagggcagcggattgaaaatatcaagcatgagcacaaatccacatggcattacgacgaggataacccttataagacttgggcttaccacggatcttatgaagttaaaccaagcggcagtgcctccagcatggtcaatggcgtggtgaagttgctcaccaagccctgggacgtcatccctatggttacacaaattgcaatgaccgatactacgccatttgggcagcagagagtgttcaaagagaaggtagacacacgcacccccaaagccaagaggggaactgctcaaataatggaagtgaccgcgaaatggctgtggggttttctatctcgaaacaagaagccgcggatctgtacaagagaggagttcacgaggaaagtccgctcaaatgccgcaattggcgctgtgtttgttgacgagaaccagtggaatagtgccaaggaggcagtggaagatgagcgtttctgggaccttgtccatcgggaaagagagctgcacaaacaggggaagtgcgcaacctgcgtgtacaacatgatgggaaaaagggaaaagaagctcggcgagtttggtaaagctaaggggtcccgcgccatctggtacatgtggctgggagcgcgattcttggagttcgaagcactgggctttatgaatgaggatcactggttcagccgggaaaactctctctcgggcgtagagggggagggacttcataaactgggttatattttaagagacatctcaaagatacctggcgggaatatgtacgccgatgacactgctggatgggatacaaggatcaccgaagacgatctgcagaacgaggcccgcattactgacatcatggaaccagagcacgcattgctcgctaaaagcatttttaagctgacatatcaaaataaagttgtgagagtccagcggcccgccaagaacggcaccgtgatggatgtgatctccaggcgtgaccagcgaggtagtgggcaggtcggaacatacggcctaaatactttcaccaacatggaagctcaacttatacgccagatggagtctgagggcatttttagcccttccgaactggagacgccaaacctcgccgaaagagttctggattggttggagaagtatgggatcgaacggttaaaaaggatggcaatctcaggagacgactgtgtggtaaagcccattgatgaccgcttcgcgaccgccctgacagctctcaatgatatgggtaaagtgagaaaggacataccgcagtgggagcctagtaaaggctggaacgattggcagcaagtccccttttgctctcatcacttccaccagcttatcatgaaggacgggcgggagattgtggttccatgtaggaatcaggatgaactggtgggacgagcccgtgtcagccagggcgcaggttggtccctaagagagactgcttgcctggggaagtcatacgcccaaatgtggcagctcatgtattttcatcgccgggacttgaggctggcagccaacgcgatctgtagcgctgtgcctgtagattggattcccacctctagaacaacttggtccatccacgcccatcaccagtggatgaccacggaagacatgcttagtgtttggaatcgcgtgtggatagaggaaaacccatggatggaggataaaacacatatcagctcgtggggagacgtcccctacctgggcaagcgggaggaccaatggtgcggctccctcattgggttaaccgcaagggccacttgggctacaaatatccaggtggccattaaccaggttcgaagactgatcggaaatgaaaactacttggattatatgacctctatgaaacggttcaagaatgagtcagaccctgaaggtgcactgtggtga

SEQ ID NO: 13578 - RNA, 9879 nt, synthetic construct
  misc_feature 1..9879: note = derived and/or modified CDS sequence (opt3) from DENV-1__EU726781__SS-prME
  source 1..9879: mol_type = other RNA
agcgtgaccatgctgctcatgcttatgcccaccgcactggctttccacttgactacgagaggcggggaacctcatatgatcgtctccaagcaggaaaggggaaaatctttactgtttaagacctcagccggtgttaacatgtgcacactaattgccatggacctcggcgagttctgtgaagatactatgacctacaaatgcccacggataacagaggcggaaccggacgatgtggactgttggtgcaatgctaccgatacttgggtaacatatgggacctgtagtcagacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaagacgcaaactttgtttgccgccgaacattcgtggatagaggctggggtaatgggtgtggactgtttggcaaaggctccttgataacttgcgctaagttcaagtgcgtaaccaaactcgaggggaagacagtgcagtacgaaaacctgaaatattcagtcattgtgaccgttcacactggagaccagcatcaagtgggtaatgagagtacggaacacggcacaaccgccactatcacaccccaggcgcctagcacagagattcagttaaccgactacggggccctgactctcgattgttctccaaggacaggacttgactttaacgaaatggtcctgttgacgatgaaggagaaatcctggctagtgcataagcagtggttcctggatctcccgctgccctggacctcaggcgcaagcacaagtcaagagacatggaatcggaaagaccttctggtaacctttaagacagctcacgccaagaaacaggaagttgtggtcttgggttctcaggagggggctatgcacactgccctcaccggcgcaacggaaatccaaacctccggaacaactaccatcttcgccggccatctgaagtgccgtttaaaaatggataagctgacactaaaagggatgagctatgtgatgtgtactggatcgttcaagctcgagaaggaagtcgctgagacccagcacggtacggtgctggttcagattaaatacgagggcacagacgcgccttgcaagataccattttctacccaggatgaaaaaggggtgactcaaaacggacgccttatcacagcaaatcccattgtaaccgacaaggagaaacctgtcaacatcgaagccgagccacccttcggcgagtcctatatagtgattggtgctggggaaaaggccttgaagctgtcatggtttaaaaagggcagtagcatcggaaaaatgttcgaggcaactgccagaggcgctaggcggatggccatcctcggggataccgcatgggactttggatccattggtggcgttttcacatctgtggggaagctggtccatcagatctttggaacggcgtacggcgtgcttttcagcggtgtatcatggaccatgaaaattgggataggcgtgctgttgacttggctcggactgaatagtcgatccactagcttatctatgacctgtatcgttgtcggcctggtgacactatacctcggggtgatggtccaggctgattcaggatgcgttattaactggaagggccgcgaactgaagtgtggtagtgggatctttgtgactaatgaggtgcacacctggacggaacagtataaattccaagccgacagcccgaagagactttccgcagccatcggaaaggcttgggaggagggcgtatgcggtattaggtctgccacacggttggaaaacataatgtggaagcagatctcgaacgagctgaatcatattctcctggaaaacgacatgaaatttaccgtcgtggttggcgatgtggcagggatcttagctcagggaaagaaaatgattcgccctcagcccatggagtacaagtatagctggaagtcctggggcaaagccaagatcataggggcggacgtccaaaatactaccttcatcattgatggaccaaacacacctgaatgtcccgacgatcagagagcctggaatatctgggaggtggaggactacggctttggtattttcactaccaacatctggctgaaacttagggattcatatacacaggtttgcgaccaccgtttgatgagtgctgcaataaaggattctaaagccgtgcacgctgacatggggtactggattgaaagcgagaagaatgaaacgtggaagctcgcccgggcatccttcatcgaggtaaaaacctgtatttggccaaagtcacatactctgtggagcaacggagtcctagaatctgagatgatcatacccaaaaattatggcggtcctatctcccagcacaactaccgaccaggctactttacacaaaccgcggggccgtggcatctgggaaagctcgagctggatttcgacctttgcgaaggcactacagtggtggtcgatgagcactgcgggaatagaggacccagtttgaggaccacgactgttaccggcaaaattatccacgaatggtgttgccgcagctgtacactgcctccattacggtttaagggtgaggacgggtgctggtatggaatggagattagacccgtgaaggaaaaagaggaaaacctcgtaaagtctatggtgtccgccggctcaggtgaggtcgacagtttcagcctgggccttctgtgtatctcgataatgattgaagaggtgatgaggtcccgctggtctcgaaaaatgttgatgaccgggactctcgctgttctgtttctactgatcatgggacagctcacatggaatgatctgatccggctttgcattatggtgggcgccaacgcaagcgaccgtatggggatgggaaccacatacttggctctgatggccactttcaagatgagacctatgtttgcagtcggcttactcttcaggcgcctgacctcacgggaggtgcttctgctaacgatcggtctcagtctggttgcctccgtggaattgccaaattctctggaggaattaggggatggactcgctatgggcattatgatactgaaacttctgacagactttcagagccatcaattgtgggcgaccctcctgtccctaactttcatcaagaccacattttcactgcactatgcctggaagactatggcaatggtccttagcattgtaagtctcttccccctgtgtttgtctaccacgtcccagaaaacaacctggctgccggtgttactcggcagcctggggtgcaagcctcttactatgtttctgatcgctgagaacaaaatttggggaagaaagtcgtggccattgaacgaaggtatcatggccgttggcatagtgtcaatcctcctgtctagtctactgaaaaatgatgtcccccttgccgggcctctcattgctggaggcatgctgatcgcatgttacgtgatttccggtagctctgccgacttgagcttagagaaggcggctgaggtatcctgggaagaggaagccgagcattcaggggcaagtcacaacatcctggtggaagtccaggatgacggaacaatgaaaataaaggatgaggagagggacgataccctcactattctgcttaaggccacactgttggctgttagcggcgtgtatcccctatctatcccagcaaccctgttcgtgtggtacttctggcagaaaaagaaacaacgatccggcgtcctctgggacacgccttcacccccagaagtggagcgcgccgttctggatgacgggatctatcggattatgcagagaggacttttaggtaggagtcaggtaggcgtgggggtctttcaggaaaatgtgttccatactatgtggcacgttacccgtggagcggtgctgatgtaccaaggcaagcgcctcgagccgagctgggcttccgtcaaaaaggacttgatatcttacggtgggggatggcggctgcagggctcgtggaacacaggcgaggaagtgcaggtaatcgccgtcgagcctgggaagaatcccaaaaacgtgcagaccgcaccaggaacatttaagactagcgaaggtgaggttggcgccattgctctcgatttcaaacccgggacctcaggatcccctatcgtgaatagagaaggcaagattgtcggtctgtatgggaacggagtggttacgacaagtggcacttacgtgtctgccatcgcacaagctaaagccagccaggagggcccacttcccgagatagaagacgaggtctttaggaagcgaaatctgaccatcatggatttgcaccctgggtccggaaagacacggcgctatctaccggcgattgtgagagaagccatcaaaaggaagctgcggaccctcattttagcaccaactcgagtagtggcttcagagatggccgaagctctgaaaggtatgcccatcagataccagaccacagcagttaagtctgagcatacgggcaaagagatagtcgaccttatgtgccacgccactttcaccatgcgcctgctcagccctgtgagggtgccaaactataatatgattatcatggatgaagcccattttacagaccccagttccatcgctgcgcgtgggtacattagcacccgggtcggaatgggcgaggcagccgctatcttcatgactgccacacctccgggttctgtagaagcatttccccaatcaaacgccgtgatacaggatgaggaaagagacattccagagaggtcctggaatagtgggtatgagtggatcaccgatttccctggaaagacggtttggtttgtgcccagcattaagtcgggcaacgacatcgctaattgtttgcgcaaaaacggcaagcgagtcatacagctgtctagaaaaactttcgatacagaataccagaagaccaaaaacaatgactgggactacgtggttaccactgatatttccgagatgggggcgaacttccgggccgacagggtgatcgatccacgccgttgcctcaagcctgtcatcctgaaggacggacccgaaagagtgattcttgcaggtccaatgccggtaacagtggctagcgccgcacaacggaggggccgcatcgggcgaaatcacaacaaagagggagatcagtatatttacatgggccagcctctaaataacgacgaggatcatgcccactggaccgaagctaagatgctgttggacaatataaacacacccgagggtatcattccagccttatttgaacccgagagagaaaaatcagcggcaatcgatggggagtatcggctgaggggcgaggcccgcaagactttcgttgaactcatgagaaggggagacctgcctgtctggcttagttacaaagtggcttctgagggctttcagtattccgatcggcgttggtgcttcgacggggaacgcaataaccaagtgctggaggaaaatatggatgtcgagatctggacgaaggagggagaacgaaagaaactcagaccaaggtggttggacgcccggacctacagcgaccccctggctctacgcgagtttaaagagttcgcagccggtagaaggtcagttagtggcgatctgattctcgagatagggaaacttcctcagcacctgacacagcgggctcagaacgccttagacaatttggtgatgctgcataacagcgaacaaggaggccgagcatatagacacgcgatggaggagctcccggatactatcgaaaccctgatgcttctggccctcattgctgtattgacaggtggggtgaccctgtttttcttatccggccgcggactaggcaagacttctatcgggctgctctgtgtcatggccagctccgtgcttctgtggatggcatcagttgagccacattggattgctgcctctatcatattggaatttttcctgatggtgctcctgatccccgagcctgacaggcagcggacgccccaggataatcagcttgcatacgtcgtaattggactcctgtttatgatcttgaccgtggccgctaacgagatgggtctgttagaaacaactaaaaaggacctaggcattgggcacgttgcggtggagaaccaccatcacgccgcaatgctggatgtcgacctccatccagctagtgcctggaccctttacgccgtggcaacaaccatcataactcctatgatgcgtcacacaattgaaaatacgaccgctaacatctcgctgactgccattgcgaatcaagctgccatcttgatgggactggataaaggctggcccataagcaagatggacatcggtgtcccactcctggcacttgggtgctattcccaggtgaaccctttaacactgaccgccgctgttctcatgttggtggcacattacgccattatcggcccgggactgcaggcgaaggctaccagagaggcccagaagaggacagcagccggcattatgaagaatcccactgtagatgggatcgtggctatagacctagatccagtcgtttatgacgccaaattcgaaaagcagctgggacagattatgctccttatcctgtgtacgtctcagatcttgctgatgcgcaccacatgggcactctgcgagtcaattactctggctaccggccctttaacaaccctttgggagggtagccccgggaaattttggaacactacgatcgccgtgtccatggcgaatatattccggggaagttacctggccggcgcaggtctcgctttctctctaatgaaaagcctgggcgggggacgaagaggcacaggggcccaaggagaaaccttgggcgagaagtggaaaaggcagctgaaccagctctcaaagtccgaatttaatacttataaacgcagtggtattatggaggtcgaccggagcgaagcaaaggaggggcttaaaagaggagagaccacaaagcacgctgtgtctcgtggcactgccaagctgaggtggttcgtagaacggaacttggtgaaaccagagggtaaggttatcgatctgggctgtgggcgcggaggctggtcctactattgcgccgggctcaaaaaggtgaccgaagtcaaaggatacacaaagggcggtcctgggcacgaggaacccattccgatggcgacgtacggatggaatttagtgaaactgcattcaggcaaggacgtctttttcatcccacctgagaagtgtgatacccttctgtgcgacataggcgagagctcgcccaacccaactatcgaagaggggcgaacactaagagtgctcaaaatggttgaaccctggctgaggggaaatcagttttgtattaagatcttgaacccttatatgccgtctgtagtggagaccctggagcaaatgcagcggaaacacggtggcatgctcgtccgcaatccccttagtagaaactccactcatgaaatgtactgggtgagctgcgggacaggaaatattgtttcagctgtgaacatgacctccaggatgctgttaaaccgattcacgatggcacaccggaagccaacctatgagcgtgatgtcgacctgggcgccggtacaagacacgtggctgtagaacctgaggtggccaatttggatatcattgggcagcgcatcgaaaacataaaacatgagcacaagtctacttggcattacgacgaggataatccctataagacctgggcataccacggaagctatgaagttaaacctagtggctccgccagctctatggtcaacggcgtggtgaagctcctgacaaaaccatgggacgtcattcccatggttactcagatcgctatgaccgatacaaccccttttgggcaacagagggtgttcaaggagaaagtagacactcggacgccaaaggcgaagagaggaacagcccagatcatggaagtgaccgcaaaatggctatggggttttctttcacgcaataagaaacccaggatttgtactcgagaggagttcacccggaaggtcagaagtaacgctgccataggcgcagtgtttgttgacgagaatcaatggaactccgccaaagaggctgtggaagatgagaggttctgggacctggtccatcgcgaacgtgagctccacaagcaggggaagtgcgccacatgcgtgtacaatatgatgggaaaacgggaaaagaaactgggcgagtttggtaaggcgaaagggagcagagcaatctggtacatgtggttgggagccaggttcctggagttcgaagctctcggctttatgaacgaggatcactggttctctcgcgaaaattcgctttcaggcgtagagggggagggactgcataagttaggttatattctgcgagacatcagcaaaattccgggcgggaacatgtacgccgatgacacggcaggatgggatacccggatcactgaagacgatttgcagaatgaggctaagataacagacatcatggaacctgagcacgccctcctggctaagtccatttttaaactaacctatcagaacaaggttgtgagagtccaaaggccagccaaaaatggcactgtgatggatgtgatcagtcgcagagaccagcggggttctgggcaggtcggaacatacggccttaacaccttcacaaacatggaagcacagctgattaggcaaatggagagcgagggcatcttttccccctcagaactcgagactcctaatctggcggggcgtgttttggattggttagaaaagcatggagtggagcgactgaaacgcatggccataagtggtgacgactgtgtagtgaagccaattgatgacagattcgctaccgccctcacggcacttaacgatatgggcaaggtccggaaagacatcccccagtgggaaccgtctaaggggtggaatgattggcaacaggtgcctttttgcagccaccacttccatcaactgatcatgaaagacggaagggagattgttgtgccctgtcgcaaccaggatgagctagtcggcagagctcgggtgtcccagggtgccgggtggtcactgagggaaaccgcatgcctcggaaagagctatgcccagatgtggcaattgatgtactttcaccgacgtgacctgagacttgcggctaatgccatatgttctgcagtaccagttgattgggtgcctacatcccgcactacctggagtatccatgcccaccatcagtggatgacaactgaggacatgctgagcgtctggaaccgggtgtggattgaagagaatccctggatggaagataaaacccacatctcgtcctggggcgacgttccatatctcggcaagagggaggaccagtggtgcgggtctttaattggactgacggctagagccacatgggcaaccaacatccaagtggctataaatcaggtccgccggttgatcggtaacgagaattacctggattacatgacttcaatgaagaggttcaaaaacgaaagcgaccccgagggcgccctctggtga

SEQ ID NO: 13579 - RNA, 9879 nt, synthetic construct
  misc_feature 1..9879: note = derived and/or modified CDS sequence (opt3) from DENV-1__EU726782__SS-prME
  source 1..9879: mol_type = other RNA
agcgtgaccatgctgctcatgcttatgcccacggccctggctttccacttgactacgagaggaggggaacctcatatgatcgtctccaagcaggaaagagggaaatctttactgtttaagacctcagccggtgttaatatgtgcacactaattgccatggacctcggagagctgtgtgaagatactatgacctacaaatgcccacggataacagagaccgaaccggacgatgtggactgttggtgcaatgcgactgatacatgggtaacctatgggacgtgtagtcaaactggggagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccggcagcttcaaactggagaaggaagtcgccgagacgcagcacggtacagtgcttgttcagataaagtacgagggcaccgacgctccttgcaaaatcccattcttgactcaagatgaaaagggggtgacacagaacggacgcctgattaccgcgaatcccatcgtaactgacaaagagaagcctgtcaacatagaagcagagccaccctttggcgagtcgtatattatcatcggtgccggggaaaaagctctcaagctgtcttggttcaagaaaggctcctcaattggaaagatgtttgaggccaccgcaagaggcgccaggcggatggctatccttggggatacagcctgggacttcggaagtattggtggcgtgtttacgagcgttgggaaactggtgcatcagatattcggaaccgcatacggcgtcttgttttccggtgtgtcttggactatgaagatcgggattggcgtactcctgacatggttaggactgaatagccgatcaaccagtctatccatgacatgtatcgcggtgggcctcgttactctgtaccttggggtcatggtgcaggctgatagcggatgcgtgatcaactggaaaggccgcgaattgaagtgtggttctgggattttcgtcaccaatgaggttcacacgtggacagaacaatataagtttcaggccgactcaccgaaaagactgagtgcagccataggaaaggcttgggaggagggcgtgtgcggtatcaggagcgccacccggctcgaaaacattatgtggaaacagatctccaacgagctgaatcatattttactggaaaacgacatgaagttcactgtggtagtcggcgatgtggcagggatccttgctcagggcaagaagatgatacgccctcaacccatggagtacaaatattcttggaagtcgtggggcaaggccaaaatcattggggcggacgttcagaataccacatttatcattgatggaccaaacactcctgaatgtcccgacgatcagagagcctggaatatctgggaggtggaggactacggcttcggtatatttaccacaaacatttggttgaagctcagggatagctatacgcaggtctgcgaccaccgtctgatgtccgctgcaatcaaagattcaaaggccgtgcacgctgacatggggtactggattgaaagtgagaaaaatgaaacctggaagctagcccgggcatctttcatcgaggttaagacttgtatatggccaaaaagccatacactgtggtccaacggagtgctcgaatcagagatgatcattcccaagatctatggcggtcctattagccaacacaattaccgaccaggctacttcacccagactgcggggccgtggcatctgggaaaacttgagttggattttgacctgtgcgaaggcacaaccgtagtcgtggatgagcactgcgggaacagaggaccctctttaaggacgactaccgtgacaggcaagatcatacacgaatggtgttgccgctcctgtaccctccctccactgcggttcagaggtgaggacgggtgctggtatggaatggagattaggcccgtcaaagaaaaggaggaaaatcttgttaagagtatggtgagcgccggctctggtgaggtagactccttttcactgggcttgctctgtatcagtatcattatcgaagaggtgatgcgcagccgatggtcgcggaaaatgctgatgactgggacactagctgtcttctttctgctcattatgggacagctgacctggaacgatcttatacgtttgtgcatcatggtgggcgccaatgcatccgacagaatggggatgggaacaacttacctggctttaatggccaccttcaagatgaggcctatgtttgcagttggcctcctgttccgccggcttacgtctagagaggtgctgctactcacaattggtctgagcttggtcgcctcagtggaactgccaaacagtttagaggaactcggggatggactggctatgggcatcatgattcttaaactgttgaccgactttcaatcccatcagctctgggcgactctgctatctctgaccttcatcaagacaacttttagccttcactatgcctggaaaaccatggcaatggttctctccatagtgtcactgttccccttgtgtctgagcacgacaagtcagaagaccacttggttaccggtcctcctgggctctcttgggtgcaagcctctgacaatgtttttgatcgctgagaataaaatttggggaaggcgatcctggccactcaacgaaggtatcatggccgtaggcattgtgagcatcctgctatcgtcactgcttaagaacgatgttcccctcgccgggcctctgatagctggaggcatgttgattgcatgttacgtgatctctggtagttccgccgacttaagcctggagaaagcggctgaggtctcttgggaagaggaagccgagcatagcggggcatcccacaatatcctcgtggaagtacaggatgacggaaccatgaagattaaagatgaggagcgcgacgatactctgacaatacttctgaaggccaccttgctagctgtgtcaggcgtctatcccctgagtatcccagcaacactcttcgtttggtacttctggcagaagaagaagcagcggagcggcgtgctgtgggacactccttctcccccagaagtggagagagccgtccttgatgacgggatttataggatcatgcagcgtggattactgggtcgctcccaggtgggcgttggggtatttcaagaaaacgtgttccataccatgtggcacgtcacacggggagcggtgctcatgtaccagggcaaaagattggagccgtcatgggctagtgttaagaaagacctgattagctacggtgggggatggaggctccagggctcctggaataccggcgaggaagtgcaggtcatcgccgtggagcctgggaagaaccccaaaaatgtacaaacagcaccaggaacttttaagacccccgaaggtgaggtcggcgccatagctctggatttcaagcctgggacgtctggatcgccaatcgtgaaccgagaaggcaaaattgttggtctttatgggaatggagtggtcacaactagcggcacctacgtgtcagccatcgcacaggctaaggcctcccaggagggccccctgcctgagattgaagacgaggtttttcggaaacgcaacttgacaatcatggatctacacccggggagtggaaagaccagaaggtatctgccagcgatagtgcgggaagccattaaacgaaagctcagaactttaatcctggcacccacccgcgtcgtggcttctgagatggccgaagctcttaagggtatgcctatcaggtaccaaacaacggcagtaaaaagcgagcatactggcaaggagattgtggacctgatgtgccacgccaccttcacaatgcgtctcttgtccccagttcgggtccccaattataacatgatcataatggatgaagcccattttaccgacccttcatctattgctgcgagagggtacatcagcactagggtgggaatgggcgaggcagccgctattttcatgacagccaccccgcccggtagtgtggaagcatttccacagtccaatgccgtcatccaggatgaggaacgcgacatacctgagcgaagctggaactctgggtatgagtggattacggatttccccggaaaaactgtatggtttgtgccatcaatcaagtccggcaatgacatcgctaactgtctgaggaaaaatggcaagcgggttattcagctcagtaggaagacattcgataccgaataccagaaaaccaagaacaacgactgggactacgtggtcactacagatatcagcgagatgggggcgaatttccgcgccgaccgtgtgattgatcctagacggtgcctgaaacccgttatacttaaggacggaccagaaagggtgatcctagcaggtccgatgcctgtcaccgtggcttcggccgcacagcgccgaggcagaattgggcggaaccacaataaagagggagatcagtatatctacatgggccagcccctgaacaatgacgaggatcatgcccactggacagaagctaagatgttgttagacaacatcaatactccagagggtattatacccgccctgtttgaacctgagagggaaaagtctgcggcaatcgatggggagtatcgcctcagaggcgaggccaggaaaacgttcgtagaactgatgcggcgtggagaccttccagtgtggctgtcctacaaggttgctagcgagggctttcaatattcagatcgccgatggtgcttcgacggggaaagaaacaatcaggtcctcgaggaaaacatggatgtggagatttggaccaaagagggagaaaggaagaaattgcggccccgctggctggacgccagaacatacagtgaccctctagctctgagggagtttaaggagttcgcagccggtcggcgatctgtgtccggcgatctcatccttgagattgggaaactgccgcagcacttaactcagagagctcaaaatgccttggacaacctggtcatgctccataatagcgaacagggaggccgcgcatataggcacgcgatggaggagctgccagataccatcgaaacacttatgctgctcgccttgatagctgttctgaccggtggggtgactttatttttcctatcaggccggggactgggcaagacgagtatcgggctcctttgtgtaatggccagctccgtgctgttgtggatggcatctgtcgagccccattggattgctgccagcatcattctggaatttttcctcatggtgctgcttatccctgagcccgaccgtcagagaaccccacaggataaccaactcgcatacgttgtgataggactgttgtttatgattctgacagtcgccgctaatgagatgggtttactagaaactaccaagaaagacctgggcatcgggcacgtagcggtggagaaccaccatcacgccgcaatgctcgatgttgaccttcatcctgcttccgcctggacactgtacgccgtggcaaccactattatcacacccatgatgaggcacacgatagaaaacaccactgctaatatctcattgacagccattgcgaaccaggctgccatcctgatgggactcgataagggctggccaatttctaaaatggacatcggtgtccctctgcttgcattagggtgctatagtcaggtgaatccgctgaccctcaccgccgctgtcttgatgctggtggcacattacgccataattggccccggactacaagcgaaggctacacgcgaggcccagaaacggactgcagccggcatcatgaagaacccaacggttgatgggatcgtggctattgacctggatcctgtagtgtatgacgccaagttcgaaaaacagctcggacagatcatgcttctgatattgtgtacctcgcaaattctgctcatgcgaacaacttgggcactgtgcgagagcatcaccttagctacaggcccccttaccactctgtgggagggttccccagggaagttttggaatacgacaattgccgtctctatggcgaacatcttcagaggatcatacctcgccggcgcaggtctagctttcagcctgatgaaatccttgggcgggggaaggcgcggcaccggggcccagggagaaactctgggcgagaagtggaaacggcagctcaatcagcttagtaagtctgaatttaacacctataagagaagcggtataatggaggttgaccgttcagaagcaaaagaggggctgaagaggggagagacaactaaacacgctgtgtcccggggcaccgccaagttgcgctggttcgtcgaacgaaatctggtgaaacctgagggtaaggtaatcgatctcggctgtgggagaggaggctggagttactattgcgccgggttaaagaaagtgacagaagttaagggatacacgaaaggcggtcccgggcacgaggaaccgattccaatggcgacctacggatggaacctggtgaaacttcatagcggcaaagacgtctttttcatccctcccgagaagtgtgatactctgctatgcgacattggcgagtcttccccaaatcccacaatcgaagaggggaggaccctccgggtgctgaaaatggtcgaaccttggttgcgcggaaaccaattttgtattaagatcctgaatccgtatatgccctcagtggttgagactctcgagcagatgcagagaaagcacggtggcatgcttgtaaggaacccactgagccgaaattcgacacatgaaatgtactgggtgtcttgcgggaccggaaacatagtcagtgctgtgaatatgacgtcccggatgttactgaaccgtttcaccatggcacacagaaaacctacatatgagcgcgatgttgacttgggcgccggtactaggcacgtggctgtcgaacccgaggtggccaacctcgatattatcgggcagcggatcgaaaatattaagcatgagcacaaaagcacctggcattacgacgaggataacccttataagacatgggcataccacggatcatatgaagtaaaaccatccggctctgccagcagtatggtgaatggcgttgtcaagctgctaactaagccctgggacgtgatacctatggtgacccaaatcgctatgacagataccactccatttgggcagcagagagtcttcaaagagaaggttgacacgcgcacacccaaagcgaagaggggaaccgcccaaattatggaagtgactgcaaaatggctttggggttttctgtcccgaaacaagaagccgcggatctgtaccagagaggagttcacaaggaaagtacgcagcaatgctgccattggcgcagtgtttgtcgacgagaaccagtggaactctgccaaggaggctgtggaagatgagcgtttctgggacctcgttcatcgggaaagagagctgcacaaacaggggaagtgcgccacgtgcgtgtacaacatgatgggaaaaagggaaaagaagttgggcgagtttggtaaagcgaaggggtcacgcgcaatctggtacatgtggctgggagcccgattcctcgagttcgaagctcttggctttatgaatgaggatcactggttcagtcgggaaaactccctgagcggcgtcgagggggagggattacataaactgggttatatattgagagacatctctaagattcctggcgggaatatgtacgccgatgacaccgcaggatgggatactaggatcacagaagacgatctccagaacgaggctcgcattaccgacatcatggaaccagagcacgccctgctagctaaatcgatatttaaacttacttatcaaaataaagtggtaagagttcagcggcccgccaagaacggcacagtgatggatgtcatttcaaggcgtgaccagcgaggtagcggacaggtgggaacctacggcctgaatacattcactaacatggaagcacaactcatccgccagatggagtccgagggcatctttagtccttctgaactggagattccaaacttggcggaaagagtgttagattggctggagaagtatggggtcgaacggctcaaaaggatggccataagcggagacgactgtgttgtgaagcccatcgatgaccgcttcgctaccgcccttacggcactgaatgatatgggtaaagtaagaaaggacattccgcagtgggagccttccaaaggctggaacgattggcagcaagtgcccttttgctcacatcacttccaccagctaatcatgaaggacgggcgggagattgtcgtgccatgtaggaatcaggatgaactggttggacgagctcgtgtgagtcagggcgccggttggtctctcagagagaccgcatgcttgggaaagagctacgcccaaatgtggcagctgatgtattttcatcgccgggaccttaggctggcggctaacgccatctgttccgcagtccctgtggattggatacccacatcaagaactacctggagcatccacgcccatcaccagtggatgacaactgaagacatgctctctgtatggaatcgcgtttggattgaggaaaacccatggatggaggataaaacccatatctccagttggggagacgtgccctacttaggcaagcgggaggaccaatggtgcggcagcctgattgggttgacggctagggccacatgggcaaccaatatccaggtcgctattaaccaggtgcgaagactgataggaaatgaaaactacctcgattatatgacttcgatgaaacggttcaagaatgagggtgaccctgaaggcgccctttggtga

SEQ ID NO: 13580 - RNA, 9879 nt, synthetic construct
  misc_feature 1..9879: note = derived and/or modified CDS sequence (opt3) from DENV-1__EU677178__SS-prME
  source 1..9879: mol_type = other RNA
agcgtgaccatgctgctcatgcttatgcccacagccctggctttccacttgactacgagaggaggggaacctcatatgatcgtctccaagcaggaaagagggaaatctttactgtttaagacctcagccggtgttaatatgtgcacactaattgccatggacctcggagagctgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccggcagcttcaaactggagaaggaagtcgccgagacgcagcacggtacagtgcttgttcagataaagtacgagggcaccgacgctccttgcaaaatcccattcttgactcaagatgaaaagggggtgacacagaacggacgcctgattaccgcgaatcccatcgtaactgacaaagagaagcctgtcaacatagaagcagagccaccctttggcgagtcgtatattatcatcggtgccggggaaaaagctctcaagctgtcttggttcaagaaaggctcctcaattggaaagatgtttgaggccaccgcaagaggcgccaggcggatggctatccttggggatacagcctgggacttcggaagtattggtggcgtgtttacgagcgttgggaaactggtgcatcagatattcggaaccgcatacggcgtcttgttttccggtgtgtcttggactatgaagatcgggattggcgtactcctgacatggttaggactgaatagccgatcaaccagtctatccatgacatgtatcgcggtgggcctcgttactctgtaccttggggtcatggtgcaggctgatagcggatgcgtgatcaactggaaaggccgcgaattgaagtgtggttctgggattttcgtcaccaatgaggttcacacgtggacagaacaatataagtttcaggccgactcaccgaaaagactgagtgcagccataggaaaggcttgggaggagggcgtgtgcggtatcaggagcgccacccggctcgaaaacattatgtggaaacagatctccaacgagctgaatcatattttactggaaaacgacatgaagttcactgtggtagtcggcgatgtggcagggatccttgctcagggcaagaagatgatacgccctcaacccatggagtacaaatattcttggaagtcgtggggcaaggccaaaatcattggggcggacgttcagaataccacatttatcattgatggaccaaacactcctgaatgtcccgacgatcagagagcctggaatatctgggaggtggaggactacggcttcggtatatttaccacaaacatttggttgaagctcagggatagccacacgcaggtctgcgaccaccgtctgatgtccgctgcaatcaaagattcaaaggccgtgcatgctgacatggggtattggattgaaagtgagaaaaatgaaacctggaagctagcccgggcatctttcatcgaggttaagacttgtatatggccaaaaagccacacactgtggtccaacggagtgctcgaatcagagatgatcattcccaagatctacggcggtcctattagccaacataattatcgaccaggctacttcacccagactgcggggccgtggcacctgggaaaacttgagttggattttgacctgtgcgaaggcacaaccgtagtcgtggatgagcactgcgggaacagaggaccctctttaaggacgactaccgtgacaggcaagatcatacatgaatggtgttgccgctcctgtaccctccctccactgcggttcagaggtgaggacgggtgctggtacggaatggagattaggcccgtcaaagaaaaggaggaaaatcttgttaagagtatggtgagcgccggctctggtgaggtagactccttttcactgggcttgctctgtatcagtatcatgattgaagaggtgatgcgcagccgatggtcgcggaaaatgctgatgactgggacactagctgtcttctttctgctcatcatgggacagctgacctggaacgatcttattcgtttgtgcataatggtgggcgccaatacatccgacagaatggggatgggaactacctatctggcattaatggctacgttcaagatgaggcctatgtttgccgttggcctcctgttccgccggcttacatctagagaggtgctgctactcaccatcggtctgagcttggtcgcatcagtggaactgccaaacagtttagaggaactcggggatggactggccatgggcattatgatccttaaactgttgactgactttcaatcccaccagctctgggctaccctgctatctctgacattcattaagactacctttagccttcattacgcgtggaaaacgatggccatggttctctccatcgtgtcactgttccccttgtgtctgagcacaaccagtcagaagactacatggttaccggtcctcctgggctctcttgggtgcaagcctctgaccatgtttttgatagcagagaataaaatctggggaaggcgatcctggccactcaacgaaggtattatggctgtaggcatcgtgagcattctgctatcgtcactgcttaagaacgatgttcccctcgccgggcctctgatcgccggaggcatgttgatagcttgttatgtgatttctggtagttccgcagacttaagcctggagaaagccgcggaggtctcttgggaagaggaagctgagcacagcggggcctcccataatatcctcgtggaagtacaggatgacggaactatgaagatcaaagatgaggagcgcgacgatacactgaccattcttctgaaggcaacgttgctagccgtgtcaggcgtctaccccctgagtataccagctactctcttcgtttggtatttctggcagaagaagaagcagcggagcggcgtgctgtgggacaccccttctcccccagaagtggagagagcagtccttgatgacgggatctacaggattatgcagcgtggattactgggtcgctcccaggtgggcgttggggtatttcaagaaaacgtgttccacacaatgtggcacgtcacccggggagccgtgctcatgtatcagggcaaaagattggagccgtcatgggcgagtgttaagaaagacctgatcagctacggtgggggatggaggctccagggctcctggaatacaggcgaggaagtgcaggtcattgctgtggagcctgggaagaaccccaaaaatgtacaaactgccccaggaacctttaagacgcccgaaggtgaggtcggcgcaatcgccctggatttcaagcctgggacatctggatcgccaatagtgaaccgagaaggcaaaatcgttggtctttacgggaatggagtggtcactaccagcggcacatatgtgtcagctattgcccaggcaaaggcttcccaggagggccccctgcctgagatcgaagacgaggtttttcggaaacgcaacttgaccattatggatctacatccggggagtggaaagactagaaggtacctgccagccatcgtgcgggaagcgataaaacgaaagctcagaaccttaattctggcccccacacgcgtcgtggcatctgagatggctgaagcccttaagggtatgcctatcaggtatcaaacgactgctgtaaaaagcgagcacaccggcaaggagatcgtggacctgatgtgccatgcaacattcaccatgcgtctcttgtccccagttcgggtccccaattacaacatgattatcatggatgaagcccactttactgacccttcatctatagccgctagagggtatattagcacaagggtgggaatgggcgaggcggcagccatcttcatgaccgctacgccgcccggtagtgtggaagcctttccacagtccaatgcagtcattcaggatgaggaacgcgacatccctgagcgaagctggaactctgggtacgagtggataactgatttccccggaaaaacagtatggtttgtgccatcaattaagtccggcaatgacatcgccaactgtctgaggaaaaatggcaagcgggttatccagctcagtaggaagaccttcgataccgaatatcagaaaactaagaacaacgactgggactacgtggtcacaaccgatattagcgagatgggggctaatttccgcgcggaccgtgtgatcgatcctagacggtgcctgaaacccgttattcttaaggacggaccagaaagggtgatactagccggtccgatgcctgtcacagtggcatcggctgcccagcgccgaggcagaatcgggcggaaccataataaagagggagatcagtacatttatatgggccagcccctgaacaatgacgaggatcacgcacactggactgaagccaagatgttgttagacaacatcaatacgccagagggtatcattcccgctctgtttgaacctgagagggaaaagtctgccgcgatagatggggagtaccgcctcagaggcgaggcaaggaaaaccttcgtagaactgatgcggcgtggagaccttccagtgtggctgtcctataaggttgccagcgagggctttcaatactcagatcgccgatggtgcttcgacggggaaagaaacaatcaggtcctcgaggaaaacatggatgtggagatctggacaaaagagggagaaaggaagaaattgcggccccgctggctggacgctagaacttatagtgaccctctagccctgagggagtttaaggagttcgctgcaggtcggcgatctgtgtccggcgatctcattcttgagatcgggaaactgccgcagcatttaacccagagagcccaaaatgctttggacaacctggtcatgctccacaatagcgaacagggaggccgcgcctacaggcatgcaatggaggagctgccagatacaattgaaacccttatgctgctcgcgttgatcgccgttctgactggtggggtgacgttatttttcctatcaggccggggactgggcaagaccagtatagggctcctttgtgtaatggctagctccgtgctgttgtggatggcctctgtcgagccccactggatcgcagctagcattatcctggaatttttcctcatggtgctgcttattcctgagcccgaccgtcagagaacaccacaggataaccaactcgcctatgttgtgatcggactgttgtttatgatactgactgtcgcagccaatgagatgggtttactagaaaccacaaagaaagacctgggcattgggcacgtagctgtggagaaccatcaccatgcggccatgctcgatgttgaccttcaccctgcatccgcttggaccctgtacgccgtggccactacaatcattacgcccatgatgaggcataccatcgaaaacactacagcaaatatatcattgaccgctatcgccaaccaggcggctattctgatgggactcgataagggctggccaatctctaaaatggacattggtgtccctctgcttgccttagggtgctacagtcaggtgaatccgctgaccctcacagcagccgtcttgatgctggtggctcactatgcaatcataggccccggactacaagccaaggcgactcgcgaggctcagaaacggacggccgcaggcattatgaagaacccaaccgttgatgggatcgtggccatcgacctggatcctgtagtgtacgacgctaagttcgaaaaacagctcggacagattatgcttctgatcttgtgtacatcgcaaatactgctcatgcgaactacctgggccctgtgcgagagcattacattagcaaccggcccccttactacgctgtgggagggttccccagggaagttttggaatacaaccatcgctgtctctatggccaacattttcagaggatcatatctcgcgggcgccggtctagcattcagcctgatgaaatccttgggcgggggaaggcgcggcactggggctcagggagaaaccctgggcgagaagtggaaacggcagctcaatcagcttagtaagtctgaatttaacacatacaagagaagcggtatcatggaggttgaccgttcagaagccaaagaggggctgaagaggggagagactaccaaacacgcagtgtcccggggcacagctaagttgcgctggttcgtcgaacgaaatctggtgaaacctgagggtaaggtaatagatctcggctgtgggagaggaggctggagttattactgcgccgggttaaagaaagtgacggaagttaagggatataccaaaggcggtcccgggcatgaggaaccgatcccaatggccacttacggatggaacctggtgaaacttcacagcggcaaagacgtctttttcattcctcccgagaagtgtgatacactgctatgcgacatcggcgagtcttccccaaatcccaccattgaagaggggaggactctccgggtgctgaaaatggtcgaaccttggttgcgcggaaaccaattttgtatcaagattctgaatccgtacatgccctcagtggttgagacactcgagcagatgcagagaaagcatggtggcatgcttgtaaggaacccactgagccgaaattcgacccacgaaatgtattgggtgtcttgcgggacgggaaacatcgtcagtgcggtgaatatgacctcccggatgttactgaaccgtttcacaatggctcacagaaaacctacttacgagcgcgatgttgacttgggcgcaggtaccaggcatgtggccgtcgaacccgagatagctaacctcgatattatcgggcagcggatcgaaaatattaagcacgagcataaaagcacatggcactatgacgaggataacccttacaagacttgggcctatcatggatcatacgaagtgaaaccatccggctctgcaagcagtatggtaaatggcgtggttaagctgctaaccaagccctgggacgtcatacctatggtgacacaaatcgccatgaccgatactacgccatttgggcagcagagagtgttcaaagagaaggtcgacacacgcacccccaaagctaagaggggaactgcgcaaattatggaagttaccgccaaatggctttggggttttctgtcccgaaacaagaagccgcggatctgtacaagagaggagttcacgaggaaagtgcgcagcaatgcagctattggcgccgtatttgtggacgagaaccagtggaactctgcaaaggaggccgtcgaagatgagcgtttctgggacctcgtgcaccgggaaagagagctgcacaaacaggggaagtgcgctacctgcgtttataacatgatgggaaaaagggaaaagaagttgggcgagtttggtaaagccaaggggtcacgcgcgatctggtacatgtggctgggagcacgattcctcgagttcgaagcccttggctttatgaatgaggatcattggttcagtcgggaaaactccctgagcggcgtggagggggagggattacacaaactgggttacatattgagagacatctctaagattcctggcgggaatatgtatgctgatgacactgccggatgggatacaaggatcaccgaagacgatctccagaacgaggcacgcattactgacatcatggaaccagagcatgctctgctagccaaatcgatatttaaacttacataccaaaataaagtcgtgagagtacagcggcccgctaagaacggcaccgttatggatgtgatttcaaggcgtgaccagcgaggtagcgggcaggtcggaacatatggcctgaatactttcaccaacatggaagcccaactcatccgccagatggagtccgagggcatctttagtccttctgaactggagacgccaaacttggcagaaagagtgttagattggctggagaagtacggggtggaacggctcaaaaggatggcgattagcggagacgactgtgtcgttaagcccatagatgaccgcttcgccaccgctcttacagccctgaatgatatgggtaaagtgagaaaggacatcccgcagtgggagccttccaaaggctggaacgattggcagcaagtacccttttgctcacaccacttccatcagctaattatgaaggacgggcgggagatcgtggtcccatgtaggaatcaggatgaactggtgggacgagcacgtgttagtcagggcgctggttggtctctcagagagactgcctgcttgggaaagagctatgcacaaatgtggcagctgatgtactttcaccgccgggaccttaggctggccgcgaacgctatttgttccgccgtgcctgtcgattggatccccacctcaagaacaacttggagcatacatgcacaccatcagtggatgaccacggaagacatgctctctgtgtggaatcgcgtatggatcgaggaaaacccatggatggaggataaaacacacatttccagttggggagacgttccctatttaggcaagcgggaggaccaatggtgcggcagcctgatcgggttgaccgccagggctacttgggccacaaatattcaggtggcaatcaaccaggtccgaagactgattggaaatgaaaactacctcgattacatgacctcgatgaaacggttcaagaatgagggtgaccctgaaggcgctctttggtga

SEQ ID NO: 13581 - RNA, 9879 nt, synthetic construct
  misc_feature 1..9879: note = derived and/or modified CDS sequence (opt3) from DENV-1__EU687251__SS-prME
  source 1..9879: mol_type = other RNA
agcgtgaccatgctgctcatgcttatgcccacagccctggctttccacttgactacgagaggaggggaacctcatatgatcgtctccaagcaggaaagaggaaaatctttactgtttaagacctcagccggtgttaatatgtgcacactaattgccatggacctcggcgagctgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccgggtcgttcaaactggagaaggaagtcgccgagacgcagcacggtacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattatcatcggtgccggggaaaaagctctgaagctctcctggttcaagaaaggctcaagtattggaaagatgtttgaggccaccgcaagaggcgccaggcggatggctatcctgggggatacagcctgggacttcggaagcattggtggcgtgtttacgtccgttgggaaacttgtgcatcagatattcggaaccgcatacggcgtcctgttttctggtgtgagctggactatgaagatcgggattggcgtattgctcacatggctgggattaaattcacgaagtacctccctgagcatgacatgtatcgcggtgggcctagttactctctacctgggggtcatggtgcaggctgattctggatgcgtgatcaactggaaaggccgcgaacttaagtgtggttcagggattttcgtcaccaatgaggttcacacgtggacagaacaatataagtttcaggccgacagtccgaaaagattgagcgcagccataggaaaggcttgggaggagggcgtgtgcggtatcaggtccgccacccggctggaaaacattatgtggaaacagatctctaacgagctcaatcatattctgttagaaaacgacatgaagttcactgtggtagtcggcgatgtggcagggatcctggctcagggcaaaaagatgatacgccctcaacccatggagtacaaatattcgtggaaaagctggggcaaggccaagatcattggggcggacgttcagaataccacatttatcattgatggaccaaacactcctgaatgtcccgacgatcagagagcctggaatatctgggaggtggaggactacggcttcggtatatttaccacaaacatttggcttaagttgagggattcccacacgcaggtctgcgaccaccgtctcatgtcagctgcaatcaaagatagtaaggccgtgcatgctgacatggggtattggattgaatctgagaaaaatgaaacctggaagctggcccgggcatccttcatcgaggttaagacttgtatatggccaaaatcccacacactatggtcaaacggagtgctggaaagcgagatgatcattcccaagatctacggcggtcctatttctcaacataattatcgaccaggctacttcacccagactgcggggccgtggcacctcggaaaactggagcttgattttgacttgtgcgaaggcacaaccgtagtcgtggatgagcactgcgggaacagaggaccctccctgaggacgactaccgtgacaggcaagatcatacatgaatggtgttgccgcagttgtaccttacctccactccggttcagaggtgaggacgggtgctggtacggaatggagattaggcccgtcaaagaaaaggaggaaaatctggttaagagcatggtgtctgccggctccggtgaggtagactcatttagtcttggcctgttgtgtatcagcatcatgattgaagaggtgatgcgctcgcgatggtcccggaaaatgctcatgactgggacactggctgtcttctttctactgatcatgggacagctcacctggaacgatctgattcgtctttgcataatggtgggcgccaatgcatctgacagaatggggatgggaacaacttatttggctctgatggccaccttcaagatgaggcctatgtttgcagttggcttactcttccgccggctgacgagcagagaggtgcttctgctaacaatcggtctctcactggtcgccagtgtggaattgccaaactccctggaggaattaggggatggactcgctatgggcattatgatcctgaaacttctgaccgactttcaatctcaccagttgtgggcgactctcctgagcctaaccttcattaagacaactttttccctgcattacgcctggaaaaccatggcaatggttctttcaatcgtgagcctcttccccctgtgtttgagtacgacatctcagaagaccacttggctgccggtcttactcggctccctggggtgcaagcctcttacaatgtttctgatagctgagaataaaatctggggaaggcgaagctggccattgaacgaaggtattatggccgtaggcatcgtgtcgattctcctgtcatctctactgaagaacgatgttccccttgccgggcctctcatcgctggaggcatgctgatagcatgttatgtgattagtggttccagcgccgacttgtctttagagaaagcggctgaggtcagctgggaagaggaagccgagcactccggggcatcacataatatcctggtggaagtacaggatgacggaaccatgaagatcaaagatgaggagcgcgacgatactctcacaattctgcttaaggccaccctgttggctgtgagtggcgtctaccccctaagcataccagcaacgctgttcgtttggtatttctggcagaaaaagaagcagcggtctggcgtgctctgggacactccttcacccccagaagtggagagagccgtcctggatgacgggatctacaggattatgcagcgtggacttttaggtcgcagccaggtgggcgttggggtatttcaagaaaacgtgttccacaccatgtggcacgtcacacggggagcggtgctgatgtatcagggcaaaagactcgagccgagttgggctagcgttaagaaagacttgatctcctacggtgggggatggaggctgcagggctcttggaataccggcgaggaagtgcaggtcattgccgtggagcctgggaagaaccccaaaaatgtacaaacagcaccaggaacttttaagacccccgaaggtgaggtcggcgccatcgctctcgatttcaagcctgggacgtcgggaagcccaatagtgaaccgagaaggcaaaatcgttggtctgtacgggaatggagtggtcacaacttcaggcacctatgtgtccgccattgcacaggctaaggccagtcaggagggcccccttcctgagatcgaagacgaggtttttcggaaacgcaacctgacaattatggatttgcatccggggtctggaaagaccagaaggtacctaccagcgatcgtgcgggaagccataaaacgaaagctgagaactctcattttagcacccacccgcgtcgtggctagcgagatggccgaagctctgaagggtatgcctatcaggtatcaaacaacggcagtaaaatccgagcacactggcaaggagatcgtggaccttatgtgccatgccaccttcacaatgcgtctgctctcaccagttcgggtccccaattacaacatgattatcatggatgaagcccactttaccgacccttctagcatagctgcgagagggtatattagtactagggtgggaatgggcgaggcagccgctatcttcatgacagccaccccgcccggttccgtggaagcatttccacagagcaatgccgtcattcaggatgaggaacgcgacatccctgagcgatcttggaactcagggtacgagtggataacggatttccccggaaaaactgtatggtttgtgccatccattaagagtggcaatgacatcgctaactgtttgaggaaaaatggcaagcgggttatccagctgagcaggaagacattcgataccgaatatcagaaaaccaagaacaacgactgggactacgtggtcactacagatatttcggagatgggggcgaatttccgcgccgaccgtgtgatcgatcctagacggtgcctcaaacccgttattctgaaggacggaccagaaagggtgatacttgcaggtccgatgcctgtcaccgtggcttctgccgcacagcgccgaggcagaatcgggcggaaccataataaagagggagatcagtacatttatatgggccagcccctaaacaatgacgaggatcacgcccactggacagaagctaagatgctgttggacaacatcaatactccagagggtatcattcccgccttatttgaacctgagagggaaaagtccgcggcaatagatggggagtaccgcctgagaggcgaggccaggaaaacgttcgtagaactcatgcggcgtggagacctgccagtgtggcttagctataaggttgcttcagagggctttcaatacagtgatcgccgatggtgcttcgacggggaaagaaacaatcaggtcctggaggaaaacatggatgtggagatctggaccaaagagggagaaaggaagaaactccggccccgctggttggacgccagaacatattctgaccctctggctctaagggagtttaaggagttcgcagccggtcggcgatccgtgagcggcgatctgattctcgagatcgggaaacttccgcagcatctgactcagagagctcaaaatgccttagacaacttggtcatgctgcacaattcagaacagggaggccgcgcatacaggcatgcgatggaggagctcccagataccattgaaacactgatgcttctggccctcatcgctgttttgaccggtggggtgactctgtttttcttaagtggccggggactaggcaagacgagcatagggctgctctgtgtaatggcctcctctgtgcttctgtggatggcaagcgtcgagccccactggatcgctgcctccattatcttggaatttttcctgatggtgctcctgattcctgagcccgaccgtcagagaaccccacaggataaccaacttgcatatgttgtgatcggactcctgtttatgatattgacagtcgccgctaatgagatgggtctgttagaaactaccaagaaagacctaggcattgggcacgtagcggtggagaaccatcaccatgccgcaatgctggatgttgacctccaccctgcttcagcctggacactttacgccgtggcaaccactatcattacacccatgatgaggcatacgatcgaaaacaccactgctaatatatctctgacagccatcgcgaaccaggctgccattttgatgggactggataagggctggccaatcagtaaaatggacattggtgtccctctcctggcacttgggtgctacagccaggtgaatccgttaaccctgaccgccgctgtcctcatgttggtggcacactatgccatcataggccccggactgcaagcgaaggctacacgcgaggcccagaaacggactgcagccggcattatgaagaacccaacggttgatgggatcgtggctatcgacctagatcctgtagtgtacgacgccaagttcgaaaaacagctgggacagattatgctccttatcctgtgtaccagccaaatattgctgatgcgaacaacttgggcactctgcgagtccattaccctggctacaggccccttaaccactctttgggagggttctccagggaagttttggaatacgacaatcgccgtctcaatggcgaacattttcagaggaagctatctggccggcgcaggtctcgctttctccctaatgaaaagtctgggcgggggaaggcgcggcaccggggcccagggagaaactttgggcgagaagtggaaacggcagctgaatcagctctctaagagcgaatttaacacctacaagagatcaggtatcatggaggttgaccgttccgaagcaaaagaggggcttaagaggggagagacaactaaacacgctgtgagtcggggcaccgccaagctgcgctggttcgtcgaacgaaatttggtgaaacctgagggtaaggtaatagatctgggctgtgggagaggaggctggagctattactgcgccgggctcaagaaagtgacagaagttaagggatatacgaaaggcggtcccgggcatgaggaaccgatcccaatggcgacctacggatggaacttagtgaagctgcactctggcaaagacgtctttttcattcctcccgagaagtgtgatactcttctgtgcgacatcggcgagtcctcaccaaatcccacaattgaagaggggaggaccctacgggtgctcaaaatggtcgaaccttggctgcgcggaaaccaattttgtatcaagattttgaatccgtacatgcccagcgtggttgagactctggagcagatgcagagaaagcatggtggcatgctcgtaaggaacccactttcgcgaaattctacacacgaaatgtattgggtgagttgcgggaccggaaacatcgtctccgctgtgaatatgacgagccggatgctgttaaaccgtttcaccatggcacacagaaaacctacatacgagcgcgatgttgacctgggcgccggtactaggcatgtggctgtcgaacccgaggtggccaacttggatataattgggcagcggatcgaaaatatcaagcacgagcataaatcaacctggcactatgacgaggataacccttacaagacatgggcatatcatggatcctacgaagtaaaaccatctggcagcgccagttccatggtgaatggcgttgtcaagctcctgactaagccctgggacgtgattcctatggtgacccaaatagctatgacagataccactccatttgggcagcagagagtcttcaaagagaaggttgacacgcgcacacccaaagcgaagaggggaaccgcccaaatcatggaagtgactgcaaaatggctatggggttttcttagccgaaacaagaagccgcggatttgtaccagagaggagttcacaaggaaagtacgctctaatgctgccatcggcgcagtgtttgtcgacgagaaccagtggaactcagccaaggaggctgtggaagatgagcgtttctgggacctggttcaccgggaaagagagctccacaaacaggggaagtgcgccacgtgcgtgtataacatgatgggaaaaagggaaaagaagctgggcgagtttggtaaagcgaaggggagtcgcgcaatttggtacatgtggttgggagcccgattcctggagttcgaagctctcggctttatgaatgaggatcattggttctcccgggaaaacagcctttctggcgtcgagggggagggactgcacaaattaggttacatcctgagagacatatcgaagatccctggcgggaatatgtatgccgatgacaccgcaggatgggatactaggattacagaagacgatttgcagaacgaggctcgcatcaccgacattatggaaccagagcatgccctcctggctaaatcaatctttaagctaacttaccaaaataaagtggtaagagttcagcggcccgccaagaacggcacagtgatggatgtcataagcaggcgtgaccagcgaggttccggacaggtgggaacctatggccttaatacattcactaacatggaagcacaactgattcgccagatggagagtgagggcatcttttctcctagcgaactcgagaccccaaacctggcggaaagagtgttggattggttaaagaaatacggggtcgagcggctgaagaggatggccatctccggagacgactgtgttgtgaaacccattgatgaccgcttcgctacggccctcaccgcacttaatgatatgggtaaggtaagaaaagacataccgcagtgggaaccttcaaagggctggaacgattggcagcaagtgcccttttgcagtcaccacttccatcagctgatcatgaaggacgggcgggagattgtcgtgccatgtaggaatcaggatgagctagttggacgagctcgtgtgtctcagggcgccggttggagcctgagagaaacagcatgcctcgggaaatcctatgcccaaatgtggcagttgatgtactttcaccgccgggacctgaggcttgcggctaacgccatctgttcagcagtccctgtggattggattcccactagcagaaccacatggtctatccatgcccaccatcagtggatgactaccgaggacatgctgtccgtatggaatcgcgtttggatagaagagaacccatggatggaagataagacgcacatcagtagctggggagacgtgccctatctcggcaaacgggaggaccaatggtgcggctcgttaattgggctgacagctagggccacctgggcaactaatatccaggtcgctattaaccaggtgcgaagattgatcggaaatgagaactacctggattacatgacatccatgaagcggttcaaaaatgaatctgaccctgagggtgccctctggtga

SEQ ID NO: 13582 - RNA, 9879 nt, synthetic construct
  misc_feature 1..9879: note = derived and/or modified CDS sequence (opt3) from DENV-1__FJ024427__SS-prME
  source 1..9879: mol_type = other RNA
tcggtgaccatgctgctcatgcttatgcccacagcactggctttccacttgactacgagaggcggggaacctcatatgatcgtctccaagcaggaaagaggaaaatctttactgtttaagacctcagccggtgttaatatgtgcacactaattgccatggacctcggcgaactgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgttccgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgggtacggagcgctcacacttgactgtagcccaaggacgggcctggatttcaacgaaatggtcttgctaaccatgaaggagaaatcttggctggtgcataagcagtggtttctcgacctgccgcttccctggacttccggtgcctcaacaagccaagagacctggaatcggcaggatctgttggtaacattcaaaactgcacacgctaagaagcaggaagttgtggtcctcgggagtcaagagggcgccatgcacaccgctctgacgggagccaccgaaatccagacatctggcactaccacaatttttgcagggcatttaaaatgccgtctgaagatggacaaactaactctcaagggaatgtcctatgtgatgtgtaccggtagcttcaaactggagaaggaagtcgccgagacgcagcacggcacagtgcttgttcagataaagtacgagggggctgatgcgccttgcaaaatcccattctcgacccaagacgaaaagggaattactcagaacggccgcttgatcacagcaaatcccatagtgaccgataaagagaagcctgtaaacattgaagccgagccaccctttggtgagtcttatatcgtcatcggggctggcgaaaaagccctgaagctctcctggttcaagaaaggatcaagtattggcaagatgtttgaggcaactgccagaggggctaggcggatggccatcctgggagacaccgcatgggatttcggtagcattggcggggtgtttacatccgttggaaaacttgtgcatcagatattcggcacggcgtacggtgtcctgttttctggggtgagctggaccatgaagatcggcattggagtattgctcacttggctgggcttaaattcacgaagtacatccctgagcatgacctgtatcgctgtggggctagttacactctacctgggagtcatggtgcaggccgactctggctgcgtgatcaactggaaaggtcgcgaacttaagtgtgggtcaggaattttcgtcactaatgaggttcacacctggacggaacaatataagtttcaggcagatagtccgaaaagattgagcgccgctataggcaaggcctgggaggagggtgtgtgcggcatcaggtccgcaacacggctggaaaacattatgtggaaacagatctctaacgagctcaatcatattctgttagaaaacgacatgaagttcaccgtggtagtcggggacgtggctggaatcctggcccagggcaaaaagatgatacgccctcaacccatggagtacaaatattcgtggaaaagctgggggaaggcgaagatcattggagccgatgttcagaatactacctttatcattgacggcccaaacacacctgaatgtcccgatgaccagagagcttggaatatctgggaggtggaggattacggtttcgggatatttactaccaacatttggcttaagttgagggactcctatacacaggtctgcgatcaccgtctcatgtcagcagccatcaaagacagtaaggctgtgcacgccgatatgggatactggattgaatctgagaaaaatgaaacgtggaagctggcacgggcgagcttcatcgaggttaagacctgtatatggccaaaatcccatactctatggtcaaacggcgtgctggaaagcgagatgatcattcccaagatctatggtggccctatttctcaacacaattaccgaccagggtacttcacacagaccgccggaccgtggcatctcggcaaactggagcttgactttgatttgtgcgaagggactacagtagtcgtggacgagcactgcggaaacagaggcccctccctgaggaccacgactgtgaccggtaagatcatacacgaatggtgttgccgcagttgtacattacctccactccggttcagaggggaggatggatgctggtatggcatggagattaggcccgtcaaagaaaaggaggaaaatctggttaagagcatggtgtctgctggttccggcgaggtagactcatttagtcttgggctgttgtgtatcagcatcatgattgaagaggtgatgcgctcgcgatggtcccggaaaatgctcatgaccggaactctggccgtcttctttctactgatcatgggccagctcacatggaacgacctgattcgtctttgcataatggtgggggcaaatgcttctgatagaatgggaatgggcaccacatacttggccctgatggcaactttcaagatgaggcctatgtttgccgttggtttactcttccgccggctgaccagcagagaggtgcttctgctaacgatcgggctctcactggtcgctagtgtggaattgccaaactccctggaggaattaggagacggcctcgcgatgggcattatgatcctgaaacttctgacagattttcaatctcatcagttgtgggccaccctcctgagcctaactttcattaagaccacattttccctgcactatgcatggaaaactatggctatggttctttcaatcgtgagcctcttccccctgtgtttgagtaccacgtctcagaagacaacctggctgccggtcttactcgggtccctgggatgcaagcctcttactatgtttctgatagccgagaataaaatctggggtaggcgaagctggccattgaacgaaggcattatggccgtagggatcgtgtcgattctcctgtcatctctactgaagaacgacgttccccttgctggacctctcatcgcaggcggtatgctgatagcctgttacgtgattagtgggtccagcgcggatttgtctttagagaaagctgccgaggtcagctgggaagaggaagcagagcattccggagcctcacacaatatcctggtggaagtacaggacgatggcacaatgaagatcaaagacgaggagcgcgatgacaccctcactattctgcttaaggctacactgttggcagtgagtggcgtctatcccctaagcataccagccaccctgttcgtttggtacttctggcagaaaaagaagcagcggtctggggtgctctgggatacgccttcacccccagaagtggagagagcggtcctggacgatggaatctataggattatgcagcgtggtcttttaggccgcagccaggtgggggttggagtatttcaagaaaacgtgttccatactatgtggcacgtcacccggggcgctgtgctgatgtaccagggtaaaagactcgagccgagttgggccagcgttaagaaagacttgatctcctacgggggaggctggaggctgcagggctcttggaatacaggggaggaagtgcaggtcattgcagtggagcctggaaagaaccccaaaaatgtacaaaccgccccaggtacatttaagactcccgaaggcgaggtcggggctatcgccctcgacttcaagcctggaacctcgggcagcccaatagtgaaccgagaaggtaaaatcgttgggctgtatggaaatggcgtggtcacgacatcaggcacttacgtgtccgcaattgctcaggccaaggcgagtcaggaggggccccttcctgagatcgaagatgaggtttttcggaaacgcaacctgaccattatggacttgcacccgggatctggtaagacaagaaggtatctaccagccatcgtgcgggaagcaataaaacgaaagctgagaaccctcattttagctcccactcgcgtcgtggccagcgagatggctgaagcactgaagggcatgcctatcaggtaccaaaccacagccgtaaaatccgagcatacggggaaggagatcgtggatcttatgtgccacgccactttcaccatgcgtctgctctcaccagttcgggtccccaattataacatgattatcatggacgaagctcattttacagatccttctagcatagcggcaagaggatacattagtaccagggtgggcatgggtgaggccgctgccatcttcatgactgcaacaccgcccgggtccgtggaagcctttccacagagcaatgctgtcattcaggacgaggaacgcgatatccctgagcgatcttggaactcaggatatgagtggataaccgacttccccggcaaaacggtatggtttgtgccatccattaagagtggcaatgatatcgcgaactgtttgaggaaaaatgggaagcgggttatccagctgagcaggaagactttcgacacagaataccagaaaaccaagaacaacgattgggactacgtggtcaccactgacatttcggagatgggagccaatttccgcgcagatcgtgtgatcgaccctagacggtgcctcaaacccgttattctgaaggatggtccagaaagggtgatacttgctggcccgatgcctgtcacagtggcctctgcagcccagcgccgagggagaatcggacggaaccacaataaagagggcgaccagtatatttacatgggtcagcccctaaacaatgatgaggaccatgctcactggaccgaagccaagatgctgttggataacatcaatacaccagaggggatcattcccgcgttatttgaacctgagagggaaaagtccgcagccatagacggcgagtatcgcctgagaggagaggctaggaaaactttcgtagaactcatgcggcgtggcgatctgccagtgtggcttagctacaaggttgcctcagaggggtttcaatatagtgaccgccgatggtgcttcgatggagaaagaaacaatcaggtcctggaggaaaacatggacgtggagatctggacgaaagagggtgaaaggaagaaactccggccccgctggttggatgctagaacctactctgaccctctggcactaagggagtttaaggagttcgccgctggccggcgatccgtgagcggggacctgattctcgagatcggaaaacttccgcagcacctgacacagagagcccaaaatgcattagataacttggtcatgctgcataattcagaacagggcggtcgcgcgtataggcacgccatggaggagctcccagacactattgaaaccctgatgcttctggctctcatcgccgttttgacagggggcgtgaccctgtttttcttaagtggacggggcctagggaagactagcataggactgctctgtgtaatggcatcctctgtgcttctgtggatggctagcgtcgagccccattggatcgccgcatccattatcttggaatttttcctgatggtgctcctgattcctgagcccgatcgtcagagaacgccacaggacaaccaacttgcctacgttgtgatcggtctcctgtttatgatattgaccgtcgctgcgaatgagatgggcctgttagaaacaactaagaaagatctagggattggacacgtagccgtggagaaccaccatcacgcagctatgctggacgttgatctccatcctgcctcagcctggaccctttacgcagtggctacaaccatcattactcccatgatgaggcacacaatcgaaaacacgaccgccaatatatctctgactgcgatcgctaaccaggccgcaattttgatgggcctggacaagggttggccaatcagtaaaatggatattggggtccctctcctggcccttggctgctatagccaggtgaatccgttaacactgaccgctgcagtcctcatgttggtggcccattacgcgatcataggacccggcctgcaagctaaggccacccgcgaggcacagaaacggacagccgctgggattatgaagaacccaactgttgacggaatcgtggccatcgatctagaccctgtagtgtatgatgcaaagttcgaaaaacagctgggccagattatgctccttatcctgtgtacgagccaaatattgctgatgcgaaccacatgggctctctgcgagtccattactctggccaccggtcccttaacaaccctttgggaggggtctccaggaaagttttggaatactacgatcgcggtctcaatggccaacattttcagaggcagctacctggcaggagctggcctcgccttctccctaatgaaaagtctagggggtggcaggcgcgggacaggagcacagggcgaaaccttgggtgagaagtggaaacggcagctgaatcagctctctaagagcgaatttaacacttataagagatcagggatcatggaggttgaccgttccgaagctaaagagggacttaagaggggcgagaccacaaaacacgccgtgagtcggggtactgccaagctgcgctggttcgtcgaacgaaatttggtgaaacctgagggcaaggtaatagacctggggtgtggaagaggcgggtggagctactattgcgcgggactcaagaaagtgaccgaagttaagggctacacaaaaggtgggcccggacacgaggaaccgatcccaatggctacgtacggctggaacttagtgaagctgcattctggcaaagatgtctttttcattcctcccgagaagtgtgacacccttctgtgcgatatcggggagtcctcaccaaatcccactattgaagagggaaggacactacgggtgctcaaaatggtcgaaccttggctgcgcggtaaccaattttgtatcaagattttgaatccgtatatgcccagcgtggttgagaccctggagcagatgcagagaaagcacggcgggatgctcgtaaggaacccactttcgcgaaattctactcatgaaatgtactgggtgagttgcggaacaggcaacatcgtctccgcagtgaatatgaccagccggatgctgttaaaccgtttcacgatggcccacagaaaacctacctatgagcgcgacgttgatctgggtgctgggacaaggcacgtggccgtcgaacccgaggtggcaaacttggacataattggacagcggatcgaaaatatcaagcatgagcacaaatcaacttggcattacgatgaggacaacccttataagacctgggcctaccacggctcctatgaagtaaaaccatctggcagcgctagttccatggtgaatggggttgtcaagctcctgacaaagccctgggatgtgattcctatggtgactcaaatagcgatgaccgacacaaccccatttggacagcagagagtcttcaaagagaaggttgatactcgcacgcccaaagccaagaggggtacagcacaaatcatggaagtgaccgctaaatggctatggggctttcttagccgaaacaagaagccgcggatttgtactagagaggagttcaccaggaaagtacgctctaatgccgcaatcggggccgtgtttgtcgacgagaaccagtggaactcagctaaggaggccgtggaagacgagcgtttctgggatctggttcatcgggaaagagagctccacaaacagggaaagtgcgcgacatgcgtgtacaacatgatgggcaaaagggaaaagaagctgggtgagtttgggaaagcaaagggaagtcgcgccatttggtacatgtggttgggcgctcgattcctggagttcgaagccctcggctttatgaatgaggaccactggttcaaccgggaaaattcccttagcggggtcgagggagagggtctgcataaattaggctatatcctgagagatatatctaagatccctgggggaaacatgtacgcagacgatacggctggctgggacaccaggattactgaagatgacttgcagaatgaggcccgcatcacagatattatggaaccagagcacgctctcctggccagatcgatctttaaactaacctatcaaaacaaggtggtacgggttcagaggcccgccaaaaatggtactgtgatggacgtcatatcacgtcgagatcagcgcgggagcggacaggtgggcacatacggccttaacaccttcacaaacatggaagcgcaactgattagacagatggagtccgaggggatctttagtccttctgaactcgagactccaaatctggccgaacgggtgttggactggttagagaagtatggagtcgaaaggctgaagcgcatggctatcagcggtgatgactgtgttgtgaaacccattgacgatagattcgccaccgcactcacggctcttaacgacatgggcaaggtacggaaagatataccgcagtgggagccttccaaggggtggaatgactggcagcaagtgcccttttgctcacatcacttccaccagctgatcatgaaagatggaagggagattgtcgtgccatgtcgaaaccaggacgagctggttggccgtgccagagtgagtcagggtgcagggtggtctctgcgcgagaccgcctgcctcggaaagagctacgcgcaaatgtggcagttgatgtattttcatcggagggatctgagacttgctgccaatgcaatctgttccgccgtccctgtggactggattcccacatcacgcactacctggagcatccacgctcatcaccagtggatgacaactgaagatatgctgtctgtatggaaccgggtttggatagaggaaaatccatggatggaggacaagacccatatctccagttggggcgatgtgccctacctcggcaaaagggaggaccaatggtgcgggagcttaattggactgacggcccgagcaacatgggctaccaacatccaggtcgccattaatcaggtgagacggttgatcggtaacgaaaattacctggactatatgacttcgatgaagaggttcaaaaacgagtccgatcctgaaggcgcgctctggtga

SEQ ID NO: 13583 - RNA, 9879 nt, synthetic construct
  misc_feature 1..9879: note = derived and/or modified CDS sequence (opt3) from DENV-1__FJ024428__SS-prME
  source 1..9879: mol_type = other RNA
agcgtgaccatgctgctcatgcttatgcccacagccctggctttccacttgactacgagaggaggggaacctcatatgatcgtctccaagcaggaaagaggaaaatctttactgtttaagacctcagccggtgttaatatgtgcacactgattgccatggacctcggcgagctgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttaccgctctgtttctggcacatgccattggcacgtcgatcactcagaagggcattatcttcatactcttaatgctggtgacaccatcaatggctatgcgctgcgtcgggatcggaagcagagattttgtggagggtcttagtggcgccacctgggtagacgttgtgttggagcacgggtcctgtgtcactacaatggcgaaggataaacccaccctggacattgaactactcaagacggaggtgaccaaccctgcagtgctgaggaaactttgcatcgaagccaagatttctaatacaactaccgatagccggtgtccaacacaaggagaggctactctggtcgaagaacaagacgccaacttcgtttgccgccgaacctttgtggatagaggctggggtaatgggtgtggattgttcggcaaaggctccctcatcacatgcgcaaagtttaagtgcgtaaccaaactggaggggaagatagtgcagtacgaaaacttaaaatattcagtcattgtgactgttcacacgggagaccagcatcaagtgggtaatgagagtacagaacacggcaccactgctaccatcacaccccaggcccctaccactgagattcagctgacagactacggggcgctcacgcttgattgtagcccaaggaccggactggacttcaacgaaatggtcttgctaactatgaaggagaaatcttggctggtgcataagcagtggtttctcgatctgccgcttccctggacatccggcgcctcaaccagccaagagacatggaatcggcaggacctgttggtaactttcaaaaccgcacacgctaagaagcaggaagttgtggtcctcggtagtcaagagggggccatgcacacggctctgaccggcgccacagaaatccagacttctggaaccacaactatctttgcaggccatttaaaatgccgtctgaagatggataaactaaccctcaaggggatgtcctatgtgatgtgtacgggtagcttcaaactggagaaggaacttgccgagacacagcacggaaccgtcttggtgcagattaagtacgagggcactgacgctccttgcaaaataccattctcgacacaagatgaaaagggggttacccagaacggacgcctgatcactgcgaatcccattgtgaccgacaaagagaagcctgtaaacatcgaagcagagccaccctttggcgagtcttatatagtcattggtgccggggaaaaagctctcaagctgtcctggttcaagaaaggctcaagtatcggaaagatgtttgaggccacagcaagaggcgccaggcggatggctatccttggggatacggcctgggacttcggaagcattggtggcgtgtttacctccgttgggaaactggtgcatcagatcttcggaactgcatacggcgtcttgttttctggtgtgagctggacaatgaagattgggataggcgtactcctgacctggttaggactaaattcacgaagtacatccctaagcatgacttgtatcgcggtgggcctcgttaccctgtaccttggggtcatggtgcaggctgattctggatgcgtgattaactggaaaggccgcgaattgaagtgtggttcagggatcttcgtcacgaatgaggttcacacatggaccgaacaatataagtttcaggccgacagtccgaaaagactgagcgcagccatcggaaaggcttgggaggagggcgtgtgcggtattaggtccgccactcggctcgaaaacataatgtggaaacagatctctaacgagctgaatcatattttactggaaaacgacatgaagttcaccgtggtagtcggcgatgtggcagggatccttgctcagggcaagaagatgattcgccctcaacccatggagcacaaatactcgtggaaaagctggggcaaggccaagatcataggggcggacgttcagaatacaacttttatcattgatggaccaaacacccctgaatgtcccgacgatcagagagcctggaatatctgggaggtggaggactatggcttcggtatttttacaacgaacatctggttgaagctcagggattcctacacccaggtctgcgaccaccgtctgatgtcagctgcaataaaagatagtaaggccgtgcatgctgacatggggtattggattgaatctgagaaaaatgaaacttggaagctagcccgggcctccttcatcgaggttaagacatgtatttggccaaaatcccacaccctgtggtcaaacggagtgctcgaaagcgagatgatcatacccaagatctacggcggtcctatttctcaacataattatcgaccaggctacttcactcagacagcggggccgtggcacctgggaaaacttgagttggattttgacctgtgcgaaggcaccacggtagtcgtggatgagcactgcgggaacagaggaccctccttaaggactaccacagtgaccggcaagatcattcatgaatggtgttgccgcagttgtactctccctccactgcggttcagaggtgaggacgggtgctggtacggaatggagatcaggcccgtcaaagaaaaggaggaaaatcttgttaagagcatggtgtctgccggctccggtgaggtagactcatttagtctgggcttgctctgtataagcattatgatcgaagaggtgatgcgctcgcgatggtcccggaaaatgctgatgacagggaccctagctgtcttctttctgctcatcgtgggacagctgacatggaacgatcttattcgtttgtgcatcatggttggcgccaatgcatctgacagaatggggatgggaactacctatctggctttaatggccacgttcaagatgaggcctatgtttgcagtgggcctcctgttccgccggcttacaagcagagaggtcctgctactcaccattggtctgtcattggtggccagtgttgaactgccaaactccttagaggaactcggggatggactggctatgggcataatgatccttaaactgttgactgactttcaatctcaccagctctgggcgaccctgctaagcctgacattcattaagactaccttttcccttcattacgcctggaaaacgatggcaatggtgctctcagtcgtaagcctgttccccttgtgtctgagtacaacctctcagaagactacatggttaccggtgctcctgggctcccttgggtgcaagcctctgaccatgtttttgatcgctgagaataaaatttggggaaggcgaagctggccactcaacgaaggtatcatggccgttggcatagtgtcgatcctgctatcatctctgcttaagaacgatgtccccctcgccgggcctctgattgctggaggcatgttgatcgcatgttatgtgattagtggttccagcgccgacttatctctggagaaagcggctgaggtaagctgggaagaggaagccgagcactccggggcatcacataatatcctcgtggaagtccaggatgacggaactatgaagataaaagatgaggagcgcgacgatacactgaccattcttctgaaggccacgttgctagctgttagtggcgtgtaccccctgagcatcccagcaactctcttcgtgtggtatttctggcagaagaagaagcagcggtctggcgtcctgtgggacaccccttcacccccagaagtggagagagccgttcttgatgacgggatctacaggattatgcagcgtggattactgggtcgcagccaggtaggcgtgggggtctttcaagaaaacgtgttccacacaatgtggcacgttacccggggagcggtgctcatgtatcagggcaaaagattggagccgagttgggctagcgtcaagaaagacctgatatcctacggtgggggatggaggctccagggctcttggaatacaggcgaggaagtgcaggtaatcgccgtcgagcctgggaagaaccccaaaaatgtgcaaactgcaccaggaacctttaagacgcccgaaggtgaggttggcgccattgctctggatttcaagcctgggacatcgggaagcccaatcgtgaaccgagaaggcaaaattgtcggtctttacgggaatggagtggttactacctcaggcacatatgtgtccgccatcgcacaggctaaggccagtcaggagggccccctgcctgagatagaagacgaggtctttcggaaacgcaacttgaccatcatggatctacatccggggtctggaaagactagaaggtacctgccagcgattgtgcgggaagccatcaaacgaaagctcagaaccttaattctggcacccacacgcgtagtggctagcgagatggccgaagctcttaagggtatgcctatcaggtatcaaacgactgcagttaaatccgagcacaccggcaaggagatagtcgacctgatgtgccatgccacattcaccatgcgtctcttgtcaccagtgcgggtgcccaattacaacatgattatcatggatgaagcccactttactgacccttctagcatcgctgcgagagggtatattagtacaagggtcggaatgggcgaggcagccgctatcttcatgaccgccacgccgcccggttccgtagaagcatttccacagagcaatgccgtgatacaggatgaggaacgcgacattcctgagcgatcttggaactcagggtacgagtggatcactgatttccccggaaaaacagtttggtttgtgccatccattaagagtggcaatgacatcgctaactgtctgaggaaaaatggcaagcgggtcatacagctcagcaggaagaccttcgataccgaatatcagaaaactaagaacaacgactgggactacgtggttacaaccgatatttcggagatgggggcgaatttccgcgccgaccgtgtgatcgatcctagacggtgcctgaaacccgtcatccttaaggacggaccagaaagggtgattctagcaggtccgatgcctgtaacagtggcttctgccgcacagcgccgaggcagaatcgggcggaaccataataaagagggagatcagtacatttatatgggccagcccctgaacaatgacgaggatcacgcccactggactgaagctaagatgttgttagacaacataaatacgccagagggtatcattcccgccctgtttgaacctgagagggaaaagtccgcggcaatcgatggggagtaccgcctcagaggcgaggccaggaaaaccttcgttgaactgatgcggcgtggagaccttccagtctggctgagctataaggtggcttcagagggctttcaatacagtgatcgccgatggtgcttcgacggggaaagaaacaatcaggtgctcgaggaaaacatggatgtcgagatctggacaaaagagggagaaaggaagaaattgcggccccgctggctggacgccagaacttattctgaccctctagctctgagggagtttaaggagttcgcagccggtcggcgatccgttagcggcgatctcattcttgagatagggaaactgccgcagcatttaacccagagagctcaaaatgccttggacaacctggtgatgctccacaattcagaacagggaggccgcgcatacaggcatgcgatggaggagctgccagatacaatcgaaacccttatgctgctcgccttgattgctgtactgactggtggggtgacgttatttttcctaagtggccggggactgggcaagaccagcatcgggctcctttgtgtcatggcctcctctgtgctgttgtggatggcaagcgttgagccccactggattgctgcctccatcatactggaatttttcctcatggtgctgcttatccctgagcccgaccgtcagagaacaccacaggataaccaactcgcatatgtcgtaattggactgttgtttatgatcctgactgtggccgctaatgagatgggtttactagaaaccacaaagaaagacctgggcattgggcacgttgcggtggagaaccatcaccatgccgcaatgctcgatgtcgaccttcaccctgcttcagcctggaccctgtacgccgtggcaactacaatcataacgcccatgatgaggcataccattgaaaacactacagctaatatctctttgaccgccattgcgaaccaggctgccatcctgatgggactcgataagggctggccaataagtaaaatggacatcggtgtccctctgcttgcattagggtgctactcgcaagtgaatccgctgaccctcacagccgctgttttgatgctggtggcacactatgccattatcggccccggactacaagcgaaggctactcgcgaggcccagaaacggacggcagccggcattatgaagaacccaaccgtagatgggatcgtggctatagacctggatcctgtcgtttacgacgccaagttcgaaaaacagctcggacagattatgcttctgatcttgtgtacaagccaaatcctgctcatgcgaactacctgggcactgtgcgagtccattacattagctaccggcccccttactacgctgtgggagggttctccagggaagttttggaatacaaccatcgccgtgtcaatggcgaacatattcagaggaagctatctcgccggcgcaggtctagctttctccctgatgaaaagtttgggcgggggaaggcgcggcactggggcccagggagaaaccctgggcgagaagtggaaacggcagctcaatcagctttctaagagcgaatttaacacatacaagagatcaggtattatggaggtcgaccgttccgaagcaaaagaggggctgaagaggggagagactaccaaacacgctgtgagtcggggcacagccaagttgcgctggttcgtagaacgaaatctggtgaaacctgagggtaaggttatcgatctcggctgtgggagaggaggctggagctattactgcgccgggttaaagaaagtgacggaagtcaagggatataccaaaggcggtcccgggcatgaggaaccgattccaatggcgacttacggatggaacctggtgaaacttcactctggcaaagacgtctttttcatccctcccgagaagtgtgatacactgctatgcgacataggcgagtcctcaccaaatcccaccatcgaagaggggaggactctccgggtgctgaaaatggttgaaccttggttgcgcggaaaccaattttgtattaagatcctgaatccgtacatgcccagcgtagtggagacactcgagcagatgcagagaaagcatggtggcatgcttgtcaggaacccactgtcgcgaaattctacccacgaaatgtattgggtgagttgcgggacgggaaacattgtttccgctgtgaatatgaccagccggatgttactgaaccgtttcacaatggcacacagaaaacctacttacgagcgcgatgtcgacttgggcgccggtaccaggcatgtggctgtagaacccgaggtggccaacctcgatatcattgggcagcggatcgaaaatataaagcacgagcataaatcaacatggcactatgacgaggataacccttacaagacttgggcatatcatggatcctacgaagttaaaccatctggcagcgccagttccatggtcaatggcgtggtgaagctgctaaccaagccctgggacgtcattcctatggttacacaaatcgctatgaccgatactacgccatttgggcagcagagagtgttcaaagagaaggtagacacacgcacccccaaagcgaagaggggaactgcccaaatcatggaagtgaccgcaaaatggctttggggttttctgagccgaaacaagaagccgcggatttgtacaagagaggagttcacgaggaaagtccgctctaatgctgccataggcgcagtgtttgttgacgagaaccagtggaactcagccaaggaggctgtggaagatgagcgtttctgggacctcgtccaccgggaaagagagctgcacaaacaggggaagtgcgcaacctgcgtgtataacatgatgggaaaaagggaaaagaagttgggcgagtttggtaaagcgaaggggagtcgcgcaatctggtacatgtggctgggagcccgattcctcgagttcgaagctcttggctttatgaatgaggatcattggttctcccgggaaaacagcctgtctggcgtagagggggagggattacacaaactgggttacattttgagagacatctcgaagattcctggcgggaatatgtatgccgatgacactgcaggatgggatacaaggatcaccgaagacgatctccagaacgaggctcgcataactgacatcatggaaccagagcatgccctgctagctaaatcaatttttaaacttacataccaaaataaagttgtgagagtccagcggcccgccaagaacggcaccgtgatggatgtgatcagcaggcgtgaccagcgaggttccgggcaggtcggaacatatggcctgaatactttcaccaacatggaagcacaactcattcgccagatggagagtgagggcatcttttctcctagcgaactggagacgccaaacttggcggaaagagttttagattggctggagaagtacggggtggaacggctcaaaaggatggccatatccggagacgactgtgtagtgaagcccattgatgaccgcttcgctaccgcccttacagcactgaatgatatgggtaaagtcagaaaggacatcccgcagtgggagccttcaaaaggctggaacgattggcagcaagtgcccttttgcagtcaccacttccatcagctaatcatgaaggacgggcgggagattgttgtgccatgtaggaatcaggatgaactggtcggacgagctcgtgtgtctcagggcgccggttggagcctcagagagactgcatgcttggggaagtcctatgcccaaatgtggcagctgatgtactttcaccgccgggaccttaggctggcggctaacgccatatgttcagcagtacctgttgattggatccccaccagcagaacaacttggtctattcatgcccaccatcagtggatgaccacggaagacatgctctccgtgtggaatcgcgtctggatcgaggaaaacccatggatggaggataaaacacacattagtagctggggagacgtgccctatttaggcaagcgggaggaccaatggtgcggctcgctgatcgggttgaccgctagggccacttgggcaacaaatatacaggttgctatcaaccaggtgcgaagactgattggaaatgaaaactacctcgattacatgacctccatgaaacggttcaagaatgagtctgaccctgaaggtgccctttggtga

SEQ ID NO: 13584 - RNA, 9879 nt, synthetic construct
  misc_feature 1..9879: note = derived and/or modified CDS sequence (opt3) from DENV-1__FJ024429__SS-prME
  source 1..9879: mol_type = other RNA
agcgtgaccatgctgctcatgcttatgcccacagccctggctttccacttgactacgaggggaggggagcctcatatgatcgtctccaagcaggaaaggggaaaatctttactgtttaagacctcagccggtgttaatatgtgcacactaattgccatggacctcggcgagctgtgtgaagatactatgacctacaaatgcccacggattacagagaccgaaccggacgatgtggactgttggtgcaatgcgactgatacatgggtaacctatgggacgtgtagtcagactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagccgggattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatcggggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccgggtcgttcaaactggagaaggaacttgccgagacgcagcacggtacagtcttggtgcagataaagtacgagggcaccgacgctccttgcaaaatcccattctcgactcaagatgaaaagggggttacacagaacggacgcctgattaccgcgaatcccatcgtgactgacaaagagaagcctgtaaacatagaagcagagccaccctttggcgagtcttatattgtcatcggtgccggggaaaaagctctcaagctgtcctggttcaagaaaggctcaagtatcggaaagatgtttgaggccaccgcaaggggcgccaggcggatggctattcttggggatacagcctgggacttcggaagcatcggtggcgtgtttacgtccgttgggaaactggtgcatcagattttcggaaccgcatacggcgtcttgttttctggtgtgagctggactatgaagatagggatcggcgtactcatgacatggctgggattaaattcacgaagtacctccctgagcatgacatgtattgcggtgggcctagttactctctacctgggggtcatggtgcaggctgattctggatgcgtgatcaactggaaaggccgcgaacttaagtgtggttcagggatcttcgtcaccaatgaggttcacacgtggacagaacaatataagtttcaggccgacagtccgaaaagattgagcgcagccattggaaaggcttgggaggagggcgtgtgcggtataaggtccgccacccggctggaaaacatcatgtggaaacagatttctaacgagctcaatcatatcctgttagaaaacgacatgaagttcactgtggtagtcggcgatgtggcagggattctggctcagggcaaaaagatgatccgccctcaacccatggagcacaaatactcgtggaaaagctggggcaaggccaagataatcggggcggacgttcagaataccacatttattatcgatggaccaaacactcctgaatgtcccgacgatcagagagcctggaatatttgggaggtggaggactatggcttcggtatctttaccacaaacatatggcttaagttgagggattcctacacgcaggtctgcgaccaccgtctcatgtcagctgcaattaaagatagtaaggccgtgcatgctgacatggggtattggatcgaatctgagaaaaatgaaacctggaagctggcccgggcatccttcattgaggttaagacttgtatctggccaaaatcccacacactatggtcaaacggagtgctggaaagcgagatgataatccccaagatttacggcggtcctatctctcaacataattatcgaccaggctacttcacccagattgcggggccgtggcacctcggaaaactggagcttgattttgacttgtgcgaaggcactacagtagtcgtggatgagcactgcgggaacagaggaccctccctgaggaccacgactgtgaccggcaagatcatacatgaatggtgttgccgcagttgtacattacctccactccggttcagaggtgaggacgggtgctggtacggaatggagattaggcccgtcaaagaaaaggaggaaaatctggttaagagcatggtgtctgccggctccggtgaggtagactcatttagtcttggcctgttgtgtatcagcatcatgattgaagaggtgatgcgctcgcgatggtcccggaaaatgctcatgaccgggactctggctgtcttctttctactgatcgtgggacagctcacatggaacgatctgattcgtctttgcataatggttggcgccaatgcatctgacagaatggggatgggaaccacatatttggctctgatggccactttcaagatgaggcctatgtttgcagtgggcttactcttccgccggctgaccagcagagaggtccttctgctaacgatcggtctctcactggtggccagtgttgaattgccaaactccctggaggaattaggggatggactcgctatgggcattatgatcctgaaacttctgacagactttcaatctcaccagttgtgggcgaccctcctgagcctaactttcattaagaccacattttccctgcattacgcctggaaaactatggcaatggtgctttcagtcgtaagcctcttccccctgtgtttgagtaccacgtctcagaagacaacctggctgccggtgttactcggctccctggggtgcaagcctcttactatgtttctgatcgctgagaataaaatatggggaaggcgaagctggccattgaacgaaggtatcatggccgttggcattgtgtcgatcctcctgtcatctctactgaagaacgatgtcccccttgccgggcctctcattgctggaggcatgctgatcgcatgttatgtgataagtggttccagcgccgacttgtctttagagaaagcggctgaggtaagctgggaagaggaagccgagcactccggggcatcacataatattctggtggaagtccaggatgacggaacaatgaagatcaaagatgaggagcgcgacgataccctcactatcctgcttaaggccacactgttggctgttagtggcgtgtaccccctaagcattccagcaaccctgttcgtgtggtatttctggcagaaaaagaagcagcggtctggcgtcctctgggacacgccttcacccccagaagtggagagagccgttctggatgacgggatatacaggatcatgcagcgtggacttttaggtcgcagccaggtaggcgtgggggtctttcaagaaaacgtgttccacactatgtggcacgttacccggggagcggtgctgatgtatcagggcaaaagactcgagccgagttgggctagcgtcaagaaagacttgatttcctacggtgggggatggaggctgcagggctcttggaatacaggcgaggaagtgcaggtaatcgccgtcgagcctgggaagaaccccaaaaatgtgcaaaccgcaccaggaacatttaagactcccgaaggtgaggttggcgccattgctctcgatttcaagcctgggacctcgggaagcccaatcgtgaaccgagaacggaaaatagtcggcctgtacggtaatggggtggttacgacatcaggaacttatgtgtccgccatcgcacaggctaaggccagtcaggagggcccccttcctgagattgaagacgaggtctttcgcaaaagaaacctgaccatcatggatttgcatccgggctctgggaagacaaggcggtacctaccagcgattgtgcgagaagccatcaaaagaaagctgcgcaccctcatattagcacccactagggtagtggctagcgagatggccgaagctctgaagggaatgcctattcgttatcaaaccacagcagttaaatccgagcacacgggtaaggagatcgtcgaccttatgtgccatgccactttcaccatgcggctgctctcaccagtgagagtgcccaattacaacatgatcattatggatgaagcccactttacagacccttctagcatcgctgcgaggggctatataagtacccgcgtcgggatgggagaggcagccgctattttcatgactgccacaccgcccggctccgtagaagcatttccacagagcaatgccgtgatccaggatgaggaacgagacattcctgagagatcttggaactcaggttacgagtggatcaccgatttccccgggaaaacggtttggtttgtgccatccataaagagtggaaatgacattgctaactgtttgcggaaaaatggcaagagggtcatccagctgagccgcaagactttcgatacagaatatcagaaaaccaagaacaacgactgggactacgtggttaccactgatatctcggagatgggcgcgaatttccgtgccgacagagtgattgatcctcggaggtgcctcaaacccgtcatcctgaaggacgggccagaacgcgtgattcttgcaggaccgatgcctgtaacagtggcttctgccgcacagcgaagaggtcggataggcaggaaccataataaagagggggatcagtacatctatatgggacagcccctaaacaatgacgaggatcacgcccactggaccgaagctaagatgctgttggacaacattaatacaccagagggcatcatccccgccttatttgaacctgagcgcgaaaagtccgcggcaattgatggtgagtacagactgagaggggaagcccggaaaactttcgttgaactcatgcgtcgcggcgacctgccagtctggcttagctataaggtggcttcagagggatttcaatacagtgatcgaagatggtgcttcgacggcgaaaggaacaatcaggtgctggaggaaaacatggatgtcgagatatggacgaaagagggggaacggaagaaactccgccccagatggttggacgccaggacctattctgaccctctggctctacgggagtttaaggagttcgcagccggacgaagatccgttagcggtgatctgatcctcgagattggcaaacttccgcagcatctgacacagcgcgctcaaaatgccttagacaacttggtgatgctgcacaattcagaacaagggggaagggcataccggcatgcgatggaggagctcccagatactatcgaaaccctgatgcttctggccctcattgctgtattgacaggcggtgtgaccctgtttttcttaagtgggcgtggcctaggaaagactagcatcggcctgctctgtgtcatggcctcctctgtgcttctgtggatggcaagcgttgagccccactggatagctgcctccatcattttggaatttttcctgatggtgctcctgatccctgagcccgacagacagaggacgccacaggataaccaacttgcatatgtcgtaattgggctcctgtttatgatcttgaccgtggccgctaatgagatgggactgttagaaacaactaagaaagacctaggtataggccacgttgcggtggagaaccatcaccatgccgcaatgctggatgtcgacctccaccctgcttcagcctggaccctttacgccgtggcaacaaccattatcactcccatgatgcgccatacaattgaaaacacgaccgctaatatctctctgactgccatagcgaaccaggctgccatcttgatggggctggataagggatggccaattagtaaaatggacatcggcgtccctctcctggcacttggttgctacagccaggtgaatccgttaacactgaccgccgctgttctcatgttggtggcacactatgccattatcgggcccggcctgcaagcgaaggctacccgggaggcccagaaacgaacagcagccggaataatgaagaacccaactgtagatggcattgtggctatcgacctagatcctgtcgtttacgacgccaagttcgaaaaacagctggggcagatcatgctccttattctgtgtacgagccaaatcttgctgatgagaaccacatgggcactctgcgagtccataactctggctaccggacccttaacaaccctttgggagggctctccaggtaagttttggaatactacgattgccgtgtcaatggcgaacatcttcagggggagctatctggccggagcaggcctcgctttctccctaatgaaaagtctgggtggcgggcgccggggaacaggcgcccagggggaaaccttgggagagaagtggaaaagacagctgaatcagctctctaagagcgaatttaacacttacaagcgttcaggcattatggaggtcgacaggtccgaagcaaaagagggtcttaagagaggggaaaccacaaaacacgctgtgagtcgcggaactgccaagctgcgatggttcgtagaaagaaatttggtgaaacctgagggcaaggttatcgatctgggttgtggcagagggggatggagctattactgcgccggcctcaagaaagtgaccgaagtcaaggggtatacaaaaggaggccccggtcatgaggaaccgataccaatggcgacgtacgggtggaacttagtgaagctgcactctggaaaagacgtctttttcatccctcccgagaagtgtgatacccttctgtgcgacattggcgagtcctcaccaaatcccactatcgaagagggccggacactacgcgtgctcaaaatggttgaaccttggctgagagggaaccaattttgtattaagatcttgaatccgtacatgcccagcgtagtggagaccctggagcagatgcagaggaagcatggaggtatgctcgtccgaaacccactttcgagaaattctactcacgaaatgtattgggtgagttgcggcacagggaacattgtttccgctgtgaatatgaccagccgtatgctgttaaacagattcacgatggcacaccgcaaacctacctacgagagggatgtcgacctgggagccggcacacggcatgtggctgtagaacccgaggtggccaacttggatatcataggtcagagaattgaaaatatcaagcacgagcataaatcaacttggcactatgacgaggataacccttacaagacctgggcatatcatgggtcctacgaagttaaaccatctggaagcgccagttccatggtcaatggcgtggtgaagctcctgacaaagccctgggacgtcatccctatggttactcaaattgctatgaccgatacaaccccatttggccagcagcgcgtgttcaaagagaaggtagacactaggacgcccaaagcgaagcgagggacagcccaaataatggaagtgaccgcaaaatggctatggggatttcttagccggaacaagaagccgagaatctgtactagggaggagttcacccgcaaagtccgttctaatgctgccattggtgcagtgtttgttgacgagaaccagtggaactcagccaaggaggctgtggaagatgagcggttctgggacctggtccacagagaaagggagctccacaaacagggcaagtgcgccacatgcgtgtataacatgatggggaaacgcgaaaagaagctgggagagtttggcaaagcgaagggtagtcgagcaatctggtacatgtggttgggggcccggttcctggagttcgaagctctcggatttatgaatgaggatcattggttctccagagaaaacagcctttctggcgtagagggcgaggggctgcacaaattaggatacattctgagggacatctcgaagatacctggtggcaatatgtatgccgatgacacggcagggtgggatacccgcatcactgaagacgatttgcagaacgaggctagaattacagacatcatggaaccagagcatgccctcctggctaaatcaatttttaagctaacctaccaaaataaagttgtgcgggtccagaggcccgccaagaacggaactgtgatggatgtgatcagccgtcgagaccagcgcggctccggtcaggtcgggacatatggacttaataccttcacaaacatggaagcacaactgataagacagatggagagtgagggcatattttctcctagcgaactcgagactccaaacctggcggaacgggttttggattggttagagaagtacggcgtggaaaggctgaaacgcatggccatctccggggacgactgtgtagtgaagcccatcgatgacagattcgctaccgccctcacggcacttaatgatatgggaaaagtccggaaggacattccgcagtgggagccttcaaaaggttggaacgattggcagcaagtgcccttttgcagtcaccacttccatcagctgataatgaaggacggcagggagatcgttgtgccatgtcgaaatcaggatgagctagtcgggcgtgctagagtgtctcagggagccggctggagcctgcgcgagaccgcatgcctcggtaagtcctatgcccaaatgtggcagttgatgtactttcaccggagggacctgagacttgcggctaacgccatttgttcagcagtacctgttgattggatccccacaagccgcactacctggtctattcatgcccaccatcagtggatgacaactgaagacatgctgtccgtgtggaatcgggtctggatcgaggaaaacccatggatggaggataaaacccacataagtagctggggagacgtgccctatctcggaaagagggaggaccaatggtgcggctcgttaatcggcctgacggctcgagccacatgggcaaccaatattcaggttgctatcaaccaggtgagacggttgattgggaatgaaaactacctggattacatgacttccatgaaaaggttcaagaatgagtctgaccctgaaggagccctctggtga

SEQ ID NO: 13585 - RNA, 9879 nt, synthetic construct
  misc_feature 1..9879: note = derived and/or modified CDS sequence (opt3) from DENV-1__FJ024430__SS-prME
  source 1..9879: mol_type = other RNA
agcgtgaccatgctgctcatgcttatgcccacggccctggctttccacttgactacgagaggaggggagcctcatatgatcgtctccaagcaggaaagaggaaaatctttactgtttaagacctcagccggtgttaatatgtgcacattgattgccatggacctcggcgagctgtgtgaagatactatgacctacaaatgcccacggataacagagaccgaaccggacgatgtggactgttggtgcaatgcgactgatacatgggtgacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctacaaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccggtagcttcaaactggagaaggaagtcgccgagacgcagcacggtacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattgtgatcggtgccggggaaaaagctctgaagctctcctggttcaagaaaggctcaagtatcggaaagatgtttgaggccaccgcaagaggcgccaggcggatggctattctgggggatacagcctgggacttcggaagcatcggtggcgtttttacgtccgtggggaaacttgtccatcagattttcggaaccgcatacggcgtgctgttttctggtgtaagctggactatgaagatagggatcggcgtgttgctcacatggctgggattaaattcacgaagtacctccctgagcatgacatgtattgcggttggcctagtcactctctacctgggggtgatggtgcaggctgattctggatgcgtcatcaactggaaaggccgcgaacttaagtgtggttcagggatcttcgttaccaatgaggtgcacacgtggacagaacaatataagtttcaggccgacagtccgaaaagattgagcgcagccattggaaaggcttgggaggagggcgtgtgcggtataaggtccgccacccggctggaaaacatcatgtggaaacagatttctaacgagctcaatcatatcctgttagaaaacgacatgaagttcactgtagtcgtgggcgatgttgcagggattctggctcagggcaagaagatgatccgccctcaacccatggagtacaaatattcgtggaaaagctggggcaaggccaagataatcggggcggacgtgcagaataccacatttattatcgatggaccaaacactcctgaatgtcccgacgatcagagagcctggaatatttgggaggtcgaggactacggcttcggtatctttaccacaaacatatggcttaagttgagggattcctatacacaggtgtgcgaccaccgtctcatgtcagctgcaattaaagatagtaaggccgttcacgctgacatggggtactggatcgaatctgagaaaaatgaaacctggaagctggcccgggcatccttcattgaggtgaagacttgtatctggccaaaatcccatacactatggtcaaacggagtactggaaagcgagatgataatccccaagatttatggcggtcctatctctcaacacaattaccgaccaggctacttcacccagactgcggggccgtggcatctcggaaaactggagcttgattttgacttgtgcgaaggcacaaccgtcgtggtggatgagcactgcgggaacagaggaccctccctgaggacgactaccgtcacaggcaagattatccacgaatggtgttgccgcagttgtaccttacctccactccggttcagaggtgaggacgggtgctggtatggaatggagataaggcccgttaaagaaaaggaggaaaatctggtaaagagcatggtatctgccggctccggtgaggtggactcatttagtcttggcctgttgtgtattagcatcatgatcgaagaggtcatgcgctcgcgatggtcccggaaaatgctcatgactgggacactggctgtgttctttctactgattatgggacagctcacctggaacgatctgatccgtctttgcattatggttggcgccaatgcatctgacagaatggggatgggaacaacttacttggctctgatggccaccttcaagatgaggcctatgtttgcagtgggcttactcttccgccggctgacgagcagagaggtccttctgctaacaataggtctctcactggtggccagtgttgaattgccaaactccctggaggaattaggggatggactcgctatgggcatcatgattctgaaacttctgaccgactttcaatctcatcagttgtgggcgactctcctgagcctaaccttcatcaagacaactttttccctgcactatgcctggaaaaccatggcaatggtgctttcaattgtcagcctcttccccctgtgtttgagtacgacatctcagaagaccacttggctgccggtattactcggctccctggggtgcaagcctcttacaatgctgttgatcgctgagaataaaatatggggaaggcgaagctggccactcaacgaaggtatcatggccgtgggcattgtttcgatcctgctatcatctctgcttaagaacgatgtgcccctcgccgggcctctgattgctggaggcatgttgatcgcatgttacgtcataagtggttccagcgccgcgttatctctggagaaagctgccgaggtgagctgggaagaggaagcagagcattccggggcctcacacaatattctcgtagaagtgcaggacgatggaaccatgaagatcaaagacgaggagcgcgatgacactctgacaatccttctgaaggctaccttgctagcagtcagtggcgtttatcccctgagcattccagccacgctctttgtgtggtacttctggcagaaaaagaagcagcggtctggcgtgctgtgggatactccttcacccccagaagtcgggagagcggtgcttgacgatggaatatataggatcatgcagcgtggtttactgggccgcagccaggttggggtaggagtgttccaagagaacgtctttcataccatgtggcacgtgacacggggcgctgttctcatgtaccagggtaaaagattggaaccgagttgggccagcgtgaagaaagacctgatttcctacgggggaggctggaggctccagggctcttggaataccggggaggaggtccaggtgatcgcagtagaacctggaaagaaccccaaaaatgtccaaacagccccaggtactttcaagacccccgagggcgaagtgggggctattgccctggactttaagcctggaacgtcgggcagcccaatcgttaaccgagagggtaaaatagtggggctttatggaaatggcgtcgtgacaacttcaggcacctacgtttccgcaatcgctcaggccaaggcgagtcaggaagggcccctgcctgagattgaggatgaagtgttccggaaacgcaacttgacaatcatggacctacacccgggatctggtaagaccagaaggtatctgccagccattgtccgggaggcaatcaaacgaaagctcagaactttaatactggctcccacccgcgtggtagccagcgaaatggctgaggcacttaagggcatgcctattaggtaccaaacaacggccgtgaaatccgaacatactgggaaggagatcgttgatctgatgtgccacgccacctttacaatgcgtctcttgtcaccagtccgggtgcccaattataacatgatcattatggacgaggctcatttcaccgatccttctagcatcgcggcaagaggatacataagtactagggtgggcatgggtgaagccgctgccatttttatgacagcaaccccgcccgggtccgtcgaggccttcccacagagcaatgctgtaatccaggacgaagaacgcgatattcctgaacgatcttggaactcaggatatgagtggatcacggactttcccggcaaaactgtgtggttcgttccatccataaagagtggcaatgatattgcgaactgtctgaggaaaaatgggaagcgggtgatccagctcagcaggaagacatttgacaccgagtaccagaaaaccaagaacaacgattgggactacgtcgtgactacagacatctcggaaatgggagccaatttccgcgcagatcgtgttattgaccctagacggtgcctgaaacccgtgatccttaaggatggtccagagagggtcattctagctggcccgatgcctgtgaccgtagcctctgcagcccagcgccgagggagaataggacggaaccacaataaagaaggcgaccagtatatctacatgggtcagcccctgaacaatgatgaggaccatgctcactggacagaggccaagatgttgttagataacattaatactccagaagggatcatccccgcgctgttcgagcctgaaagggagaagtccgcagccattgacggcgaatatcgcctcagaggagaggctaggaaaacgtttgtggagctgatgcggcgtggcgatcttccagtttggctgagctacaaggtcgcctcagaagggttccaatatagtgaccgccgatggtgctttgatggagagagaaacaatcaggtgctcgaagagaacatggacgtggaaatatggaccaaagagggtgagaggaagaaattgcggccccgctggctggatgctagaacatactctgaccctctagcactgagggagttcaaggagtttgccgctggccggcgatccgtcagcggggacctcatccttgaaattggaaaactgccgcagcacttaactcagagagcccaaaatgcattggataacctggttatgctccataattcagagcagggcggtcgcgcgtataggcacgccatggaggaactgccagacaccatcgagacacttatgctgctcgctttgattgccgtgctgaccgggggcgtaactttattctttctaagtggacggggcctggggaagacgagcatcggactcctttgtgtgatggcatcctctgtcctgttgtggatggctagcgtggaaccccattggatagccgcatccatcattctggagttctttctcatggttctgcttatccctgaacccgatcgtcagagaaccccacaggacaaccaactcgcctacgtggtcattggtctgttgttcatgatcctgacagtagctgcgaatgagatgggcttactagagactaccaagaaagatctggggataggacacgtggccgttgaaaaccaccatcacgcagctatgctcgacgtggatcttcatcctgcctcagcctggacactgtacgcagtcgctaccactattatcacacccatgatgaggcacacgattgagaacaccactgccaatatctctttgacagcgatagctaaccaggccgcaatcctgatgggcctcgacaagggttggccaattagtaaaatggatatcggggtgcctctgcttgccttaggctgctattcgcaggtcaatccgctgaccctcaccgctgcagtgttgatgctggttgcccattacgcgattatcggacccggcctacaagctaaggccacacgcgaagcacagaaacggactgccgctgggataatgaagaacccaacggtggacggaattgtagccatcgatctggaccctgtggtctatgatgcaaagtttgagaaacagctcggccagatcatgcttctgattttgtgtaccagccaaatcctgctcatgcgaacaacttgggctctgtgcgaatccataaccttagccacaggtccccttaccactctgtgggaggggtctccaggaaagttctggaatacgacaattgcggtttcaatggccaacatctttagaggcagctacctcgcaggagctggcctagccttctccctgatgaaaagtctagggggaggcaggcgcgggaccggagcacagggcgagactctgggtgaaaagtggaaacggcagctcaatcagctttctaagagcgagttcaacacctataagagatcagggattatggaagtggaccgttccgaggctaaagaaggactgaagaggggcgagacaactaaacacgccgtcagtcggggtaccgccaagttgcgctggtttgtggagcgaaatctggtaaaacctgaaggcaaggtgatcgacctcgggtgtggaagaggcgggtggagctactattgcgcgggattaaagaaagttacagaggtgaagggctacacgaaaggtgggcccggacacgaggaaccgataccaatggctacctacggctggaacctggtcaaacttcattctggcaaagatgtgttctttatccctcccgaaaagtgtgacactctgctatgcgatattggggagtcctcaccaaatcccacaatcgaggaaggaaggaccctccgggtcctgaaaatggtggagccttggttgcgcggtaaccaattctgtattaagatcctgaatccgtatatgcccagcgttgtagaaactctcgagcagatgcagagaaagcacggcgggatgcttgtgaggaacccactgtcgcgaaattctacacatgagatgtactgggtcagttgcggaaccggcaacattgtgtccgcagttaatatgacgagccggatgttactgaaccgttttaccatggcccacagaaaacctacatatgaacgcgacgtggatttgggtgctgggactaggcacgtcgccgtggagcccgaagtagcaaacctcgacatcataggacagcggattgagaatatcaagcatgaacacaaatcaacctggcattacgatgaggacaacccttataagacatgggcctaccacggctcctatgaggtgaaaccatctggcagcgctagttccatggttaatggggtcgtgaagctgctaactaagccctgggatgtgatccctatggtcacccaaattgcgatgacagacaccactccattcggacagcagagagtttttaaagaaaaggtggatacgcgcacacccaaagccaagaggggtaccgcacaaataatggaggtaactgctaaatggctttggggcttcctgagccgaaacaagaagccgcggatctgtaccagagaagagtttacaaggaaagtgcgctctaatgccgcaattggggccgtcttcgtggacgaaaaccagtggaactcagctaaggaggccgttgaggacgaacgtttttgggatctcgtgcatcgggagagagaactgcacaaacagggaaagtgcgcgacgtgcgtctacaacatgatgggcaaaagggagaagaagttgggtgagttcgggaaagcaaagggaagtcgcgccatctggtacatgtggctgggcgctcgatttctcgagttcgaggcccttggcttcatgaatgaagaccactggttttcccgggagaacagcctgtctggggtggaaggagagggtttacataaactgggctatattttgagagatatctcgaatatacctgggggaaacatgtacgcagacgataccgctggctgggacactaggatcacagaggatgacctccagaatgaagcccgcattaccgatatcatggagccagaacacgctctgctagccaagtcaattttcaaacttacttatcaaaacaaggtagttagagtgcagcggcccaccaaaaatggtaccgtcatggacgtgatcagcaggcgtgatcagcgagggtccggacaggtgggcacatacggcctgaacacttttaccaacatggaggcacaactcatacgccagatggaaagtgaggggattttctctcctagcgagctggaaacgccaaatttggcggagagagtcttagactggctggaaaagtatggagttgagcggctcaagaggatggccatctccggtgatgactgtgtggtaaaacccgtggacgatcgctttgctaccgcccttacagcactgaacgacatgggcaaggtcagaaaagatatcccgcagtgggaaccttcaaaggggtggaatgactggcagcaagtgcccttctgcagtcatcactttcaccagctaattatgaaagatggacgggagatagttgtgccatgtaggaaccaggacgagctggtcggccgagctcgtgtgtctcagggtgccgggtggagcctcagagaaactgcatgcttgggaaagtcctacgcccaaatgtggcagctgatgtatttccatcgccgggatcttaggctggcggctaatgccatctgttcagcagtacctgttgactggattcccaccagcagaacaacttggtctatccacgcccatcaccagtggatgaccacggaggatatgctctccgtgtggaaccgcgtctggattgaagagaatccatggatggaagacaagacacatatcagtagctggggcgatgtgccctacttaggcaaacgggaggaccaatggtgcgggtcgctgataggattgaccgctagggccacttgggcaacaaacatccaggttgctattaatcaggtgcgaagactgatcggtaacgagaattacctcgactatatgacctccatgaagcggtttaaaaacgaatctgatcctgagggcgccctttggtga

SEQ ID NO: 13586 - RNA, 9879 nt, synthetic construct
  misc_feature 1..9879: note = derived and/or modified CDS sequence (opt3) from DENV-1__FJ024433__SS-prME
  source 1..9879: mol_type = other RNA
agcgtgaccatgctgctcatgcttatgcccaccgccctggctttccacttgactacgcggggcggggaacctcatatgatcgtctccaagcaggaaagggggaagtctttactgtttaagacctcagccggtgttaatatgtgcacactaattgccatggacctcggcgaactgtgtgaagatactatgacctacaaatgcccacggataacagaaaccgaaccggacgatgtggactgttggtgcaatgcgactgatacatgggtgacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaggacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaggcccctacaaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaatcagccaagagacatggaatcggcaggacctgttggtaaccttcaaaacagcacacgctaagaagcaggaagttgtggtcctcggtagtcaagagggggccatgcacactgctctgaccggcgccacggaaattcagacctctggaacaactaccatatttgcaggccatttaaaatgccgtctgaagatggataaactaacactccgcgggatgtcctatgtgatgtgtactgggagcttcaagctggagaaagaagtcgccgagacccagcacggtacggtgcttgttcagatcaagtacgagggcacagacgctccttgcaagattccattctcgacccaagatgaaaaaggggtgactcagaacggaagattgatcacagcgaatcccatagtaaccgacaaggagaaacctgtcaacattgaagcagagccaccctttggcgagtcttatatcgtgatcggtgccggggaaaaggctctgaaactctcctggttcaagaagggctcaagtattggaaaaatgtttgaggccactgcaaggggcgcccggcgaatggctatcctgggggataccgcctgggacttcggaagcattggtggcgtttttacatccgtggggaaacttgtccatcagatattcggaacggcatacggcgtgctgttttctggtgtaagctggaccatgaaaatcgggattggcgtgttgctcacttggctgggattaaattcacgcagtacatccctgagcatgacctgtatcgcggttggcctagtcacactctacctgggggtgatggtgcaggctgattctggatgcgtcatcaactggaagggcagagaacttaaatgtggttcagggattttcgttactaatgaggtgcacacctggacggaacaatataagtttcaggccgacagtccgaagaggttgagcgcagccataggaaaggcttgggaggagggcgtgtgcggtatccggtccgccacacgcctggaaaacattatgtggaagcagatctctaacgagctcaatcatattctgttagaaaacgacatgaaattcaccgtagtcgtgggcgatgttgcagggatcctggctcagggaaagaaaatgataagacctcaacccatggagcacaagtactcgtggaaaagctggggcaaggccaagatcattggggcggacgtgcagaatactacctttatcattgatggaccaaacacacctgaatgtcccgacgatcagagggcctggaatatctgggaggtcgaggactatggcttcggtatatttactaccaacatttggcttaaattgcgtgattcctacacacaggtgtgcgaccaccggctcatgtcagctgcaatcaaggatagtaaagccgttcatgctgacatggggtattggattgaatctgagaagaatgaaacgtggaaactggcccgagcatccttcatcgaggtgaagacctgtatatggccaaagtcccacactctatggtcaaacggagtactggaaagcgagatgatcattcccaaaatctacggcggtcctatttctcaacataattatagaccaggctacttcacacagaccgcggggccgtggcacctcggaaagctggagcttgattttgacttgtgcgaaggcactacagtcgtggtggatgagcactgcgggaacaggggaccctccctgcgcaccacgactgtcaccggcaaaatcatacatgaatggtgttgccggagttgtacattacctccactcagattcaggggtgaggacgggtgctggtacggaatggagattcgccccgttaaggaaaaagaggaaaatctggtaaagagcatggtatctgccggctccggtgaggtggactcatttagtcttggcctgttgtgtatcagcatcatgattgaagaggtcatgcgatcgcggtggtcccgtaagatgctcatgaccgggactctggctgtgttctttctactgatcatgggacagctcacatggaacgatctgattagactttgcataatggttggcgccaatgcatctgacaggatggggatgggaaccacatatttggctctgatggccactttcaaaatgcgccctatgtttgcagtgggcttactcttccggagactgaccagcagggaggtccttctgctaacgatcggtctctcactggtggccagtgttgaattgccaaactccctggaggaattaggggatggactcgctatgggcattatgatcctgaaacttctgacagactttcaatctcaccagttgtgggcgaccctcctgagcctaactttcattaaaaccacattttccctgcattacgcctggaagactatggcaatggtgctttcaatcgtcagcctcttccccctgtgtttgagtaccacgtctcagaaaacaacctggctgccggtattactcggctccctggggtgcaagcctcttactatgtttctgatagctgagaataagatctggggacgacgcagctggccattgaacgaaggtattatggccgtgggcatcgtttcgattctcctgtcatctctactgaaaaacgatgtgccccttgccgggcctctcatcgctggaggcatgctgatagcatgttatgtcattagtggttccagcgccgacttgtctttagagaaggcggctgaggtgagctgggaagaggaagccgagcactccggggcatcacataatatcctggtagaagtgcaggatgacggaacaatgaaaatcaaggatgaggagcgggacgataccctcactattctgcttaaagccacactgttggctgtcagtggcgtttaccccctaagcataccagcaaccctgttcgtgtggtatttctggcaaaagaaaaagcagagatctggcgtgctctgggacacgccttcacccccagaagtcgagagggccgtgctggatgacgggatctaccgtattatgcagcgcggacttttaggtcggagccaggttggcgtaggggtgtttcaagaaaacgtcttccacactatgtggcacgtgaccagaggagcggttctgatgtatcagggcaagaggctcgagccgagttgggctagcgtgaaaaaggacttgatctcctacggtgggggatggcgactgcagggctcttggaatacaggcgaggaagtccaggtgattgccgtagagcctgggaaaaaccccaagaatgtccaaaccgcaccaggaacatttaaaactcccgaaggtgaggtgggcgccatcgctctcgatttcaagcctgggacctcgggaagcccaatagttaaccgggaaggcaagatcgtgggtctgtacgggaatggagtcgtgacgacatcaggcacttatgtttccgccattgcacaggctaaagccagtcaggagggcccccttcctgagatcgaagacgaggtgtttcgcaagagaaacctgaccattatggatttgcatccggggtctggaaaaacaaggcggtacctaccagcgatcgtccgagaagccataaagagaaaactgcgcaccctcattttagcacccactagggtggtagctagcgagatggccgaagctctgaagggtatgcctatccgttatcaaaccacagcagtgaagtccgagcacacgggcaaagagatcgttgaccttatgtgccatgccactttcaccatgcggctgctctcaccagtcagagtgcccaattacaacatgattatcatggatgaagcccactttacagacccttctagcatagctgcgagggggtatattagtacccgcgtgggaatgggcgaggcagccgctatcttcatgactgccacaccgcccggttccgtcgaagcatttccacagagcaatgccgtaattcaggatgaggaacgagacatccctgagagatcttggaactcagggtacgagtggataaccgatttccccggaaagacggtgtggtttgttccatccattaaaagtggcaatgacatcgctaactgtttgcggaagaatggcaaaagggtgatccagctgagccgcaagactttcgatacagaatatcaaaagaccaaaaacaacgactgggactacgtcgtgaccactgatatttcggagatgggggcgaatttccgtgccgacagagttatcgatcctcggaggtgcctcaagcccgtgattctgaaagacggaccagaacgcgtcatacttgcaggtccgatgcctgtgacagtagcttctgccgcacagcgaagaggccggatcgggaggaaccataataaggagggagatcagtacatttatatgggccagcccctaaacaatgacgaggatcacgcccactggaccgaagctaaaatgctgttggacaacatcaatacaccagagggtatcattcccgccttatttgaacctgagcgcgaaaagtccgcggcaatagatggggagtacagactgaggggcgaggcccggaagactttcgtggaactcatgcgtcgcggagacctgccagtttggcttagctataaagtcgcttcagagggctttcaatacagtgatcgaagatggtgcttcgacggggaaaggaacaatcaggtgctggaggaaaacatggatgtggagatctggacgaaggagggagaacggaaaaagctccgccccagatggttggacgccaggacctattctgaccctctggctctacgggagtttaaagagttcgcagccggtcgaagatccgtcagcggcgatctgattctcgagatcgggaaacttccgcagcatctgacacagcgcgctcaaaatgccttagacaacttggttatgctgcacaattcagaacagggaggcagggcataccggcatgcgatggaggagctcccagatactattgaaaccctgatgcttctggccctcatcgctgtgttgacaggtggggtaaccctgtttttcttaagtggccgtggactaggcaaaactagcatagggctgctctgtgtgatggcctcctctgtccttctgtggatggcaagcgtggagccccactggatcgctgcctccattatcttggaatttttcctgatggttctcctgattcctgagcccgacagacagaggacgccacaggataaccaacttgcatatgtggtcatcggactcctgtttatgatattgaccgtagccgctaatgagatgggtctgttagaaacaactaagaaggacctaggcattgggcacgtggcggttgagaaccatcaccatgccgcaatgctggatgtggacctccaccctgcttcagcctggaccctttacgccgtcgcaacaaccatcattactcccatgatgcgccatacaatcgaaaacacgaccgctaatatatctctgactgccatcgcgaaccaggctgccattttgatgggactggataaaggctggccaatcagtaagatggacattggtgtgcctctcctggcacttgggtgctactcgcaggtcaatccgttaacactgaccgccgctgtgctcatgttggttgcacactatgccatcataggccccggactgcaagcgaaagctacccgggaggcccagaagcgaacagcagccggcattatgaaaaacccaactgtggatgggatcgtagctatcgacctagatcctgtggtctacgacgccaagttcgaaaagcagctgggacagattatgctccttatcctgtgtacgagccaaatattgctgatgagaaccacatgggcactctgcgagtccattactctggctaccggccccttaacaaccctttgggagggttctccagggaaattttggaatactacgatcgccgtttcaatggcgaacattttcaggggaagctatctggccggcgcaggtctcgctttctccctaatgaagagtctgggcgggggacgccggggcacaggggcccagggagaaaccttgggcgagaaatggaagagacagctgaatcagctctctaaaagcgaatttaacacttacaagcgttcaggtatcatggaggtggacaggtccgaagcaaaggaggggcttaaacggggagagaccacaaagcacgctgtcagtcgcggcactgccaaactgcgatggttcgtggaaagaaatttggtaaagcctgagggtaaagtgatagatctgggctgtgggaggggaggctggagctattactgcgccgggctcaagaaggttaccgaagtgaaaggatatacaaagggcggtcccgggcatgaggaaccgatcccaatggcgacgtacggatggaacttagtcaaactgcactctggcaaggacgtgtttttcattcctcccgagaaatgtgatacccttctgtgcgacatcggcgagtcctcaccaaatcccactattgaagaggggcggacactacgcgtcctcaagatggtggaaccttggctgagaggaaaccaattttgtatcaaaattttgaatccgtacatgcccagcgttgtagagaccctggagcagatgcagaggaagcatggtggcatgctcgtgcgaaacccactttcgagaaattctactcacgaaatgtattgggtcagttgcgggacaggaaacatcgtgtccgctgttaatatgaccagccgtatgctgttaaacagattcacgatggcacaccgcaagcctacctacgagagggatgtggacctgggcgccggtacacggcatgtcgctgtggaacccgaggtagccaacttggatataattgggcagagaatcgaaaatatcaaacacgagcataagtcaacttggcactatgacgaggataacccttacaaaacctgggcatatcatggatcctacgaagtgaagccatctggcagcgccagttccatggttaatggcgtcgtgaaactcctgacaaagccctgggacgtgattcctatggtcactcaaatagctatgaccgatacaaccccatttgggcagcagcgcgttttcaaggagaaagtggacactaggacgcccaaggcgaaacgaggaacagcccaaatcatggaagtaaccgcaaagtggctatggggttttcttagccggaacaaaaagccgagaatttgtactagggaggagttcacccgcaaggtgcgttctaatgctgccatcggcgcagtctttgtggacgagaaccagtggaactcagccaaagaggctgttgaagatgagcggttctgggacctggtgcacagagaaagggagctccacaagcaggggaaatgcgccacatgcgtctataacatgatgggaaagcgcgagaagaagctgggcgagtttggtaaggcgaaagggagtcgagcaatttggtacatgtggttgggagcccggttcctggagttcgaagctctcggctttatgaatgaggatcattggttctccagagaaaacagcctttctggcgtggagggggagggactgcacaagttaggttacatcctgagggacatatcgaaaatccctggcgggaatatgtatgccgatgacacggcaggatgggatacccgcattactgaagacgatttgcagaacgaggctagaatcacagacattatggaaccagagcatgccctcctggctaagtcaatctttaaactaacctaccaaaataaggtagttcgggtgcagaggcccgccaaaaacggcactgtcatggatgtgataagccgtcgagaccagcgcggttccggacaggtgggaacatatggccttaataccttcacaaacatggaagcacaactgattagacagatggagagtgagggcatcttttctcctagcgaactcgagactccaaacctggcggaacgggtcttggattggttagagaagtacggggttgaaaggctgaagcgcatggccatctccggagacgactgtgtggtaaaacccattgatgacagattcgctaccgccctcacggcacttaatgatatgggtaaggtgcggaaagacataccgcagtgggagccttcaaagggctggaacgattggcagcaagtccccttttgcagtcaccacttccatcagctgatcatgaaagacgggagggagattgtggttccatgtcgaaatcaggatgagctagtgggacgtgctagagtctctcagggcgccggttggaacctgcgcgagaccgcatgcctcggaaagagctatgcccaaatgtggcagttgatgtactttcaccggagggacctgagacttgcggctaatgccatctgttccgcagtgcctgtagattggattcccacatcacgcactacctggagcatccatgcccaccatcagtggatgacaactgaagacatgctgtctgtttggaaccgggtgtggatagaggaaaatccatggatggaggataagacccacatctccagttgggaggacgtcccctatctcggaaaaagggaagaccaatggtgcggcagcttaattggcctgacggctcgagccacatgggcaaccaacatccaggtggctattaatcaggttagacggttgatcgggaacgagaattacctggattacatgacttcgatgaagaggttcaaaaacgaatccgaccctgagggagccctctggtga

SEQ ID NO: 13587 - RNA, 9879 nt, synthetic construct
  misc_feature 1..9879: note = derived and/or modified CDS sequence (opt3) from DENV-1__FJ024434__SS-prME
  source 1..9879: mol_type = other RNA
agcgtgaccatgctgctcatgcttatgcccacagcactggctttccacttgactacgagaggaggggaacctcatatgatcgtctccaagcaggaaaggggaaaatctttactgtttaagacctcagccggtgttaacatgtgcacattaattgccatggacctcggcgaactgtgtgaagatactatgacctacaaatgcccacggataacagaggcggaaccggacgatgtggactgttggtgcaatgctaccgatacttgggtaacatatgggacctgtagtcagacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaattgctcaagacagaggtgaccaaccctgccgtgctgaggaaactttgcattgaagctaagatctctaatacgaccacagatagccggtgtccaactcaaggagaggccaccctggtcgaagaacaggacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatgtgtactggtagcttcaaactggagaaggaagtcgctgagacccagcacggaacggtgcttgttcagataaagtacgagggcacagacgcgccttgcaaaatcccattctcgacccaagatgaaaagggggtgactcagaacggacgcttgattacagcaaatcccatcgtaaccgacaaagagaagcctgtcaacatagaagccgagccaccctttggcgagtcttatattgtgatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtttttacatccgtggggaaacttgtccatcagattttcggaacggcgtacggcgtgctgttttctggtgtaagctggaccatgaagatagggatcggcgtgttgctcacttggctgggattaaattcacgaagtacatccctgagcatgacctgtattgctgttggcctagtcacactctacctgggggtgatggtgcaggccgattctggatgcgtcatcaactggaaaggccgcgaacttaagtgtggttcagggatcttcgttactaatgaggtgcacacctggacggaacaatataagtttcaggcagacagtccgaaaagattgagcgccgctattggaaaggcctgggaggagggcgtgtgcggtataaggtccgcaacacggctggaaaacatcatgtggaaacagatttctaacgagctcaatcatatcctgttagaaaacgacatgaagctgaccgtagtcgtgggcgatgttgctgggattcttggacagggcaaaaagatgatccgccctcaacccatggagtacaaatattcgtggaaaagctgggggaaggccaaaataatcggagcggacgcccagaatactaccttcattatcgatggcccaaacacacctgaatgtcccgacgatcagagagcttggaatatttgggaggtggaggactacggttttgggatcttcactaccaacatatggttgaagctcagggattcctatacacaggtctgcgaccaccgtctgatgtcagcagccattaaagatagtaaggctgtgcacgccgacatgggatactggatcgaatctgagaaaaatgaaacgtggaagctagcacgggcgagctttattgaggttaagacctgtatctggccaaaatcccatactctgtggtcaaacggcgtgctcgaaagcgagatgataatccccaagatttatggtggccctatctctcaacacaattaccgaccagggtacttcacacagaccgccggaccgtggcatctgggcaaacttgagttggatttcgacctgtgcgaagggactacagtagtcgtggatgagcactgcggaaacagaggcccctccttaaggaccacgactgtgaccggtaagattatccacgaatggtgttgccgcagttgtacactccctccactgcggtttagaggggaggacggatgctggtatggcatggagataaggcccgtcaaagaaaaggaggaaaatcttgttaagagcatggtgtctgctggttccggcgaggtagactcattcagtctggggttgctctgtattagcatcatgatcgaagaggtgatgcgctcgcgatggtcccggaaaatgctgatgaccggaactctagccgtctttttcctgctcattatgggccagctgacatggaacgatcttatccgtttgtgcattatggtgggggcaaatgcttctgacagaatgggaatgggcaccacatacctggccttaatggcaacttttaagatgaggcctatgttcgccgttggtctcctgtttcgccggcttaccagcagagaggtgctgctactcacgatagggctgtcattggtcgctagtgtggaactgccaaactccttagaggaactcggagatggcctggcgatgggcatcatgattcttaaactgttgacagacttccaatctcatcagctctgggccaccctgctaagcctgacttttatcaagaccacattctcccttcactatgcatggaaaactatggctatggttctctcaattgtgagcctgtttcccttgtgtctgagtaccacgtctcagaagacaacctggttaccggtcctcctggggtcccttggatgcaagcctctgactatgttcttgatcgccgagaataaaatatggggtaggaagtcctggccactcaacgaaggcatcatggccgtagggattgtgtcgatcctgctatcatctctgcttaaaaacgatgttcccctcgctggacctctgattgcaggcggtatgttgatcgcctgttacgtgataagtgggtccagcgcggacttatctctggagaaggctgccgaggtcagctgggaagaggaagcagagcattccggagcctcacacaatattctcgtggaagtacaggatgacggcacaatgaaaatcaaggatgaggagcgagacgataccctgactatccttctgaaagctacattgctagcagtgagtggcgtctatcccctgagcattccagccaccctctttgtttggtacttctggcaaaagaagaaacagcgctctggggtgctgtgggacacgccttcacccccagaagtggagcgggcggtccttgatgacggaatatatagaatcatgcagaggggtttactgggccgtagccaggtgggggttggagtattccaagaaaacgtgtttcatactatgtggcacgtcacccgcggcgctgtgctcatgtaccagggtaagcggttggagccgagttgggccagcgttaaaaaggacctgatttcctacgggggaggctggagactcaggggctcttggaatacaggggaggaagtgcaggtcatcgcagtggagcctggcaaaaatcccaagaatgtacagaccgccccaggtacattcaagactcccgaaggcgaggtcggggctattgccctggattttaaacctggaacctcgggcagcccaatcgtgaaccgagaaggtaagatagttgggctttatggaaatggcgtggtcacgacatcaggcacttacgtgtccgcaatcgctcaagccaaagcgagtcaggaggggcccctgcctgagattgaagacgaggttttccggaagcgcaacttgaccatcatggatctacacccgggatctggtaaaacaagaaggtatctgccagccattgtgcgggaagcaatcaagcgaaagctcagaaccttaatactggctcccactcgcgtcgtggccagcgagatggctgaagcacttaaaggcatgcctattaggtaccagaccacagccgtaaagtccgagcatacggggaaagagatcgtggacctgatgtgccacgccacttttaccatgcgtctcttgtcaccagttcgggtccccaattataacatgatcattatggatgaagctcatttcacagacccttctagcatcgcggcaagaggatacataagtaccagggtgggcatgggtgaggccgctgccatttttatgactgcaacaccgcccgggtccgtggaagccttcccacaaagcaatgctgtcatccaggatgaggaacgcgacattcctgagcgatcttggaactcaggatatgagtggatcaccgattttcccggcaagacggtatggttcgtgccatccataaaaagtggcaatgacattgcgaactgtctgagaaagaatgggaagcgggttatccagctcagcaggaaaacttttgatacagaataccagaagaccaaaaacaacgactgggactacgtggtcaccactgatatctcggagatgggagccaatttccgcgcagaccgtgtgattgatcctagacggtgcctgaagcccgttatccttaaagacggtccagaaagggtgattctagctggcccgatgcctgtcacagtggcctctgcagcccaacgccgagggagaataggacggaaccacaataaggagggcgatcagtatatctacatgggtcagcccctgaacaatgacgaggatcatgctcactggaccgaagccaagatgttgttagacaacattaatacaccagaggggatcatccccgcgctgttcgaacctgagagggaaaaatccgcagccgtagatggcgagtatcgcctcagaggagaggctaggaagacttttgtggaactgatgcggcgtggcgaccttccagtttggctgagctacaaagtcgcctcagaggggttccagtatagtgatcgccgatggtgctttgacggagaaagaaacaatcaagtgctcgaggaaaacatggatgtggagatttggacgaaggagggtgaaaggaaaaagttgcggccccgctggctggacgctagaacctactctgaccctctagcactgagggagtataaagagttcgccgctggccggcgatccgtcagcggggatctcatacttgagatcggaaagctgccgcagcacttaacacagagagcccagaatgcattggacaacctggttatgctccataattcagaacaaggcggtcgcgcgtacaggcacgccatggaggagctgccagatactattgaaacccttatgctgctcgctttgatcgccgtgctgacagggggcgtaaccttatttttcctaagtggacggggcctggggaagactagcattggactcctttgtgtgatggcatcctctgtcctgttgtggatggctagcgtggagccccattggatcgccgcatccataatcctggaatttttcctcatggttctgcttattcctgagcccgaccgtcagagaacgccacaggataaccagctcgcctacgtggtcatcggtctgttgtttatgattctgaccgtagctgcgaatgagatgggcttactagaaacaactaaaaaggacctggggatcggacacgtggccgttgagaaccaccatcacgcagctatgctcgatgtggaccttcatcctgcctcagcctggaccctgtatgcagtcgctacaaccataattactcccatgatgaggcacacaatcgaaaacacgaccgccaatatttctttgactgcgatcgctaaccaagccgcaatactgatgggcctcgataaaggttggccaatcagtaagatggacattggggtgcctctgcttgccttaggctgctactcgcaggtcaatccgctgacactcaccgctgcagtgttgatgctggttgcccattatgcgatcattggacccggcctacaggctaaagccacccgcgaggcacaaaagcggacagccgctgggatcatgaagaacccaactgtggatggaatagtagccattgacctggatcctgtggtctacgacgcaaaattcgaaaagcagctcggccagatcatgcttctgatcttgtgtacgagccagattctgctcatgcgaaccacatgggctctgtgcgagtccatcactttagccgcgggtccccttaccacactgtgggaggggtctccaggaaaattttggaataccactatagccgtttcaatggcaaacattttcagaggcagctatctcgctggtgccggcctagcattttccctgatgaagagtctagggggaggcaggcgcgggacgggagctcaaggcgaaacactgggtgagaaatggaagcggcagctcaatcagctttctaagagcgagttcaacacctacaaaagatcagggatcatggaggtggaccgttccgaagccaaggagggactgaaaaggggcgagactaccaagcacgccgtcagtcggggtacagcgaaattgcgctggttcgtggaacgaaatctggtaaagcctgagggcaaggtgattgatctcgggtgtggaagaggcgggtggagctattactgcgctggactaaagaaggttactgaagtgaaaggctacaccaagggtgggcccggacacgaggaaccgatcccaatggcaacatatggctggaacctggtcaaacttcattctggcaaggacgtgtttttcatacctcccgagaaatgtgatacgctgctatgcgacatcggggagtcctcaccaaatcccaccattgaagagggaaggactctccgggtcctgaagatggtggaaccttggttgcgcggtaaccagttttgtatcaagattctgaatccgtacatgcccagcgttgtagaggccctcgagcaaatgcagagaaaacacggcgggatgcttgtgaggaacccactgtcgcgaaattctacacatgaaatgtattgggtcagttgcggaaccggcaacatcgtgtccgctgttaatatgactagccggatgttactgaaccgtttcacaatggcccacagaaagcctacctacgagcgcgatgtggacttgggtacggggaccaggcacgtcgcagtggaacccgaggtagccaacctcgatattatcggacagcggatagaaaatattaaacatgagcacaagtcaacatggcattatgacgaggataacccttacaaaacttgggcttatcacggctcctacgaagtgaagccatctggcagcgcgagttccatggttaatggggtcgtgaagctgctaaccaaaccctgggacgtgatccctatggtcacacagatcgccatgactgataccacaccatttggacaacagagagttttcaaggagaaagtggacacccgcactcccaaggcaaaaaggggtacggctcagattatggaagtaacagcccgatggctttggggctttctgagccggaacaagaagccgagaatatgtaccagggaggagttcactcgcaaagtgcgttctaatgcagccatcggggctgtctttgtggacgagaaccaatggaactcagccaaggaggcggttgaagatgagcggttctgggacctcgtgcatagagaaagggagctgcacaaacagggaaagtgcgcaacctgcgtctacaacatgatgggcaaacgcgaaaagaagttgggtgagtttgggaaagccaagggaagtcgagctatttggtatatgtggctgggcgcccggttcctcgagtttgaagcacttggcttcatgaatgaggatcactggttctccagagaaaacagcctgtctggggtggagggagagggtttacataaactgggctacatcttgagggacatttcgaagatccctgggggaaatatgtatgctgatgacacagccggctgggatacgcgcataaccgaagacgatctccagaacgaggctaaaatcactgacattatggaaccagagcacgccctgctagcaaaggcgatctttaaacttacataccagaataaggtagttagagtgcaacggcccgccaagaacggtaccgtcatggatgtgatttcaaggcgtgaccagcgagggagcggacaggtgggcacttatggcctgaatacattcaccaacatggaagctcagctcatccgccaaatggagtccgaggggatatttagtccttctgaactggagacaccaaacttggccgaaagagcattagattggctggagaaatacggagtcgaacggctcaagaggatggctattagcggtgacgactgtgttgtgaaacccatcgatgaccgcttcgccactgcacttaccgccctgaatgatatgggcaaggtaagaaaagacatcccgcagtgggagccttccaaggggtggaacgattggcaacaggtgcccttttgctcacatcacttccaccaactaattatgaaggacggacgggagatagtcgtgccatgtaggaatcaggatgaactggttggccgagcgcgtgtgagtcagggtgctgggtggtctctcagagagacggcctgcttgggaaaaagctatgcacagatgtggcaactgatgtactttcatcgccgggaccttaggctggccgctaacgccatctgttccgcagtccctgtggattgggtacccacctcaagaacaacttggagcattcacgctcatcaccagtggatgaccacagaagacatgctctctgtttggaatcgcgtgtggatcgaggaaaacccatggatggaggataagactcatatttccagttgggaggacgtcccctacttaggcaaacgggaagaccagtggtgcggcagcctgatcgggttgaccgccagggcgacgtgggctacaaatatacaagtggccatcaaccaggttcgaagactgattggaaatgagaactatctcgattacatgatctcgatgaagcggttcaaaaatgaatccgaccctgagggtgcactttggtga

SEQ ID NO: 13588 - RNA, 9879 nt, synthetic construct
  misc_feature 1..9879: note = derived and/or modified CDS sequence (opt3) from DENV-1__FJ024435__SS-prME
  source 1..9879: mol_type = other RNA
agcgtgaccatgctgctcatgcttatgcccacagccctggctttccacttgactacgagaggaggggaacctcatatgatcgtctccaagcaggaaagaggaaaatctttactgtttaagacctcagccggtgttaatatgtgcacactgattgccatggacctcggcgagctgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttaccgctctgtttctggcacatgccattggcacgtcgatcactcagaagggcattatcttcatactcttaatgctggtgacaccatcaatggctatgcgctgcgtcgggatcggaagcagagattttgtggagggtcttagtggcgccacctgggtagacgttgtgttggagcacgggtcctgtgtcactacaatggcgaaggataaacccaccctggacattgaactactcaagacggaggtgaccaaccctgcagtgctgaggaaactttgcatcgaagccaagatttctaatacaactaccgatagccggtgtccaacacaaggagaggctactctggtcgaagaacaagacgccaacttcgtttgccgccgaacctttgtggatagaggctggggtaatgggtgtggattgttcggcaaaggctccctcatcacatgcgcaaagtttaagtgcgtaaccaaactggaggggaagatagtgcagtacgaaaacttaaaatattcagtcattgtgactgttcacacgggagaccagcatcaagtgggtaatgagagtacagaacacggcaccactgctaccatcacaccccaggcccctaccactgagattcagctgacagactacggggcgctcacgcttgattgtagcccaaggaccggactggacttcaacgaaatggtcttgctaactatgaaggagaaatcttggctggtgcataagcagtggtttctcgatctgccgcttccctggacatccggcgcctcaaccagccaagagacatggaatcggcaggacctgttggtaactttcaaaaccgcacacgctaagaagcaggaagttgtggtcctcggtagtcaagagggggccatgcacacggctctgaccggcgccacagaaatccagacttctggaaccacaactatctttgcaggccatttaaaatgccgtctgaagatggataaactaaccctcaaggggatgtcctatgtgatgtgtacgggtagcttcaaactggagaaggaacttgccgagacacagcacggaaccgtcttggtgcagattaagtacgagggcactgacgctccttgcaaaataccattctcgacacaagatgaaaagggggttacccagaacggacgcctgatcactgcgaatcccattgtgaccgacaaagagaagcctgtaaacatcgaagcagagccaccctttggcgagtcttatatagtcattggtgccggggaaaaagctctcaagctgtcctggttcaagaaaggctcaagtatcggaaagatgtttgaggccacagcaagaggcgccaggcggatggctatccttggggatacggcctgggacttcggaagcattggtggcgtgtttacctccgttgggaaactggtgcatcagatcttcggaactgcatacggcgtcttgttttctggtgtgagctggacaatgaagattgggataggcgtactcctgacctggttaggactaaattcacgaagtacatccctaagcatgacttgtatcgcggtgggcctcgttaccctgtaccttggggtcatggtgcaggctgattctggatgcgtgattaactggaaaggccgcgaattgaagtgtggttcagggatcttcgtcacgaatgaggttcacacatggaccgaacaatataagtttcaggccgacagtccgaaaagactgagcgcagccatcggaaaggcttgggaggagggcgtgtgcggtattaggtccgccactcggctcgaaaacataatgtggaaacagatctctaacgagctgaatcatattttactggaaaacgacatgaagttcaccgtggtagtcggcgatgtggcagggatccttgctcagggcaagaagatgattcgccctcaacccatggagcacaaatactcgtggaaaagctggggcaaggccaagatcataggggcggacgttcagaatacaacttttatcattgatggaccaaacacccctgaatgtcccgacgatcagagagcctggaatatctgggaggtggaggactatggcttcggtatttttacaacgaacatctggttgaagctcagggattcctacacccaggtctgcgaccaccgtctgatgtcagctgcaataaaagatagtaaggccgtgcatgctgacatggggtattggattgaatctgagaaaaatgaaacttggaagctagcccgggcctccttcatcgaggttaagacatgtatttggccaaaatcccacaccctgtggtcaaacggagtgctcgaaagcgagatgatcatacccaagatctacggcggtcctatttctcaacataattatcgaccaggctacttcactcagacagcggggccgtggcacctgggaaaacttgagttggattttgacctgtgcgaaggcaccacggtagtcgtggatgagcactgcgggaacagaggaccctccttaaggactaccacagtgaccggcaagatcatttacgaatggtgttgccgcagttgtactctccctccactgcggttcagaggtgaggacgggtgctggtatggaatggagatcaggcccgtcaaagaaaaggaggaaaatcttgttaagagcatggtgtctgccggctccggtgaggtagactcatttagtctgggcttgctctgtataagcattatgatcgaagaggtgatgcgctcgcgatggtcccggaaaatgctgatgacagggaccctagctgtcttctttctgctcatcgtgggacagctgacatggaacgatcttattcgtttgtgcatcatggttggcgccaatgcatctgacagaatggggatgggaactacctacctggctttaatggccacgttcaagatgaggcctatgtttgcagtgggcctcctgttccgccggcttacaagcagagaggtcctgctactcaccattggtctgtcattggtggccagtgttgaactgccaaactccttagaggaactcggggatggactggctatgggcataatgatccttaaactgttgactgactttcaatctcatcagctctgggcgaccctgctaagcctgacattcattaagactaccttttcccttcactatgcctggaaaacgatggcaatggtgctctcagtcgtaagcctgttccccttgtgtctgagtacaacctctcagaagactacatggttaccggtgctcctgggctcccttgggtgcaagcctctgaccatgtttttgatcgctgagaataaaatttggggaaggcgaagctggccactcaacgaaggtatcatggccgttggcatagtgtcgatcctgctatcatctctgcttaagaacgatgtccccctcgccgggcctctgattgctggaggcatgttgatcgcatgttacgtgattagtggttccagcgccgacttatctctggagaaagcggctgaggtaagctgggaagaggaagccgagcattccggggcatcacacaatatcctcgtggaagtccaggatgacggaactatgaagataaaagatgaggagcgcgacgatacactgaccattcttctgaaggccacgttgctagctgttagtggcgtgtatcccctgagcatcccagcaactctcttcgtgtggtacttctggcagaagaagaagcagcggtctggcgtcctgtgggacaccccttcacccccagaagtggagagagccgttcttgatgacgggatctataggattatgcagcgtggattactgggtcgcagccaggtaggcgtgggggtctttcaagaaaacgtgttccatacaatgtggcacgttacccggggagcggtgctcatgtaccagggcaaaagattggagccgagttgggctagcgtcaagaaagacctgatatcctacggtgggggatggaggctccagggctcttggaatacaggcgaggaagtgcaggtaatcgccgtcgagcctgggaagaaccccaaaaatgtgcaaactgcaccaggaacctttaagacgcccgaaggtgaggttggcgccattgctctggatttcaagcctgggacatcgggaagcccaatcgtgaaccgagaaggcaaaattgtcggtctttatgggaatggagtggttactacctcaggcacatacgtgtccgccatcgcacaggctaaggccagtcaggagggccccctgcctgagatagaagacgaggtctttcggaaacgcaacttgaccatcatggatctacacccggggtctggaaagactagaaggtatctgccagcgattgtgcgggaagccatcaaacgaaagctcagaaccttaattctggcacccacacgcgtagtggctagcgagatggccgaagctcttaagggtatgcctatcaggtaccaaacgactgcagttaaatccgagcataccggcaaggagatagtcgacctgatgtgccacgccacattcaccatgcgtctcttgtcaccagtgcgggtgcccaattataacatgattatcatggatgaagcccattttactgacccttctagcatcgctgcgagagggtacattagtacaagggtcggaatgggcgaggcagccgctatcttcatgaccgccacgccgcccggttccgtagaagcatttccacagagcaatgccgtgatacaggatgaggaacgcgacattcctgagcgatcttggaactcagggtatgagtggatcactgatttccccggaaaaacagtttggtttgtgccatccattaagagtggcaatgacatcgctaactgtctgaggaaaaatggcaagcgggtcatacagctcagcaggaagaccttcgataccgaataccagaaaactaagaacaacgactgggactacgtggttacaaccgatatttcggagatgggggcgaatttccgcgccgaccgtgtgatcgatcctagacggtgcctgaaacccgtcatccttaaggacggaccagaaagggtgattctagcaggtccgatgcctgtaacagtggcttctgccgcacagcgccgaggcagaatcgggcggaaccacaataaagagggagatcagtatatttacatgggccagcccctgaacaatgacgaggatcatgcccactggactgaagctaagatgttgttagacaacataaatacgccagagggtatcattcccgccctgtttgaacctgagagggaaaagtccgcggcaatcgatggggagtatcgcctcagaggcgaggccaggaaaaccttcgttgaactgatgcggcgtggagaccttccagtctggctgagctacaaggtggcttcagagggctttcaatatagtgatcgccgatggtgcttcgacggggaaagaaacaatcaggtgctcgaggaaaacatggatgtcgagatctggacaaaagagggagaaaggaagaaattgcggccccgctggctggacgccagaacttactctgaccctctagctctgagggagtttaaggagttcgcagccggtcggcgatccgttagcggcgatctcattcttgagatagggaaactgccgcagcacttaacccagagagctcaaaatgccttggacaacctggtgatgctccataattcagaacagggaggccgcgcatataggcacgcgatggaggagctgccagatacaatcgaaacccttatgctgctcgccttgattgctgtactgactggtggggtgacgttatttttcctaagtggccggggactgggcaagaccagcatcgggctcctttgtgtcatggcctcctctgtgctgttgtggatggcaagcgttgagccccattggattgctgcctccatcatactggaatttttcctcatggtgctgcttatccctgagcccgaccgtcagagaacaccacaggataaccaactcgcatacgtcgtaattggactgttgtttatgatcctgactgtggccgctaatgagatgggtttactagaaaccacaaagaaagacctgggcattgggcacgttgcggtggagaaccaccatcacgccgcaatgctcgatgtcgaccttcatcctgcttcagcctggaccctgtacgccgtggcaactacaatcataacgcccatgatgaggcacaccattgaaaacactacagctaatatctctttgaccgccattgcgaaccaggctgccatcctgatgggactcgataagggctggccaataagtaaaatggacatcggtgtccctctgcttgcattagggtgctattcgcaagtgaatccgctgaccctcacagccgctgttttgatgctggtggcacattacgccattatcggccccggactacaagcgaaggctactcgcgaggcccagaaacggacggcagccggcattatgaagaacccaaccgtagatgggatcgtggctatagacctggatcctgtcgtttatgacgccaagttcgaaaaacagctcggacagattatgcttctgatcttgtgtacaagccaaatcctgctcatgcgaactacctgggcactgtgcgagtccattacattagctaccggcccccttactacgctgtgggagggttctccagggaagttttggaatacaaccatcgccgtgtcaatggcgaacatattcagaggaagctacctcgccggcgcaggtctagctttctccctgatgaaaagtttgggcgggggaaggcgcggcactggggcccagggagaaaccctgggcgagaagtggaaacggcagctcaatcagctttctaagagcgaatttaacacatataagagatcaggtattatggaggtcgaccgttccgaagcaaaagaggggctgaagaggggagagactaccaaacacgctgtgagtcggggcacagccaagttgcgctggttcgtagaacgaaatctggtgaaacctgagggtaaggttatcgatctcggctgtgggagaggaggctggagctactattgcgccgggttaaagaaagtgacggaagtcaagggatacaccaaaggcggtcccgggcacgaggaaccgattccaatggcgacttacggatggaacctggtgaaacttcattctggcaaagacgtctttttcatccctcccgagaagtgtgatacactgctatgcgacataggcgagtcctcaccaaatcccaccatcgaagaggggaggactctccgggtgctgaaaatggttgaaccttggttgcgcggaaaccaattttgtattaagatcctgaatccgtatatgcccagcgtagtggagacactcgagcagatgcagagaaagcacggtggcatgcttgtcaggaacccactgtcgcgaaattctacccatgaaatgtactgggtgagttgcgggacgggaaacattgtttccgctgtgaatatgaccagccggatgttactgaaccgtttcacaatggcacacagaaaacctacttatgagcgcgatgtcgacttgggcgccggtaccaggcacgtggctgtagaacccgaggtggccaacctcgatatcattgggcagcggatcgaaaatataaagcatgagcacaaatcaacatggcattacgacgaggataacccttataagacttgggcataccacggatcctatgaagttaaaccatctggcagcgccagttccatggtcaatggcgtggtgaagctgctaaccaagccctgggacgtcattcctatggttacacaaatcgctatgaccgatactacgccatttgggcagcagagagtgttcaaagagaaggtagacacacgcacccccaaagcgaagaggggaactgcccaaatcatggaagtgaccgcaaaatggctttggggttttctgagccgaaacaagaagccgcggatttgtacaagagaggagttcacgaggaaagtccgctctaatgctgccataggcgcagtgtttgttgacgagaaccagtggaactcagccaaggaggctgtggaagatgagcgtttctgggacctcgtccatcgggaaagagagctgcacaaacaggggaagtgcgcaacctgcgtgtacaacatgatgggaaaaagggaaaagaagttgggcgagtttggtaaagcgaaggggagtcgcgcaatctggtacatgtggctgggagcccgattcctcgagttcgaagctcttggctttatgaatgaggatcactggttctcccgggaaaacagcctgtctggcgtagagggggagggattacataaactgggttatattttgagagacatctcgaagattcctggcgggaatatgtacgccgatgacactgcaggatgggatacaaggatcaccgaagacgatctccagaacgaggctcgcataactgacatcatggaaccagagcacgccctgctagctaaatcaatttttaaacttacatatcaaaataaagttgtgagagtccagcggcccgccaagaacggcaccgtgatggatgtgatcagcaggcgtgaccagcgaggttccgggcaggtcggaacatacggcctgaatactttcaccaacatggaagcacaactcattcgccagatggagagtgagggcatcttttctcctagcgaactggagacgccaaacttggcggaaagagttttagattggctggagaagtatggggtggaacggctcaaaaggatggccatatccggagacgactgtgtagtgaagcccattgatgaccgcttcgctaccgcccttacagcactgaatgatatgggtaaagtcagaaaggacatcccgcagtgggagccttcaaaaggctggaacgattggcagcaagtgcccttttgcagtcatcacttccaccagctaatcatgaaggacgggcgggagattgttgtgccatgtaggaatcaggatgaactggtcggacgagctcgtgtgtctcagggcgccggttggagcctcagagagactgcatgcttggggaagtcctacgcccaaatgtggcagctgatgtattttcatcgccgggaccttaggctggcggctaacgccatatgttcagcagtacctgttgattggatccccaccagcagaacaacttggtctattcacgcccatcaccagtggatgaccacggaagacatgctctccgtgtggaatcgcgtctggatcgaggaaaacccatggatggaggataaaacacatattagtagctggggagacgtgccctacttaggcaagcgggaggaccaatggtgcggctcgctgatcgggttgaccgctagggccacttgggcaacaaatatacaggttgctatcaaccaggtgcgaagactgattggaaatgaaaactacctcgattatatgacctccatgaaacggttcaagaatgagtctgaccctgaaggtgccctttggtga

SEQ ID NO: 13589 - RNA, 9879 nt, synthetic construct
  misc_feature 1..9879: note = derived and/or modified CDS sequence (opt3) from DENV-1__FJ024436__SS-prME
  source 1..9879: mol_type = other RNA
agcgtgacaatgctgctcatgcttatgcccacagcactggctttccacttgactacgagaggaggggagcctcatatgatcgtctccaagcaggaaagggggaaatctttactgtttaagacctcagccggtgttaacatgtgcacattaattgcaatggacctcggcgagctgtgtgaagatactatgacctacaaatgcccacggattacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccgtgctgaggaaactttgcattgaagctaagatctctaatacgaccacagatagccggtgtccaactcaaggagaggccaccctggtcgaagaacaagacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaatacggcacgacagccaccattactccccaggcgcctagcaccgagatccagctgacagactatggggccctcacccttgattgttctccaaggactggactggacttcaacgaaatggtcttgctaacaatgaaggagaaatcctggctggtgcacaagcagtggtttctcgatctgccgcttccctggacgtcaggcgcaagcaccagtcaagagacttggaatcggcaggacctgttggtaacattcaaaaccgctcatgccaagaagcaggaagttgtggtcctcggttctcaagagggggctatgcacacagccctgactggcgcaaccgaaatccagacgtccggaaccacaactatttttgccggccacttaaaatgccgtctgaagatggataaactaaccctcaaggggatgagctacgtgatgtgtacaggatcgttcaaactggagaaggaagtcgctgagactcagcatggtaccgtgcttgttcagataaagtatgagggcacggacgcgccttgcaaaatcccattctctacacaagatgaaaagggggtgacccagaacggacgcttgattactgcaaatcccatcgtaacagacaaagagaagcctgtcaacatagaagccgagccaccctttggcgagtcctacattgtgatcggtgctggggaaaaagccctgaagctctcatggttcaagaaaggcagtagcatcggaaagatgtttgaggcaaccgccagaggcgctaggcggatggccattctgggggatactgcatgggacttcggatccatcggtggcgtttttacctctgtggggaaacttgtccaccagattttcggaacagcgtacggcgtgctgtttagcggtgtatcatggacgatgaagatagggatcggcgtgttgctcacctggctgggattaaatagtcgatccactagcctgtctatgacatgtattgctgttggcctagtcaccctctatctgggggtgatggtgcaggccgattcaggatgcgtcatcaactggaaaggccgcgaacttaagtgtggtagtgggatcttcgttacaaatgaggtgcatacttggaccgaacaatacaagtttcaggcagacagcccgaaaagattgtccgccgctattggaaaggcctgggacgagggcgtgtgcggtataaggtctgcaacgcggctggagaacatcatgtggaaacagatttcgaacgaactcaatcacatcctgttagagaacgatatgaagttcacagtagtcgtgggcgacgttgctgggattctggcccagggcaagaagatgatccgccctcaacccatggaatataaatacagctggaagtcctggggcaaggcgaaaataatcggggccgatgtgcagaataccacttttattatcgacggaccaaacacccctgagtgtcccgatgaccagagagcttggaatatttgggaagtcgaggattatggcttcggtatctttacaactaacatatggcttaagttgagggactcatacacccaggtgtgcgatcatcgtctcatgagtgcagccattaaagactctaaggctgttcacgccgatatggggtattggatcgagagcgagaaaaatgagacatggaagctggcacgggcgtccttcattgaagtgaagacgtgtatctggccaaaatcacacaccctatggagcaacggagtactggagtctgaaatgataatccccaagatttacggcggtcctatctcccaacataattaccgaccaggctatttcactcagacagccgggccgtggcacctcggaaaactggagcttgactttaacttgtgcgagggcaccactgtcgtggtggatgaacattgcgggaatagaggacccagtctgaggacaaccacggtcactggcaagattatccacgagtggtgttgccgcagctgtaccttacctccactccggttcaaaggtgaagacgggtgctggtacggaatggagataagacccgttaaggagaaggaagagaacctggtgaaatctatggtatccgctggctcaggtgaagtggacagttttagccttggcctgttgtgtatttcgatcatgatcgaggaagtcatgaggtcccgctggtctcgaaagatgctcatgacagggaccctggccgtgttctttctactgattatgggacagctcacttggaatgatctgatccggctttgcattatggttggcgcaaacgctagcgaccgtatggggatgggaacaacctatttggccctgatggcaacattcaaaatgagacctatgttagccgtgggcctcctgtttaggcgccttacttcacgggaggtcctgctactcaccataggtctgagtttggtggcttccgttgagctgccaaattctttagaagaactcggggatggactggcgatgggcatcatgattcttaagctgttgacggacttccaaagccaccagctctgggccacactgctatccctgacctttatcaaaactacctactcacttcattatgcatggaagacaatggctatggtgctcagcattgtcagtctgttccccttgtgtctgtctactacctcccagaagacgacatggttaccggtactcctgggcagccttgggtgcaaacctctgaccatgtttttgatcgccgaaaacaagatatggggaagaaaatcgtggccactcaacgagggtatcatggccgtgggcattgtttcaatcctgctatctagtctgcttaagaatgatgtgcccctcgctgggcctctgattgcaggaggcatgttgatcgcctgttacgtcatatccggtagctctgcggacttaagcctggaaaaagctgccgaggtgtcctgggaggaagaggcagaacactcaggggccagtcataacattctcgtagaggtgcaggatgacggaactatgaagatcaaagatgaagagagggacgatacactgaccatccttctgaaggctactttgctagcagtcagcggcgtttatcccctgtctattccagccacactcttcgtgtggtacttttggcaaaagaaaaagcagcgatccggcgtgctgtgggacaccccttcacccccagaggtcgaacgcgcggtgcttgatgacgggatataccggatcatgcagagaggattactgggtaggagtcaggttggcgtaggggtgttccaagagaatgtcttccacacgatgtggcatgtgactcgtggagctgttctcatgtatcagggcaaacgcttggaaccgagctgggcctccgtgaagaaagacctgatttcttacggtgggggatggcggctccagggctcgtggaacaccggcgaggaggtccaggtgatcgcagtagaacctgggaagaatcccaagaacgtccaaacagccccaggaacctttaaaacaagcgagggtgaagtgggcgctattgccctggatttcaagcccgggacttcaggatcccctatcgttaatagagagggcaaaatagtgggtctttatgggaacggagtcgtgaccacgagtggcacatacgtttctgcaatcgctcaggccaaggcgagccaggaaggcccactgcccgagattgagaatgaagtgtttaggaaacgaaacttgactatcatggacctacaccctgggtccggaaagacccggcgctatctgccggccattgtcagagaggcaatcaagaggaaactccggacattaatactggctccaacccgagtggtagcctcagaaatggctgaggcacttaagggtatgcccattagataccaaactaccgccgtgaaatctgaacacacaggcaaggagatcgttgatctgatgtgccatgccacgttcactatgcgcctcttgagccctgtcagggtgccaaattataacatgatcattatggacgaggctcactttaccgatcccagttccatcgcggcacgtgggtacataagcacacgggtgggaatgggcgaagccgctgccattttcatgaccgcaactcctccgggttctgtcgaggcctttccccagtcaaatgctgtaatccaggacgaagagagagatattccagaaaggtcctggaacagtgggtacgagtggatcacagacttccctggaaaaaccgtgtggtttgttcccagcataaagtcgggcaatgatattgcgaactgtctgcgcaagaacggcaaacgagtgatccagctctctagaaagacgttcgacactgagtatcagaaaacaaagaataacgattgggactacgtcgtgaccaccgacatctccgaaatgggggccaattttcgggcagatagggttattgacccacgccgttgcctgaaacctgtgatccttaaggatggacccgagagagtcattctagctggtccaatgccggtgactgtagccagcgcagcccagcggaggggccgcatagggcgaaaccataataaggaaggagaccagtatatctacatgggccagcctctgaacaatgatgaggaccacgctcattggacagaggccaaaatgttgttagataacattaatacccccgaaggtatcatcccagcgctgttcgagcccgaaagagagaagtcagcagccattgacggggaatatcggctcaggggcgaggctcgcaaaacattcgtggagctgatgagaaggggagatcttcctgtttggctgagttacaaggtcgcctctgaaggctttcaatattccgaccggcgttggtgcttcgatggggagcgcaacaatcaggtgctcgaagagaacatggacgtggaaatatggactaaagagggagagcgaaagaaattgagaccaaggtggctggatgctcggacgtacagcgaccccctagcactgcgcgaatttaaggagttcgccgctggtagaaagtcagtcagtggcgacctcatccttgaaattgggaaactgcctcagcacttaacccagagggcccaaaatgcattggataacctggttatgctccacaatagcgagcagggaggccgggcgtaccgacatgccatggaggaactgccggacacaatcgagactcttatgctgctcgctttgattgccgtgctgaccggtggggtaacattatttttcctatccggcagaggactgggcaagacctctatcgggctcctttgtgtgatggcaagctccgtcctgttgtggatggcttcagtggaaccacactggatagccgcatctatcattctggagtttttcctcatggttctgcttatccccgaacctgatcgccagaggactccccaggacaaccaactcgcctatgtggtcattggactgttgtttatgatcctgacggtagctgcgaacgagatgggtttactagagaccaccaaaaaggatctgggcatagggcatgtggccgttgaaaatcaccaccatgcagctatgctcgacgtggatcttcacccagccagtgcctggactctgtacgcagtcgctaccacaattatcacccctatgatgcggcatactattgagaacacaacggccaatatctcgttgaccgcgatagctaaccaggccgcaatcctgatgggactcgacaaaggctggcccattagcaagatggatatcggtgtgccactgcttgccttagggtgctattcccaggtcaatcctctgactctcacagctgcagtgttgatgctggttgcccactacgcgattatcggcccgggactacaagctaaggccacccgtgaagcacagaaaagaaccgccgctggcataatgaagaaccccacagtggacgggattgtagccatcgatctggacccagtggtctatgatgcaaaattcgagaagcagctcggacagatcatgcttctgattttgtgtacttctcaaatcctgctcatgaggacgacctgggctctgtgcgaatcaataacattagccactggccctcttaccacactgtgggagggtagccccgggaaattttggaataccactattgcggtttccatggccaacatcttccgcggaagttacctcgcaggcgctggtctagccttttctctgatgaaaagcctaggcgggggacggcgaggcacgggggcacagggagagacactgggcgaaaagtggaaaagacagctcaatcagctttcaaagtccgagttcaacacctataaaaggagtggtattatggaagtggaccgcagcgaggctaaggaagggctgaaacggggagagactaccaagcatgccgtctctagaggcacagccaagttgcgttggttcgtggagaggaatctggtaaaaccagaaggtaaggtgatcgacctcggctgtgggcggggaggctggtcctactactgcgcggggttgaaaaaggttactgaggtgaaaggatataccaagggcggtcctgggcacgaggagcccataccgatggctacatacggatggaacctggtcaaacttcactcaggcaaggatgtgtttttcatcccacctgaaaagtgtgacacgctgctatgcgatattggcgagagctcgcccaatccaaccatcgaggaagggcgcactctccgagtcctgaaaatggtggagccctggttgagaggaaaccaattttgtattaagatcctgaatccttatatgccgtctgttgtagaaacactcgagcagatgcagaggaaacatggtggcatgcttgtgcggaaccccctgagtcgcaattccacccacgagatgtactgggtcagctgcgggactggaaacattgtgtcagcagttaacatgacatccagaatgttactgaataggttcaccatggcccatcgaaagccaacgtatgaacgggacgtggatttgggcgctggtacccgtcacgtcgccgtggagcctgaagtagcaaacctcgacatcatagggcagagaattgagaatatcaaacacgaacataagtctacatggcactacgatgaggacaacccctataagacttgggcctaccatggaagctacgaggtgaaacctagtggctccgctagctctatggttaatggcgtcgtgaagctgctaaccaaaccatgggatgtgatccccatggtcacacaaattgcgatgactgacaccacaccttttgggcagcagcgcgttttcaaggaaaaagtggataccaggactccaaaggccaagcggggaacggcacaaataatggaggtaacagctaaatggctttggggttttctgtcaagaaacaagaaaccccgcatctgtaccagggaagagttcactcgaaaggtgcggagtaatgccgcaattggcgccgtctttgtggacgaaaaccagtggaactccgctaaagaggccgttgaggacgaaagattctgggatctcgtgcacagggagcgcgaactgcataagcaggggaagtgcgcgacctgcgtctataacatgatgggaaaacgtgagaagaaattgggcgaatttggtaaggcaaaagggagccgggccatctggtacatgtggctgggagctagattcctcgagtttgaggcccttggcttcatgaatgaagaccactggttctctagggagaactcgctgtcaggcgtggaaggggagggattacacaagctgggttatattttgcgcgatatcagcaaaataccgggcgggaatatgtacgcagacgatacagctggatgggacacgcgaatcaccgaggatgacctccagaacgaagccaagattactgatatcatggagcctgaacatgctctgctagccaagtccatttttaaacttacatatcaaaataaggtagttcgggtgcagagaccagccaaaaatggcaccgtcatggacgtgatcagtaggcgcgatcagagaggttctggacaggtgggaacttacggcctgaacacattcaccaatatggaggcgcaactcatacggcagatggaaagcgagggcatattttccccctcagagctggaaacacctaacttggccgggagggtcttagactggctggagaagcacggagttgaacgtctcaaacgaatggctatcagtggtgatgactgtgtggtaaagccaatcgacgatcgcttcgccactgcacttaccgctctgaatgacatgggcaaggtgagaaaagatattccccagtgggagccgtctaaggggtggaacgactggcagcaagtccctttttgcagccatcacttccaccagctaataatgaaagatggacgggaaatcgtggttccctgtaggaatcaggacgagctggtgggccgcgccagagtctcccagggtgcagggtggtcactccgggagacggcctgcttgggaaagagctatgcgcaaatgtggcagctgatgtactttcataggcgagatcttcgtctggctgccaacgcaatttgttctgccgtgccagtagactgggttcctacctccagaacaacttggagtatccacgctcatcaccagtggatgaccacagaagatatgctcagcgtgtggaatcgcgtctggattgaggaaaacccctggatggaggacaaaactcatatctcgtcctggggcgatgtgccatacttaggcaagcgggaagaccaatggtgcgggtctctgataggattgaccgccagggcaacgtgggctacaaatatccaggttgccattaaccaggtgagacgcctgatcggtaatgagaactatctcgactacatgacctcaatgaagcggttcaaaaatgagagcgatcccgaaggcgcgctttggtga

SEQ ID NO: 13590 - RNA, 9879 nt, synthetic construct
  misc_feature 1..9879: note = derived and/or modified CDS sequence (opt3) from DENV-1__FJ024472__SS-prME
  source 1..9879: mol_type = other RNA
agcgtgaccatgctgctcatgcttatgcccacggccctggctttccacttgactacgagaggaggggaacctcatatgatcgtctccaagcaggaaagaggaaaatctttactgtttaagacctcagccggtgttaatatgtgcacactgattgccatggacctcggcgagctgtgtgaagatactatgacctacaaatgcccacggataacagagaccgaaccggacgatgtggactgttggtgcaatgcgactgatacatgggtgacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccgggagcttcaaactggagaaggaacttgccgagacgcagcacggtacagtcttggtgcagataaagtacgagggcaccgacgctccttgcaaaatcccattctcgactcaagatgaaaagggggttacacagaacggacgcctgattaccgcgaatcccatcgtgactgacaaagagaagcctgtaaacatagaagcagagccaccctttggcgagtcttatattgtcatcggtgccggggaaaaagctctcaagctgtcctggttcaagaaaggctcaagtatcggaaagatgtttgaggccaccgcaagaggcgccaggcggatggctattcttggggatacagcctgggacttcggaagcatcggtggcgtgtttacgtccgttgggaaactggtgcatcagattttcggaaccgcatacggcgtcttgttttctggtgtgagctggactatgaagatagggatcggcgtactcctgacatggttaggactaaattcacgaagtacctccctaagcatgacatgtattgcggtgggcctcgttactctgtaccttggggtcatggtgcaggctgattctggatgcgtgatcaactggaaaggccgcgaattgaagtgtggttcagggatcttcgtcaccaatgaggttcacacgtggacagaacaatataagtttcaggccgacagtccgaaaagactgagcgcagccgtgggaaaggcttgggaggagggcgtgtgcggtattaggtccgccacccggctcgaaaacataatgtggaaacagatctctaacgagctgaatcatattttactggaaaacgacatgaagttcactgtagtcgtgggcgatgttgcagggatccttgctcagggcaagaagatgattcgccctcaacccatggagtacaaatattcgtggaaaagctggggcaaggccaagatcataggggcggacgtgcagaataccacatttatcattgatggaccaaacactcctgaatgtcccgacgatcagagagcctggaatatctgggaggtcgaggactacggcttcggtatttttaccacaaacatctggttgaagctcagggattcctatacacaggtgtgcgaccaccgtctgatgtcagctgcaataaaagatagtaaggccgttcacgctgacatggggtactggattgaatctgagaaaaatgaaacctggaagctagcccgggcatccttcatcgaggtgaagacttgtatttggccaaaatcccatacactgtggtcaaacggagtactcgaaagcgagatgatcatacccaagatctatggcggtcctatttctcaacacaattaccgaccaggctacttcacccagactgcggggccgtggcatctgggaaaacttgagttggattttgacctgtgcgaaggcacaaccgtcgtggtggatgagcactgcgggaacagaggaccctccttaaggacgactaccgtcacaggcaagatcattcacgaatggtgttgccgcagttgtaccctccctccactgcggttcagaggtgaggacgggtgctggtatggaatggagatcaggcccgttaaagaaaaggaggaaaatcttgtaaagagcatggtatctgccggctccggtgaggtggactcatttagtctgggcttgctctgtataagcattatgatcgaagaggtcatgcgctcgcgatggtcccggaaaatgctgatgactgggacactagctgtgatcttcctgctcattatgggacagctgacctggaacgatcttatccgtttgtgcattatggttggcgccaatgcatctgacagaatggggatgggaacaacttacctggctttaatggccacctttaagatgaggcctatgttcgcagtgggcctcctgtttcgccggcttacgagcagagaggtcctgctactcacaataggtctgtcattggtggccagtgttgaactgccaaactccttagaggaactcggggatggactggctatgggcatcatgattcttaaactgttgaccgacttccaatctcatcagctctgggcgactctgctaagcctgacctttatcaagacaactttctcccttcactatgcctggaaaaccatggcaatggtgctctcaattgtcagcctgtttcccttgtgtctgagtacgacatctcagaagaccacttggttaccggtactcctgggctcccttgggtgcaagcctctgacaatgttcttgatcgctgagaataaaatatggggaaggcgaagctggccactcaacgaaggtatcatggccgtgggcattgtttcgatcctgctatcatctctgcttaagaacgatgtgcccctcgccgggcctctgattgctggaggcatgttgatcgcatgttacgtcataagtggttccagcgccgacttatctctggagaaagcggctgaggtgagctgggaagaggaagccgagcattccggggcatcacacaatattctcgtagaagtgcaggatgacggaaccatgaagatcaaagatgaggagcgcgacgatactctgacaatccttctgaaggccaccttgctagctgtcagtggcgtttatcccctgagcattccagcaacgctctttgtgtggtacttctggcagaagaagaagcagcggtctggcgtgctgtgggacactccttcacccccagaagtcgagagagccgtgcttgatgacgggatatataggatcatgcagcgtggattactgggtcgcagccaggttggcgtaggggtgttccaagaaaacgtctttcataccatgtggcacgtgacacggggagcggttctcatgtaccagggcaaaagattggagccgagttgggctagcgtgaagaaagacctgatttcctacggtgggggatggaggctccagggctcttggaataccggcgaggaagtccaggtgatcgccgtagagcctgggaagaaccccaaaaatgtccaaacagcaccaggaactttcaagacccccgaaggtgaggtgggcgccattgctctggattttaagcctgggacgtcgggaagcccaatcgttaaccgagaaggcaaaatagtgggtctttatgggaatggagtcgtgacaacttcaggcacctacgtttccgccatcgcacaggctaaggccagtcaggagggccccctgcctgagattgaagacgaggtgttccggaaacgcaacttgacaatcatggatctacacccggggtctggaaagaccagaaggtatctgccagcgattgtccgggaagccatcaaacgaaagctcagaactttaatactggcacccacccgcgtggtagctagcgagatggccgaagctcttaagggtatgcctattaggtaccaaacaacggcagtgaaatccgagcatactggcaaggagatcgttgacctgatgtgccacgccacctttacaatgcgtctcttgtcaccagtccgggtgcccaattataacatgatcattatggatgaagcccatttcaccgacccttctagcatcgctgcgagagggtacataagtactagggtgggaatgggcgaggcagccgctatttttatgacagccaccccgcccggttccgtcgaagcattcccacagagcaatgccgtaatccaggatgaggaacgcgacattcctgagcgatcttggaactcagggtatgagtggatcacggattttcccggaaaaactgtgtggttcgttccatccataaagagtggcaatgacattgctaactgtctgaggaaaaatggcaagcgggtgatccagctcagcaggaagacatttgataccgaataccagaaaaccaagaacaacgactgggactacgtcgtgactacagatatctcggagatgggggcgaatttccgcgccgaccgtgttattgatcctagacggtgcctgaaacccgtgatccttaaggacggaccagaaagggtcattctagcaggtccgatgcctgtgaccgtagcttctgccgcacagcgccgaggcagaatagggcggaaccacaataaagagggagatcagtatatctacatgggccagcccctgaacaatgacgaggatcatgcccactggacagaagctaagatgttgttagacaacattaatactccagagggtatcatccccgccctgttcgaacctgagagggaaaagtccgcggcaattgatggggagtatcgcctcagaggcgaggccaggaaaacgtttgtggaactgatgcggcgtggagaccttccagtttggctgagctacaaggtcgcttcagagggcttccaatatagtgatcgccgatggtgctttgacggggaaagaaacaatcaggtgctcgaggaaaacatggatgtggagatatggaccaaagagggagaaaggaagaaattgcggccccgctggctggacgccagaacatactctgaccctctagctctgagggagttcaaggaatttgcagccggtcggcgatccgtcagcggcgatctcatccttgagattgggaaactgccgcagcacttaactcagagagctcaaaatgccttggacaacctggttatgctccataattcagaacagggaggccgcgcatataggcacgcgatggaggagctgccagataccatcgaaacacttatgctgctcgccttgattgctgtgctgaccggtggggtaactttattctttctaagtggccggggactgggcaagacgagcatcgggctcctttgtgtgatggcctcctctgtcctgttgtggatggcaagcgtggagccccattggatagctgcctccatcattctggagttctttctcatggttctgcttatccctgagcccgaccgtcagagaaccccacaggataaccaactcgcatacgtggtcattggactgttgttcatgatcctgacagtagccgctaatgagatgggtttactagaaactaccaagaaagacctgggcatagggcacgtggcggttgagaaccaccatcacgccgcaatgctcgatgtggaccttcatcctgcttcagcctggacactgtacgccgtcgcaaccactattatcacacccatgatgaggcacacgattgaaaacaccactgctaatatctctttgacagccatagcgaaccaggctgccatcctgatgggactcgataagggctggccaattagtaaaatggacatcggtgtgcctctgcttgcattagggtgctattcgcaggtcaatccgctgaccctcaccgccgctgtgttgatgctggttgcacattacgccattatcggccccggactacaagcgaaggctacacgcgaggcccagaaacggactgcagccggcataatgaagaacccaacggtggatgggattgtagctatcgacctggatcctgtggtctatgacgccaagtttgaaaaacagctcggacagatcatgcttctgattttgtgtaccagccaaatcctgctcatgcgaacaacttgggcactgtgcgagtccataaccttagctacaggcccccttaccactctgtgggagggttctccagggaagttctggaatacgacaattgccgtttcaatggcgaacatctttagaggaagctacctcgccggcgcaggtctagctttctccctgatgaaaagtttgggcgggggaaggcgcggcaccggggcccagggagaaactctgggcgagaagtggaaacggcagctcaatcagctttctaagagcgagttcaacacctataagagatcaggtattatggaggtggaccgttccgaagcaaaagaggggctgaagaggggagagacaactaaacacgctgtcagtcggggcaccgccaagttgcgctggtttgtggaacgaaatctggtaaaacctgagggtaaggtgatcgatctcggctgtgggagaggaggctggagctactattgcgccgggttaaagaaagttacagaagtgaagggatacacgaaaggcggtcccgggcacgaggaaccgataccaatggcgacctacggatggaacctggtcaaacttcattctggcaaagacgtgttctttatccctcccgagaagtgtgatactctgctatgcgacattggcgagtcctcaccaaatcccacaatcgaagaggggaggaccctccgggtcctgaaaatggtggaaccttggttgcgcggaaaccaattctgtattaagatcctgaatccgtatatgcccagcgttgtagagactctcgagcagatgcagagaaagcacggtggcatgcttgtgaggaacccactgtcgcgaaattctacacatgaaatgtactgggtcagttgcgggaccggaaacattgtgtccgctgttaatatgacgagccggatgttactgaaccgttttaccatggcacacagaaaacctacatatgagcgcgatgtggacttgggcgccggtactaggcacgtcgctgtggaacccgaggtagccaacctcgatatcatagggcagcggattgaaaatatcaagcatgagcacaaatcaacctggcattacgacgaggataacccttataagacatgggcataccacggatcctatgaagtgaaaccatctggcagcgccagttccatggttaatggcgtcgtgaagctgctaactaagccctgggacgtgatccctatggtcacccaaattgctatgacagataccactccattcgggcagcagagagtttttaaagagaaggtggacacgcgcacacccaaagcgaagaggggaaccgcccaaataatggaagtaactgcaaaatggctttggggtttcctgagccgaaacaagaagccgcggatctgtaccagagaggaatttacaaggaaagtgcgctctaatgctgccattggcgcagtcttcgtggacgagaaccagtggaactcagccaaggaggctgttgaagatgagcgtttttgggacctcgtgcatcgggaaagagagctgcacaaacaggggaagtgcgccacgtgcgtctacaacatgatgggaaaaagggaaaagaagttgggcgagttcggtaaagcgaaggggagtcgcgcaatctggtacatgtggctgggagcccgatttctcgagttcgaagctcttggcttcatgaatgaggatcactggttttcccgggaaaacagcctgtctggcgtggagggggagggattacataaactgggttatattttgagagacatctcgaagatacctggcgggaatatgtacgccgatgacaccgcaggatgggatactaggatcacagaagacgatctccagaacgaggctcgcattaccgacatcatggaaccagagcacgccctgctagctaaatcaattttcaaacttacttatcaaaataaagtagttagagtgcagcggcccgccaagaacggcacagtcatggatgtgatcagcaggcgtgaccagcgaggttccggacaggtgggaacctacggcctgaatacatttactaacatggaagcacaactcatacgccagatggagagtgagggcattttctctcctagcgaactggagaccccaaacttggcggaaagagtcttagattggctggagaagtatggggttgaacggctcaaaaggatggccatctccggagacgactgtgtggtaaagcccatcgatgaccgctttgctacggcccttaccgcactgaatgatatgggtaaagtgagaaaggacattccgcagtgggagccttcaaaaggctggaacgattggcagcaagtccccttctgcagtcatcactttcaccagctaataatgaaggacgggcgggagatcgtggttccatgtaggaatcaggatgaactggtgggacgagctcgtgtctctcagggcgccggttggagcctcagagagacagcatgcttggggaagtcctacgcccaaatgtggcagctgatgtatttccatcgccgggaccttaggctggcggctaacgccatttgttcagcagtgcctgtagattggatccccactagcagaaccacatggtctattcacgcccatcaccagtggatgactaccgaagacatgctctccgtttggaatcgcgtgtggatcgaggaaaacccatggatggaggataaaacgcatataagtagctggggagacgtcccctacttaggcaagcgggaggaccaatggtgcggctcgctgatcgggttgacagctagggccacctgggcaactaatattcaggtggctatcaaccaggttcgaagactgattggaaatgaaaactacctcgattatatgacatccatgaaacggtttaagaatgagtctgaccctgaaggtgccctttggtga

SEQ ID NO: 13591 - RNA, 9879 nt, synthetic construct
  misc_feature 1..9879: note = derived and/or modified CDS sequence (opt3) from DENV-1__FJ024439__SS-prME
  source 1..9879: mol_type = other RNA
agcgtgaccatgctgctcatgcttatgcccacagccctggctttccacttgactacgagaggaggggagcctcatatgatcgtctccaagcaggaaagaggaaaatctttactgtttaagacctcagccggtgttaatatgtgcacactaattgccatggacctcggcgagctgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccggtagcttcaaactggagaaggaagtcgccgagacgcagcacggaacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattatcatcggtgccggggaaaaagctctgaagctctcctggttcaagaaaggctcaagtattggaaagatgtttgaggccaccgcaagaggcgccaggcggatggctatcctgggggatacagcctgggacttcggaagcattggtggcgtgtttacgtccgttgggaaacttgtgcatcagatattcggaaccgcatacggcgtcctgttttctggtgtgagctggactatgaagatcgggattggcgtattgctcacatggctgggattaaattcacgaagtacctccttcagcatgacatgtatcgcggtgggcctggttactctatacctcggggtcatggtgcaggctgattctggatgcgtgatcaactggaaaggccgcgaactgaagtgtggttcagggatttttgtcaccaatgaggttcacacgtggacagaacaatataagttccaggccgacagtccgaaaagacttagcgcagccataggaaaggcttgggaggagggcgtgtgcggtatcaggtccgccacccggttggaaaacattatgtggaaacagatctctaacgagctgaatcatattctcctggaaaacgacatgaagtttactgtggtagtcggcgatgtggcagggatcttagctcagggcaagaagatgatacgccctcaacccatggagtacaaatattcgtggaaaagctggggcaaggccaagatcattggggcggacgttcagaataccacattcatcattgatggaccaaacactcctgaatgtcccgacgatcagagagcctggaatatctgggaggtggaggactacggctttggtatattcaccacaaacatttggctgaaacttagggattcctatacgcaggtctgcgaccaccgtttgatgtcagctgcaatcaaagatagtaaggccgtgcacgctgacatggggtactggattgaatctgagaaaaatgaaacctggaagctcgcccgggcatccttcatcgaggttaagacttgtatatggccaaaatcccatacactgtggtcaaacggagtgctagaaagcgagatgatcattcccaagatctatggcggtcctatttctcaacacaattaccgaccaggctactttacccagactgcggggccgtggcatctgggaaaactcgagctggatttcgacctttgcgaaggcacaaccgtagtcgtggatgagcactgcgggaacagaggaccctccttgaggacgactaccgtgacaggcaagatcatacacgaatggtgttgccgcagttgtaccctgcctccattacggtttagaggtgaggacgggtgctggtatggaatggagattaggcccgtcaaagaaaaggaggaaaatctcgttaagagcatggtgtctgccggctccggtgaggtagactcattcagtctgggccttctgtgtatcagcatcatgattgaagaggtgatgcgctcgcgatggtcccggaaaatgttgatgactgggacactcgctgtctttttcctgctaatcatgggacagctgacctggaacgatctcattcgtctgtgcataatggtgggcgccaatgcatctgacagaatggggatgggaacaacttaccttgctttgatggccacctttaagatgaggcctatgttcgcagttggcctgttatttcgccggctcacgagcagagaggtgctgcttctgacaatcggtctatcactcgtcgccagtgtggaactgccaaactccttggaggaactgggggatggattagctatgggcattatgatcctcaaactgcttaccgacttccaatctcatcagctgtgggcgactttgctcagcctgacctttattaagacaactttctccctacactatgcctggaaaaccatggcaatggttctgtcaatcgtgagcctttttcccctctgtctgagtacgacatctcagaagaccacttggttgccggtcctgttaggctccctcgggtgcaagcctctgacaatgttccttatagctgagaataaaatctggggaaggcgaagctggccactgaacgaaggtattatggccgtaggcatcgtgtcgattttgctctcatctctgctaaagaacgatgttcccctggccgggcctcttatcgctggaggcatgctcatagcatgttacgtgattagtggttccagcgccgacctgtctttggagaaagcggctgaggtcagctgggaagaggaagccgagcattccggggcatcacacaatatcttagtggaagtacaggatgacggaaccatgaagatcaaagatgaggagcgcgacgatactctgacaattctcctgaaggccacccttctggctgtgagtggcgtctatcccttgagcataccagcaacgctattcgtttggtacttttggcagaagaagaagcagcggtctggcgtgctgtgggacactccttcacccccagaagtggggagagccgtcctcgatgacggaatctataggattatgcagcgtggtctgcttggccgcagccaggtgggggttggagtattccaagagaacgtgtttcataccatgtggcacgtcacacggggcgcggtgttaatgtaccagggtaaaagactggaaccgagttgggctagcgttaagaaagacctcatctcctacgggggaggctggaggttgcagggctcttggaataccggggaggaggtgcaggtcattgccgtggaacctggaaagaaccccaaaaatgtacaaacagcaccaggtactttcaagacccccgagggcgaagtcggggccatcgctctggattttaagcctggaacgtcgggcagcccaatagtgaaccgagagggtaaaatcgttgggctctatggaaatggcgtggtcacaacttcaggcacctacgtgtccgccattgcacaggctaaggccagtcaggaagggcccctgcctgagatcgaggacgaagttttccggaaacgcaaccttacaattatggatctgcacccgggatctggtaagaccagaaggtatttgccagcgatcgtgcgggaggccataaaacgaaagctaagaactctgattctcgcacccacccgcgtcgtggctagcgaaatggccgaggctttaaagggcatgcctatcaggtaccaaacaacggcagtaaaatccgaacatactgggaaggagatcgtggacctgatgtgccacgccacctttacaatgcgtcttctgtcaccagttcgggtccccaattataacatgattatcatggatgaggcccatttcaccgacccttctagcatagctgcgagaggatacattagtactagggtgggcatgggtgaagcagccgctatctttatgacagccaccccgcccgggtccgtggaggcattcccacagagcaatgccgtcattcaggatgaagaacgcgacatccctgaacgatcttggaactcaggatatgagtggataacggattttcccggcaaaactgtatggttcgtgccatccattaagagtggcaatgacatcgctaactgtctcaggaaaaatgggaagcgggttatccagttgagcaggaagacattcgataccgagtaccagaaaaccaagaacaacgactgggactacgtggtcactacagatatttcggaaatgggagcgaattttcgcgccgaccgtgtgatcgatcctagacggtgcctgaaacccgttattctcaaggacggtccagagagggtgatactggcaggcccgatgcctgtcaccgtggcttctgccgcacagcgccgagggagaatcggacggaaccacaataaagaaggcgatcagtatatttacatgggtcagccccttaacaatgacgaggatcatgcccactggacagaggctaagatgctactggacaacatcaatactccagaagggatcattcccgccttgttcgagcctgaaagggagaagtccgcggcaatagatggcgaatatcgcttaagaggagaggccaggaaaacgtttgtagagctgatgcggcgtggcgacctcccagtgtggctgagctacaaggttgcttcagaagggttccaatatagtgatcgccgatggtgctttgacggagagagaaacaatcaggtccttgaagagaacatggatgtggaaatctggaccaaagagggtgagaggaagaaactgcggccccgctggctcgacgccagaacatactctgaccctttggctctgagggagttcaaggagtttgcagccggccggcgatccgtgagcggggatctaattctggaaatcggaaaactcccgcagcaccttactcagagagctcaaaatgccctggacaacttagtcatgttgcataattcagagcagggcggtcgcgcatataggcaggcgatggaggaactgccagataccattgagacactcatgctgcttgccctgatcgctgttctcaccgggggcgtgactttgttctttctgagtggacggggcttagggaagacgagcataggactactgtgtgtaatggcctcctctgtgctcctttggatggcaagcgtcgaaccccactggatcgctgcctccattatcctggagttctttttgatggtgctgctcattcctgaacccgaccgtcagagaaccccacaagataaccagctggcatacgttgtgatcggtcttctcttcatgatactgacagtcgccgctaatgagatgggcttgctggagactaccaagaaagacttagggattggacatgtagcggtggaaaaccaccaccatgccgcaatgctagatgttgacctgcaccctgcttcagcctggacactctacgccgtggcaaccactatcattacacccatgatgaggcatacgatcgagaacaccactgctaatatatctcttacagccatcgcgaaccaggctgccattctgatgggcttggataagggttggccaatcagtaaaatggacattggggtccctctgctcgcactgggctgctattcgcaagtgaatccgcttaccttaaccgccgctgtcctgatgctcgtggcacactacgccatcataggacccggcttgcaggcgaaggctacacgcgaagcccagaaacggactgcagccgggattatgaagaacccaacggttgatggaatcgtggctatcgacctggatcctgtagtgtatgacgccaagtttgagaaacagctaggccaaattatgctgctcatcctttgtaccagccagatactgttgatgcgaacaacttgggcactgtgcgaatccattaccctcgctacaggtcccctgaccactttatgggaggggtctccaggaaagttctggaatacgacaatcgccgtctcaatggcgaacattttcagaggcagctaccttgccggtgcaggcctggctttttccctcatgaaaagtctagggggaggcaggcgcgggaccggagcccagggcgagactctgggtgaaaagtggaaacggcagttgaatcaactgtctaagagcgagttcaacacctataagagatcagggatcatggaagttgaccgttccgaggcaaaagaaggactcaagaggggcgagacaactaaacatgctgtgagtcggggtaccgccaaacttcgctggtttgtcgagcgaaatctggtgaaacctgaaggcaaggtaatagatttggggtgtggaagaggcgggtggagctactattgcgccggactgaagaaagtgacagaggttaagggctacacgaaaggtgggcccggacacgaggaaccgatcccaatggcgacctacggctggaacctcgtgaagttacactctggcaaagacgtcttctttattcctcccgaaaagtgtgatactctgctttgcgacatcggggagtcctcaccaaatcccacaattgaggaaggaaggaccctgcgggtgctaaaaatggtcgagccttggctccgcggtaaccagttctgtatcaagattctgaatccgtatatgcccagcgtggttgaaactttggagcagatgcagagaaagcatggcgggatgctggtaaggaacccactctcgcgaaattctacacacgagatgtactgggtgagttgcggaaccggcaacatcgtctccgctgtgaatatgacgagccggatgcttctgaaccgttttaccatggcacatagaaaacctacatatgaacgcgatgttgacttaggtgccgggactaggcacgtggctgtcgagcccgaagtggccaacctggatataattggacaacggatcgagaatatcaagcacgaacataaatcaacctggcactacgacgaggataacccttataagacatgggcataccatggctcctatgaggtaaaaccatctggcagcgccagttccatggtgaatggggttgtcaagttgctcactaagccctgggacgtgattcctatggtgacccagatagctatgacagataccactccattcggacagcaaagagtctttaaagaaaaggttgacacgcgcacacccaaagcgaagaggggtaccgcccagatcatggaggtgactgcaaaatggctgtggggcttcctaagccgaaacaagaagccgcggatttgtaccagagaagagtttacaaggaaagtacgctctaatgctgccatcggggcagtgttcgtcgacgaaaaccagtggaactcagccaaggaggctgtggaggatgaacgtttttgggaccttgttcaccgggagagagaactgcataaacagggaaagtgcgccacgtgcgtgtacaacatgatgggcaaaagggagaagaagctcggtgagttcgggaaagcgaagggaagtcgcgcaatttggtacatgtggctgggcgcccgattcttggagtttgaggctctgggcttcatgaatgaagatcactggttttcccgggagaacagcctctctggggtcgaaggagagggtcttcacaaactgggctatatcttaagagacatatcgaatatccctgggggaaacatgtacgccgatgacaccgcaggctgggatactaggattacagaggacgatctgcaaaatgaagctcgcatcaccgacattatggagccagaacatgccttgctcgctaagtcaatcttcaaactgacttatcagaacaaggtggtaagagttcagcggcccgccaaaaatggtacagtgatggatgtcataagcaggcgtgaccagcgagggtccggacaagtgggcacctacggcctaaacacatttactaacatggaggcacagcttattcgccagatggaaagtgaggggatcttctctcctagcgagctggaaaccccaaatctcgcggagagagtgctggattggttggaaaagtatggagtcgagcggttaaagaggatggccatctccggtgacgactgtgttgtgaaacccattgatgaccgctttgctacggccctgaccgcactcaacgatatgggcaaggtaagaaaagacataccgcagtgggaaccttcaaaggggtggaatgattggcaacaggtgcccttctgcagtcaccattttcaccagcttatcatgaaagacggacgggagattgtcgtgccatgtaggaaccaggatgagctggttggccgagctcgtgtgtctcaaggtgccgggtggagcctaagagaaacagcatgcctgggaaagtcctacgcccagatgtggcagctcatgtatttccaccgccgggacttgaggctggcggctaatgccatctgttcagcagtccctgtggattggattcccactagcagaaccacatggtctatccatgcccaccatcaatggatgactaccgaggacatgctttccgtatggaaccgcgtttggatagaagagaatccatggatggaagataagacgcacatcagtagctggggcgacgtgccctacctgggcaaacgggaggaccagtggtgcgggtcgctcattggattaacagctagggccacctgggcaactaacatccaggtcgctattaatcaggtgcgaagactgatcggtaacgagaattacttggattatatgacatccatgaagcggtttaaaaacgaatctgaccctgagggcgccctgtggtga

SEQ ID NO: 13592 - RNA, 9879 nt, synthetic construct
  misc_feature 1..9879: note = derived and/or modified CDS sequence (opt3) from DENV-1__FJ024441__SS-prME
  source 1..9879: mol_type = other RNA
agcgtgaccatgctgctcatgcttatgcccaccgccctggctttccacttgactacgcggggcggggaacctcatatgatcgtctccaagcaggaaaggggaaagtctttactgtttaagacctcagccggtgttaatatgtgcacactaattgccatggacctcggcgaactgtgtgaagatactatgacctacaagtgcccacggataacagaaaccgaaccggacgatgtggactgttggtgcaatgcgactgatacatgggtgacctatgggacgtgtagtcaaactggagagcaccgccgagacaagcgtagcgtggctcttgcaccccatgtcggcctgggtttggagaccagaacagaaacttggatgtcctctgagggggcatggaggcagatccagcgggtggaaacctgggccctccgccaccctggattcacagttattgctctgtttctggcacatgccatcggcacctcgattacgcagaaaggcatcatattcatcctcttaatgctggtgactccatcaatggctatgagatgcgtcgggattggaagcagggattttgtggagggtcttagtggcgccacatgggtagacgttgtgttggagcacgggtcctgtgtcaccactatggcgaaggataagcccacactggacatcgaactactcaaaaccgaggtgacgaaccctgcagtgctgcggaaactttgcattgaagccaaaatctctaataccacaactgatagccgctgtccaacccaaggagaggctacactggtcgaagaacaggacgccaacttcgtttgccgaagaacttttgtggataggggctggggtaatgggtgtggattgttcggcaagggctccctcataacctgcgcaaaatttaagtgcgtaacaaagctggaggggaaaattgtgcagtacgaaaacttaaagtattcagtcatcgtgaccgttcacactggagaccagcatcaagtgggtaatgagagtacggaacacggcacaaccgctactattacaccccaggcccctacaaccgagatccagctgactgactacggggcgctcacacttgattgtagcccacggacgggactggacttcaacgaaatggtcttgctaaccatgaaagagaagtcttggctggtgcataaacagtggtttctcgatctgccgcttccctggacttccggcgcctcaacaagccaagagacctggaatcgtcaggacctgttggtaacattcaagactgcacacgctaaaaagcaggaagttgtggtcctcggtagtcaagagggggccatgcacaccgctctgacgggcgccaccgaaatccagacatctggaactaccacaatttttgcaggccatttaaagtgccgcctgaaaatggataagctaactctcaaagggatgtcctatgtgatgtgtaccgggagcttcaagctggagaaagaagtcgccgagacgcagcacggtacagtgcttgttcagataaagtacgagggcaccgacgctccttgcaagatcccattctcgactcaagatgaaaaaggggtgacacagaacggaagattgattaccgcgaatcccatcgtaactgacaaggagaaacctgtcaacatagaagcagagccaccctttggcgagtcttatattaccatcggtgccggggaaaaggctctgaaactctcctggttcaagaagggctcaagtatcggaaaaatgtttgaggccacagcaaggggcgcccggcgaatggctattctgggggatacggcctgggacttcggaagcatcggtggcgtgtttacctccgttgggaaacttgtgcatcagattttcggaactgcatacggcgtcctgttttctggtgtgagctggacaatgaaaatagggatcggcgtattgctcacctggctgggattaaattcacgcagtacatccctgagcatgacttgtattgcggtgggcctagttaccctctacctgggggtcatggtgcaggctgattctggatgcgtgatcaactggaagggcagagaacttaaatgtggttcagggatcttcgtcacgaatgaggttcacacatggaccgaacaatataagtttcaggccgacagtccgaagaggttgagcgcagccattggaaaggcttgggaggagggcgtgtgcggtatacggtccgccactcgcctggaaaacatcatgtggaagcagatttctaacgagctcaatcatatcctgttagaaaacgacatgaaattcaccgtggtagtcggcgatgtggcagggattctggctcagggaaagaaaatgatcagacctcaacccatggagtacaagtattcgtggaaaagctggggcaaggccaagataatcggggcggacgttcagaatacaacttttattatcgatggaccaaacacccctgaatgtcccgacgatcagagggcctggaatatttgggaggtggaggactacggcttcggtatctttacaacgaacatatggcttaaattgcgtgattcctatacccaggtctgcgaccaccggctcatgtcagctgcaattaaggatagtaaagccgtgcacgctgacatggggtactggatcgaatctgagaagaatgaaacttggaaactggcccgagcctccttcattgaggttaagacatgtgtgtggccaaagtcccataccctatggtcaaacggagtactggaaagcgagatgatcatacccaaaatctatggcggtcctatttctcaacacaattacagaccaggctacttcactcagacagcggggccgtggcatctcggaaagctggagcttgattttgacttgtgcgaaggcaccacggtcgtggtggatgagcactgcgggaacaggggaccctccctgcgcactaccacagtcaccggcaaaatcattcacgaatggtgttgccggagttgtactttacctccactcagattcaggggtgaggacgggtgctggtatggaatggagatccgccccgttaaggaaaaagaggaaaatctggtaaagagcatggtatctgccggctccggtgaggtggactcatttagtcttggcctgttgtgtataagcattatgatcgaagaggtcatgcgatcgcggtggtcccgtaagatgctcatgacagggaccctggctgtgttctttctactgatcatgggacagctcacatggaacgatctgattagactttgcatcatggttggcgccaatgcatctgacaggatggggatgggaactacctacttggctctgatggccacgttcaaaatgcgccctatgtttgcagtgggcttactcttccggagactgacaagcagggaggtccttctgctaaccattggtctctcactggtggccagtgttgaattgccaaactccctggaggaattaggggatggactcgctatgggcataatgatcctgaaacttctgactgactttcaatctcatcagttgtgggcgaccctcctgagcctaacattcattaaaactaccttttccctgcactatgcctggaagacgatggcaatggtgctttcaatcgtcagcctcttccccctgtgtttgagtacaacctctcagaaaactacatggctgccggtattactcggctccctggggtgcaagcctcttaccatgtttctgattgctgagaataagatctggggacgacgcagctggccattgaacgaaggtataatggccgtgggcatcgtttcgattctcctgtcatctctactgaaaaacgatgtgccccttgccgggcctctcatcgctggaggcatgctgattgcatgttacgtcatcagtggttccagcgccgacttgtctttagagaaggcggctgaggtgagctgggaagaggaagccgagcattccggggcatcacacaatatactggtagaagtgcaggatgacggaactatgaaaattaaggatgaggagcgggacgatacactcaccatcctgcttaaagccacgctgttggctgtcagtggcgtttatcccctaagcatcccagcaactctgttcgtgtggtacttctggcaaaagaaaaagcagagatctggcgtgctctgggacaccccttcacccccagaagtcgagagggccgtgctggatgacgggatttatcgtataatgcagcgcggacttttaggtcggagccaggttggcgtaggggtgtttcaagaaaacgtcttccatacaatgtggcacgtgaccagaggagcggttctgatgtaccagggcaagaggctcgagccgagttgggctagcgtgaaaaaggacttgatctcctacggtgggggatggcgactgcagggctcttggaatacaggcgaggaagtccaggtgattgccgtagagcctgggaaaaaccccaagaatgtccaaactgcaccaggaacctttaaaacgcccgaaggtgaggtgggcgccatcgctctcgatttcaagcctgggacatcgggaagcccaattgttaaccgggaaggcaagatcgtgggtctgtatgggaatggagtcgtgactacctcaggcacatacgtttccgccatagcacaggctaaagccagtcaggagggcccccttcctgagatcgaagacgaggtgtttcgcaagagaaacctgaccattatggatttgcacccggggtctggaaaaactaggcggtatctaccagcgatcgtccgagaagccattaagagaaaactgcgcaccctcatcttagcacccacaagggtggtagctagcgagatggccgaagctctgaagggtatgcctatacgttaccaaacgactgcagtgaagtccgagcataccggcaaagagattgttgaccttatgtgccacgccacattcaccatgcggctgctctcaccagtcagagtgcccaattataacatgatcatcatggatgaagcccattttactgacccttctagcattgctgcgagggggtacatcagtacacgcgtgggaatgggcgaggcagccgctatattcatgaccgccacgccgcccggttccgtcgaagcatttccacagagcaatgccgtaattcaggatgaggaacgagacatccctgagagatcttggaactcagggtatgagtggattactgatttccccggaaagacagtgtggtttgttccatccatcaaaagtggcaatgacatagctaactgtttgcggaagaatggcaaaagggtgattcagctgagccgcaagaccttcgataccgaataccaaaagactaaaaacaacgactgggactacgtcgtgacaaccgatatctcggagatgggggcgaatttccgtgccgacagagttatcgatcctcggaggtgcctcaagcccgtgattctgaaagacggaccagaacgcgtcatccttgcaggtccgatgcctgtgacagtagcttctgccgcacagcgaagaggccggattgggaggaaccacaataaggagggagatcagtatatatacatgggccagcccctaaacaatgacgaggatcatgcccactggactgaagctaaaatgctgttggacaacatcaatacgccagagggtattatccccgccttatttgaacctgagcgcgaaaagtccgcggcaatcgatggggagtatagactgaggggcgaggcccggaagaccttcgtggaactcatgcgtcgcggagacctgccagtttggcttagctacaaagtcgcttcagagggctttcaatatagtgatcgaagatggtgcttcgacggggaaaggaacaatcaggtgctggaggaaaacatggatgtggagatttggacaaaggagggagaacggaaaaagctccgccccagatggttggacgccaggacttactctgaccctctggctctacgggagtttaaagagttcgcagccggtcgaagatccgtcagcggcgatctgatactcgagatcgggaaacttccgcagcacctgacccagcgcgctcaaaatgccttagacaacttggttatgctgcataattcagaacagggaggcagggcatatcggcacgcgatggaggagctcccagatacaattgaaaccctgatgcttctggccctcatcgctgtgttgactggtggggtaacgctgtttttcttaagtggccgtggactaggcaaaaccagcattgggctgctctgtgtgatggcctcctctgtccttctgtggatggcaagcgtggagccccattggatcgctgcctccataatcttggaatttttcctgatggttctcctgattcctgagcccgacagacagaggacaccacaggataaccaacttgcatacgtggtcatcggactcctgtttatgattttgactgtagccgctaatgagatgggtctgttagaaaccacaaagaaggacctaggcatcgggcacgtggcggttgagaaccaccatcacgccgcaatgctggatgtggacctccatcctgcttcagcctggaccctttacgccgtcgcaactacaataattacgcccatgatgcgccacaccatcgaaaacactacagctaatatttctctgaccgccatcgcgaaccaggctgccatattgatgggactggataaaggctggccaatcagtaagatggacattggtgtgcctctcctggcacttgggtgctattcgcaggtcaatccgttaaccctgacagccgctgtgctcatgttggttgcacattacgccatcattggccccggactgcaagcgaaagctactcgggaggcccagaagcgaacggcagccggcatcatgaaaaacccaaccgtggatgggatagtagctattgacctagatcctgtggtctatgacgccaagttcgaaaagcagctgggacagatcatgctccttatcctgtgtacaagccaaattttgctgatgagaactacctgggcactctgcgagtccatcacactggctaccggccccttaactacgctttgggagggttctccagggaaattttggaatacaaccatagccgtttcaatggcgaacattttcaggggaagctacctggccggcgcaggtctcgctttctccctaatgaagagtctgggcgggggacgccggggcactggggcccagggagaaaccttgggcgagaaatggaagagacagctgaatcagctctctaaaagcgaatttaacacatataagcgttcaggtatcatggaggtggacaggtccgaagcaaaggaggggcttaaacggggagagactaccaagcacgctgtcagtcgcggcacagccaaactgcgatggttcgtggaaagaaatttggtaaagcctgagggtaaagtgattgatctgggctgtgggaggggaggctggagctactattgcgccgggctcaagaaggttacggaagtgaaaggatacaccaagggcggtcccgggcacgaggaaccgatcccaatggcgacttacggatggaacttagtcaaactgcattctggcaaggacgtgtttttcatacctcccgagaaatgtgatacacttctgtgcgacatcggcgagtcctcaccaaatcccaccattgaagaggggcggactctacgcgtcctcaagatggtggaaccttggctgagaggaaaccaattttgtatcaaaattttgaatccgtatatgcccagcgttgtagagacactggagcagatgcagaggaagcacggtggcatgctcgtgcgaaacccactttcgagaaattctacccatgaaatgtactgggtcagttgcgggacgggaaacatcgtgtccgctgttaatatgaccagccgtatgctgttaaacagattcacaatggcacaccgcaagcctacttatgagagggatgtggacctgggcgccggtacccggcacgtcgctgtggaacccgaggtagccaacttggatattatcgggcagagaatagaaaatattaaacatgagcacaagtcaacatggcattacgacgaggataacccttataaaacttgggcataccacggatcctatgaagtgaagccatctggcagcgccagttccatggttaatggcgtcgtgaaactcctgaccaagccctgggacgtgatccctatggtcacacaaatcgctatgaccgatactacgccatttgggcagcagcgcgttttcaaggagaaagtggacacaaggacccccaaggcgaaacgaggaactgcccaaattatggaagtaaccgcaaagtggctatggggttttcttagccggaacaaaaagccgagaatatgtacaagggaggagttcacgcgcaaggtgcgttctaatgctgccatcggcgcagtctttgtggacgagaaccagtggaactcagccaaagaggctgttgaagatgagcggttctgggacctggtgcatagagaaagggagctccacaagcaggggaaatgcgcaacctgcgtctacaacatgatgggaaagcgcgagaagaagctgggcgagtttggtaaggcgaaagggagtcgagcaatttggtacatgtggttgggagcccggttcctggagttcgaagctctcggctttatgaatgaggatcactggttctccagagaaaacagcctttctggcgtggagggggagggactgcataagttaggttatatcctgagggacatttcgaaaatccctggcgggaatatgtacgccgatgacactgcaggatgggatacacgcataaccgaagacgatttgcagaacgaggctagaatcactgacattatggaaccagagcacgccctcctggctaagtcaatctttaaactaacatatcaaaataaggtagttcgggtgcagaggcccgccaaaaacggcaccgtcatggatgtgattagccgtcgagaccagcgcggttccggacaggtgggaacatacggccttaatactttcaccaacatggaagcacaactgatcagacagatggagagtgagggcatattttctcctagcgaactcgagacgccaaacctggcggaacgggtcttggattggttagagaagtatggggttgaaaggctgaagcgcatggccatttccggagacgactgtgtggtaaaacccatcgatgacagattcgctaccgccctcacagcacttaatgatatgggtaaggtgcggaaagacatcccgcagtgggagccttcaaagggctggaacgattggcagcaagtccccttttgcagtcatcacttccaccagctgattatgaaagacgggagggagatagtggttccatgtcgaaatcaggatgagctagtgggacgtgctagagtctctcagggcgccggttggagcctgcgcgagactgcatgcctcgggaagtcctacgcccaaatgtggcagttgatgtattttcatcggagggacctgagacttgcggctaacgccatctgttcagcagtgcctgtagattggattcccaccagccgcacaacttggtctatccacgcccatcaccagtggatgaccacggaagacatgctgtccgtttggaatcgggtgtggattgaggaaaacccatggatggaggataagacacatatcagtagctggggagacgtcccctacctcggcaaaagggaggaccaatggtgcggctcgttaatagggctgaccgctcgagccacttgggcaacaaatatccaggtggctattaaccaggttagacggttgatcggaaatgaaaactacctggattatatgacctccatgaagaggttcaaaaatgagtctgaccctgaaggtgccctctggtga

SEQ ID NO: 13593 - RNA, 9879 nt, synthetic construct
  misc_feature 1..9879: note = derived and/or modified CDS sequence (opt3) from DENV-1__FJ024442__SS-prME
  source 1..9879: mol_type = other RNA
agcgtgaccatgctgctcatgcttatgcccacagccctggctttccacttgactacgagaggaggggaacctcatatgatcgtctccaagcaggaaagggggaaatctttactgtttaagacctcagccggtgttaacatgtgcacactaattgccatggacctcggcgaactgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaggacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccgggagcttcaaactggagaaggaagtcgccgagacgcagcacggtacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattatcatcggtgccggggaaaaagctctgaagctctcctggttcaagaaaggctcaagtattggaaagatgtttgaggccaccgcaagaggcgccaggcggatggctatcctgggggatacagcctgggacttcggaagcattggtggcgtgtttacgtccgttgggaaacttgtgcatcagatattcggaaccgcatacggcgtcctgttttctggtgtgagctggactatgaagatcgggattggcgtattgctcacatggctgggattaaattcacgaagtacctccctgagcatgacatgtatcgcggtgggcctagttactctctacctgggggtcatggtgcaggctgattctggatgcgtgatcaactggaaaggccgcgaacttaagtgtggttcagggattttcgtcaccaatgaggttcacacgtggacagaacaatataagtttcaggccgacagtccgaaaagattgagcgcagccataggaaaggcttgggaggagggcgtgtgcggtatcaggtccgccacccggctggaaaacattatgtggaaacagatctctaacgagctcaatcatattctgttagaaaacgacatgaagttcactgtggtagtcggcgatgtggcagggatcctggctcagggcaaaaagatgatacgccctcaacccatggagtacaaatattcgtggaaaagctggggcaaggccaagatcattggggcggacgttcagaataccacatttatcattgatggaccaaacactcctgaatgtcccgacgatcagagagcctggaatatctgggaggtggaggactacggcttcggtatatttaccacaaacatttggcttaagttgagggattcctatacgcaggtctgcgaccaccgtctcatgtcagctgcaatcaaagatagtaaggccgtgcacgctgacatggggtactggattgaatctgagaaaaatgaaacctggaagctggcccgggcatccttcatcgaggttaagacttgtatatggccaaaatcccatacactatggtcaaacggagtgctggaaagcgagatgatcattcccaagatctatggcggtcctatttctcaacacaattaccgaccaggctacttcacccagactgcggggccgtggcatctcggaaaactggagcttgattttaacttgtgcgaaggcacaaccgtagtcgtggacgagcactgcgggaatagaggaccctccctgaggacgactaccgtgacaggcaagatcatacacgaatggtgttgccgcagttgtaccttacctccactccggttcagaggtgaggatgggtgctggtatggaatggagattaggcccgtcaaagaaaaggaggaaaacctggttaagagcatggtgtctgccggctccggtgaggtagactcatttagtcttggcctgttgtgtatcagcatcatgattgaagaggtgatgcgctcgcgatggtcccggaaaatgctcatgactgggacactggctgtcttctttctactgatcatgggacagctcacctggaatgacctgattcgtctttgcataatggtgggcgccaacgcatctgatagaatggggatgggaacaacttacttggctctgatggccaccttcaagatgaggcctatgtttgcagttggcttactcttccgccggctgacgagcagagaggtgcttctgctaacaatcggtctctcactggtcgccagtgtggaattgccaaattccctggaggaattaggggacggactcgctatgggcattatgatcctgaaacttctgaccgattttcaatctcatcagttgtgggcgactctcctgagcctaaccttcattaagacaactttttccctgcactatgcctggaaaaccatggcaatggttctttcaatcgtgagcctcttccccctgtgtttgagtacgacatctcagaagaccacttggctgccggtcttactcggctccctggggtgcaagcctcttacaatgtttctgatagctgagaacaaaatctggggaaggcgaagctggccattgaacgaaggtattatggccgtaggcatcgtgtcgattctcctgtcatctctactgaagaatgacgttccccttgccgggcctctcatcgctggaggcatgctgatagcatgttacgtgattagtggttccagcgccgatttgtctttagagaaagcggctgaggtcagctgggaagaggaagccgagcattccggggcatcacacaacatcctggtggaagtacaggacgatggaaccatgaagatcaaagacgaggagcgcgatgacactctcacaattctgcttaaggccaccctgttggctgtgagtggcgtctatcccctaagcataccagcaacgctgttcgtttggtacttctggcagaaaaagaagcagcggtctggcgtgctctgggatactccttcacccccagaagtggagagagccgtcctggacgatgggatctataggattatgcagcgtggacttttaggtcgcagccaggtgggcgttggggtatttcaagaaaatgtgttccataccatgtggcacgtcacacggggagcggtgctgatgtaccagggcaaaagactcgagccgagttgggctagcgttaagaaagacttgatctcctacggtgggggatggaggctgcagggctcttggaacaccggcgaggaagtgcaggtcattgccgtggagcctgggaagaatcccaaaaacgtacaaacagcaccaggaacttttaagacccccgaaggtgaggtcggcgccatcgctctcgacttcaagcctgggacgtcgggaagcccaatagtgaatcgagaaggccggatcgttggtctgtatgggaacggagtggtcacaacttcaggcacctacgtgtccgccattgcacaggctaaagccagtcaggagggcccccttcctgagatcgaagatgaggtttttcgcaagagaaatctgacaattatggacttgcacccggggtctggaaaaaccaggcggtatctaccagcgatcgtgcgagaagccataaagagaaaactgcgcactctcattttagcacccaccagggtcgtggctagcgagatggccgaagctctgaagggtatgcctatccgttaccaaacaacggcagtaaagtccgagcatactggcaaagagatcgtggatcttatgtgccacgccaccttcacaatgcggctgctctcaccagttagagtccccaactataatatgattatcatggacgaagcccattttaccgatccttctagcatagctgcgagggggtacattagtactcgcgtgggaatgggcgaggcagccgctatcttcatgacagccaccccgcccggttccgtggaagcatttccacagagcaacgccgtcattcaggacgaggaacgagatatccctgagagatcttggaatttggggtatgagtggataacggacttccccggaaagactgtatggtttgtgccatcaattaaatccggcaacgatatcgctaattgtctgcggaagaacggcaaaagggttatccagctcagtcgcaagacattcgacaccgaataccaaaagaccaaaaacaatgattgggactacgtggtcactacagacattagcgagatgggggcgaacttccgtgccgatagagtgatcgaccctcggaggtgcctgaagcccgttattcttaaagatggaccagaacgcgtgatactagcaggtccgatgcctgtcaccgtggcttcggccgcacagcgaagaggccggatcgggaggaatcacaacaaggagggagaccagtatatttacatgggccagcccctgaataacgatgaggaccatgcccactggacagaagctaaaatgttgttagataatatcaacactccagagggtatcattcccgccctgtttgaacctgagcgcgaaaagtctgcggcaatagacggggagtatagactcaggggcgaggcccggaagacgttcgtagaactgatgcgtcgcggagatcttccagtgtggctgtcctacaaagttgctagcgagggctttcaatattcagaccgaagatggtgcttcgatggggaaaggaataaccaggtcctcgaggaaaatatggacgtggagatctggaccaaggagggagaacggaaaaagttgcgccccagatggctggatgccaggacatacagtgaccctctagctctgcgggagtttaaagagttcgcagccggtcgaagatctgtgtccggcgacctcattcttgagatcgggaagctgccgcagcacttaactcagcgcgctcaaaacgccttggataatctggtcatgctccataacagcgaacagggaggcagggcatatcggcacgcgatggaggagctgccagacaccattgaaacacttatgctgctcgccttgatcgctgttctgaccggtggggtgactttatttttcctatcaggccgtggactgggcaaaacgagtatagggctcctttgtgtaatggccagctccgtgctgttgtggatggcatctgtcgagccccattggatcgctgccagcattatcctggaatttttcctcatggtgctgcttattcctgagcccgatagacagaggaccccacaggacaatcaactcgcatacgttgtgatcggactgttgtttatgatactgacagtcgccgctaacgagatgggtttactagaaactaccaagaaggatctgggcattgggcacgtagcggtggagaaccaccatcacgccgcaatgctcgacgttgatcttcatcctgcttccgcctggacactgtacgccgtggcaaccactatcattacacccatgatgcgccacacgatcgaaaataccactgctaacatatcattgacagccatcgcgaatcaggctgccattctgatgggactcgacaaaggctggccaatctctaagatggatattggtgtccctctgcttgcattagggtgctatagtcaggtgaacccgctgaccctcaccgccgctgtcttgatgctggtggcacattacgccatcataggccccggactacaagcgaaagctacacgggaggcccagaagcgaactgcagccggcattatgaaaaatccaacggttgacgggatcgtggctatcgatctggaccctgtagtgtatgatgccaagttcgaaaagcagctcggacagattatgcttctgatcttgtgtacctcgcaaatactgctcatgagaacaacttgggcactgtgcgagagcattaccttagctacaggcccccttaccactctgtgggagggttccccagggaaattttggaacacgacaatcgccgtctctatggcgaatattttcaggggatcatacctcgccggcgcaggtctagctttcagcctgatgaagtccttgggcgggggacgccggggcaccggggcccagggagaaactctgggcgagaaatggaagagacagctcaaccagcttagtaaatctgaatttaatacctataagcgtagcggtatcatggaggttgacaggtcagaagcaaaggaggggctgaaacggggagagacaactaagcacgctgtgtcccgcggcaccgccaaattgcgatggttcgtcgaaagaaacctggtgaagcctgagggtaaagtaatagacctcggctgtgggaggggaggctggagttactattgcgccgggttaaagaaggtgacagaagttaaaggatacacgaagggcggtcccgggcacgaggaaccgatcccaatggcgacctacggatggaatctggtgaaacttcatagcggcaaggatgtctttttcattcctcccgagaaatgtgacactctgctatgcgatatcggcgagtcttccccaaaccccacaattgaagaggggcggaccctccgcgtgctgaagatggtcgaaccttggttgagaggaaatcaattttgtatcaaaattctgaacccgtatatgccctcagtggttgagactctcgagcagatgcagaggaagcacggtggcatgcttgtacgaaatccactgagccggaactcgacacatgaaatgtactgggtgtcttgcgggaccggaaatatcgtcagtgctgtgaacatgacgtcccgtatgttactgaacagattcaccatggcacaccgcaagcctacatatgagagggacgttgatttgggcgccggtactcggcacgtggctgtcgaacccgaggtggccaatctcgacataattgggcagagaatcgaaaacatcaaacatgagcacaagagcacctggcattacgatgaggacaatccttataaaacatgggcataccacggatcatatgaagtaaagccatccggctctgccagcagtatggtgaacggcgttgtcaaactgctaactaagccctgggatgtgattcctatggtgacccaaatagctatgacagacaccactccatttgggcagcagcgcgtcttcaaggagaaagttgatacgaggacacccaaggcgaaacgaggaaccgcccaaatcatggaagtgactgcaaagtggctttggggttttctgtcccggaataaaaagccgagaatttgtaccagggaggagttcacacgcaaggtacgtagcaacgctgccatcggcgcagtgtttgtcgacgagaatcagtggaactctgccaaagaggctgtggaagacgagcggttctgggatctcgttcatagagaaagggagctgcacaagcaggggaaatgcgccacgtgcgtgtacaatatgatgggaaagcgcgagaaaaagttgggcgagtttggtaaggcgaaagggtcacgagcaatttggtacatgtggctgggagcccggttcctcgagttcgaagctcttggctttatgaacgaggaccactggttcagtagagaaaattccctgagcggcgtcgagggggagggattacataagctgggttatatcttgagggatatatctaaaatccctggcgggaacatgtacgccgacgataccgcaggatgggacactcgcattacagaagatgacctccagaatgaggctagaatcaccgatattatggaaccagagcacgccctgctagctaagtcgatctttaaacttacttatcaaaacaaggtggtacgggttcagaggcccgccaaaaatggcacagtgatggacgtcatatcacgtcgagatcagcgcggtagcggacaggtgggaacctacggcctgaacacattcactaacatggaagcacaactcattagacagatggagtccgagggcatctttagtccttctgaactggagaccccaaatttggcggaacgggtgttagactggctggagaagtatggggtcgaaaggctcaagcgcatggccatcagcggagatgactgtgttgtgaaacccattgacgatagattcgctacggcccttaccgcactgaacgacatgggtaaggtacggaaagatataccgcagtgggagccttccaagggctggaatgactggcagcaagtgcccttttgctcacatcacttccaccagctaatcatgaaagatgggagggagattgtcgtgccatgtcgaaaccaggacgaactggttggacgtgctagagtgagtcagggcgccggttggtctctccgcgagacagcatgcttgggaaagagctacgcccaaatgtggcagctgatgtattttcatcggagggatcttagactggcggctaatgccatctgttccgcagtccctgtggactggattcccacttcacgcaccacatggagcatccacgcccatcaccagtggatgactaccgaagatatgctctctgtatggaaccgggtttggatagaggaaaatccatggatggaggacaagacgcatatctccagttggggagatgtgccctacttaggcaaaagggaggaccaatggtgcggcagcctgattgggttgacagctcgagccacctgggcaactaacatccaggtcgctattaatcaggtgagacggctgatcggaaacgaaaattacctcgactatatgacatcgatgaagaggttcaaaaacgagggtgatcctgaaggcgccctttggtga

SEQ ID NO: 13594 - RNA, 9879 nt, synthetic construct
  misc_feature 1..9879: note = derived and/or modified CDS sequence (opt3) from DENV-1__FJ373296__SS-prME
  source 1..9879: mol_type = other RNA
agcgtgacaatgctgctcatgcttatgcccatcgcactggctttccacttgacaactagaggaggggaacctcatatgattgtctccaagcaggaaaggggaaaatctttactgtttaagacgtcagccggtgttaacatgtgcaccttaatagccatggacctcggcgaactgtgtgaagatacaatgacttacaaatgcccacggatcaccgaggcggaaccggacgatgtggactgttggtgcaatgctacagatacctgggtaacttatgggacatgtagtcaaaccggagagcaccgccgagacaagcgtagcgtggcccttgcaccccatgtcggcctgggtttggagacgagaactgaaacctggatgtcctctgagggggcctggaaacagattcagagggtggaaacatgggctctccggcaccctggattcactgttatcgcactgtttctggcccatgctattggcacctcgatcacacagaagggcataatcttcattctcttaatgctggtgaccccatcaatggccatgcgctgcgtcgggatcggaagcagagattttgtggagggtcttagtggcgcgacgtgggtagacgttgtgttggagcacgggtcctgtgtcactacaatggcaaaggataaacccaccctggacattgaattgctcaagactgaggtgacaaaccctgccgtgctgaggaaactttgcatcgaagctaagatatctaataccacgaccgatagccggtgtccaacacaaggagaggccactctggtcgaagaacaggacgcaaacttcgtttgccgccgaacctttgtggatagaggctggggtaatgggtgtggattgttcggcaaaggctccctcattacatgcgctaagtttaagtgcgtaactaaactggaggggaagatcgtgcagtacgaaaacttaaaatattcagtcattgtgaccgttcacacaggagaccagcatcaagtgggtaatgagagtaccgaacacggcactacggccacaatcacaccccaggcgcctactaccgagatccagctgacagactacggggccctcacccttgattgtagcccaaggactggactggacttcaacgaaatggtcttgctaacaatgaaggagaaatcttggctggtgcataagcagtggtttctcgatctgccgcttccctggacgtccggcgcatcaaccagccaagagacttggaatcggcaggacctgttggtaacattcaaaaccgctcacgccaagaagcaggaagttgtggtcctcggtagtcaagagggggctatgcacacagccctgactggcgcaaccgaaattcagacgtctggaaccacaactatatttgccggccatttaaaatgccgtctgaagatggataaactaaccctcaaggggatgtcctatgtgatgtgtacaggatcgttcaaactggagaaggaagtcgctgagactcagcacggtaccgtgcttgttcagatcaagtacgagggcacggacgcgccttgcaaaattccattctcgacacaagatgaaaagggggcaacccagaacggacgcttgatcactgccaatcccatagtgacagacaaagagaagcctgtaaacattgaagctgagccaccctttggcgagtcttatatcgtcatcggtgccggggaaaaagcactgaagctctcctggttcaagaaaggctcaagtattggaaagatgtttgaggccaccgctagaggcgccaggcggatggcaatcctgggggatactgcgtgggacttcggaagcattggtggcgtgtttacctccgttgggaaacttgtgcatcagatattcggaacagcttacggcgtcctgttttctggtgtgagctggacgatgaagatcgggattggcgtattgctcacctggctgggattaaattcacgaagtacttccctgagcatgacatgtatcgccgtgggcctagttaccctctacctgggggtcatggtgcaggcagattctggatgcgtgatcaactggaaaggccgcgaacttaagtgtggttcagggattttcgtcacaaatgaggttcacacttggaccgaacaatataagtttcaggccgacagtccgaaaagattgagcgctgccataggaaaggcatgggaggagggcgtgtgcggtatcaggtccgctacgcggctggaaaacattatgtggaaacagatctctaacgagctcaatcatattctgttagaaaacgacatgaagctgacagtggtagtcggcgatgtggccgggatccttggacagggcaaaaagatgatacgccctcaacccatggagtacaaatattcgtggaaaagctgggggaaggcgaaaatcattggagccgacgctcagaataccactttcatcattgatggcccaaacacccctgaatgtcccgacgatcagagagcatggaatatctgggaggttgaggactacggttttgggatattcacaactaacatttggttgaagctcagggattcctatacccaggtgtgcgaccaccgtctgatgtcagccgctatcaaagatagtaaggccgtccacgcagacatgggatactggattgaatctgagaaaaatgaaacatggaagctagcgcgggccagctttatcgaggtgaagacgtgtatatggccaaaatcccataccctgtggtcaaacggcgttctcgaaagcgagatgatcattcccaagatctatggtggccctatttctcaacacaattaccgaccagggtacttcactcagacagctggaccgtggcatctgggcaaacttgagttggatttcgacctgtgcgaagggaccactgtggtagtcgatgagcactgcggaaacagaggcccctccttaaggacaaccacggtgactggtaagatcatacacgaatggtgttgccgcagttgtaccctccctccactgcggtttagaggggaggacggatgctggtatggcatggagattaggcccgtgaaagaaaaggaggaaaatcttgtcaagagcatggtttctgccggttccggcgaggtggactcattcagtctggggttgctctgtatcagcatcatgattgaagaggtaatgcgctcgcgatggtcccggaaaatgctgatgacaggaaccctagcagtgtttttcctgctcatcatgggccagctgacttggaacgatcttattcgtttgtgcataatggtcggggctaatgcctctgacagaatgggaatgggcacaacctacctggcattaatggccacatttaagatgaggcctatgttcgctgtgggtctcctgtttcgccggcttactagcagagaggttctgctactcaccatcgggctgtcattggtggcgagtgtcgaactgccaaactccttagaggaactcggagatggcctggccatgggcattatgatccttaaactgttgacggacttccaatctcatcagctctgggcaacactgctaagcctgacctttattaagactaccttctcccttcactatgcttggaaaacaatggccatggtgctctcaatcgttagcctgtttcccttgtgtctgagtactacctctcagaagacgacatggttaccggtgctcctggggtcccttggatgcaagcctctgaccatgttcttgatagccgagaataaaatctggggtaggaagtcctggccactcaacgaaggcattatggctgtcgggatcgtatcgattctgctatcatctctgcttaaaaacgatgtgcccctcgcaggacctctgatcgccggcggtatgttgatagcgtgttacgttattagtgggtccagcgctgacttatctctggagaaggccgcagaggtgagctgggaagaggaagccgagcattccggagcttcacacaatatcctcgtcgaagtgcaggatgacggcactatgaaaatcaaggatgaggagcgagacgatacactgaccattcttctgaaagcaactttgctagccgtaagtggcgtgtatcccctgagcataccagcgacactctttgtctggtacttctggcaaaagaagaaacagcgctctggggttctgtgggacaccccttcacccccagaagtggagcgggctgtgcttgatgacggaatctatagaattatgcagaggggtttactgggccgtagccaggtcggggtgggagttttccaagaaaacgtatttcatacgatgtggcacgtgactcgcggcgccgtcctcatgtaccagggtaagcggttggagccgagttgggcaagcgtgaaaaaggacctgatctcctacgggggaggctggagactcaggggctcttggaataccggggaggaagttcaggtgattgccgtcgagcctggcaaaaatcccaagaatgtgcagacagctccaggtaccttcaagacacccgaaggcgaggtaggggccatcgcactggattttaaacctggaacttcgggcagcccaatagtcaaccgagaaggtaagatcgtggggctttatggaaatggcgttgtgaccacgtcaggcacatacgtctccgctattgcccaagcgaaagccagtcaggaggggcccctgcctgagatcgaagacgaggtgttccggaagcgcaacttgactattatggatctacacccgggatctggtaaaaccagaaggtatctgccagcaatcgttcgggaagctataaagcgaaagctcagaacattaattctggcccccacccgcgtggtcgctagcgagatggcagaagcccttaaaggcatgcctatcaggtaccagactaccgccgtgaagtccgagcatacagggaaagagatcgtagacctgatgtgccacgctacgtttactatgcgtctcttgtcaccagtgcgggttcccaattataacatgattatcatggatgaagcgcatttcaccgacccttctagcatagcagccagaggatacattagtacaagggtcggcatgggtgaggctgccgcaatctttatgaccgccactccgcccgggtccgtggaggctttcccacaaagcaatgcggtgattcaggatgaggaacgcgacatccctgagcgatcttggaactcaggatatgagtggataacagattttcccggcaagaccgtctggttcgtaccatccattaaaagtggcaatgacatcgccaactgtctgagaaagaatgggaagcgggtgatccagctcagcaggaaaacgtttgatactgaataccagaagaccaaaaacaacgactgggactacgttgtgaccaccgatatttcggagatgggagcaaatttccgcgctgaccgtgtcatcgatcctagacggtgcctgaagcccgtgattcttaaagacggtccagaaagggttatactagccggcccgatgcctgtgactgtcgcatctgccgctcaacgccgagggagaatcggacggaaccacaataaggagggcgatcagtatatttacatgggtcagcccctgaacaatgacgaggatcatgcccactggacagaagcgaagatgttgttagacaacatcaataccccagaggggatcattcccgcactgttcgaacctgagagggaaaaatccgccgctgtggatggcgagtatcgcctcagaggagaggccaggaagacatttgtagaactgatgcggcgtggcgaccttccagtgtggctgagctacaaagttgcttcagaggggttccagtatagtgatcgccgatggtgctttgacggagaaagaaacaatcaagtcctcgaggaaaacatggatgtggagatatggactaaggagggtgaaaggaaaaagttgcggccccgctggctggacgcaagaacgtactctgaccctctagccctgagggagttcaaagaatttgctgccggccggcgatccgtgagcggggatctcatccttgagattggaaagctgccgcagcacttaacccagagagcacagaatgcgttggacaacctggtcatgctccataattcagaacaaggcggtcgcgcctataggcacgctatggaggagctgccagatacaatcgaaactcttatgctgctcgccttgattgcagttctgaccgggggcgtgacattattctttctaagtggacggggcctggggaagaccagcatcggactcctttgtgtaatggcttcctctgtgctgttgtggatggccagcgtcgagccccattggatagcagcctccatcattctggagttctttctcatggtgctgcttatccctgagcccgaccgtcagagaactccacaggataaccagctcgcttacgttgtgattggtctgttgttcatgatcctgacggtcgcggccaatgagatgggcttactagaaaccaccaaaaaggacctggggataggacacgtagcagtggagaaccaccatcacgctgccatgctcgatgttgaccttcatcctgcctcagcatggactctgtacgctgtggccaccacaattatcacccccatgatgaggcacactattgaaaacacaacggcgaatatctctttgaccgctatagccaaccaagcagccatcctgatgggcctcgataaaggttggccaattagtaagatggacatcggggtccctctgcttgctttaggctgctatagccaggtgaatccgctgactctcacagcagccgtcttgatgctggtggcgcattacgctattatcggacccggcctacaggccaaagcaacccgcgaggcccaaaagcggaccgctgccgggataatgaagaacccaacagttgatggaattgtggcaatcgacctggatcctgtagtgtatgacgctaaatttgaaaagcagctcggccagatcatgcttctgattttgtgtactagccagatcctgctcatgcgaacgacctgggccctgtgcgagtccataacattagcgactggtccccttaccacactgtgggaggggtctccaggaaaattctggaataccactattgccgtctcaatggcaaacatctttagaggcagctacctcgctggtgccggcctagcattctccctgatgaagagtctagggggaggcaggcgcgggacgggagctcaaggcgaaacactgggtgagaaatggaagcggcagctcaatcagctttctaagagcgagttcaacacctataaaagatcagggattatggaggttgaccgttccgaagccaaggagggactgaaaaggggcgagactaccaagcacgccgtgagtcggggtacagcgaaattgcgctggtttgtcgaacgaaatctggtgaagcctgagggcaaggtaatcgatctcgggtgtggaagaggcgggtggagctactattgcgctggactaaagaaggtgactgaagttaaaggctacaccaagggtgggcccggacacgaggaaccgataccaatggcaacatacggctggaacctggtgaaacttcattctggcaaggacgtcttctttatccctcccgagaaatgtgatacgctgctatgcgacattggggagtcctcaccaaatcccaccatcgaagagggaaggactctccgggtgctgaagatggtcgaaccttggttgcgcggtaaccagttctgtattaagatcctgaatccgtatatgcccagcgtggttgagacactcgagcaaatgcagagaaaacacggcgggatgcttgtaaggaacccactgtcgcgaaattctacccatgaaatgtactgggtgagttgcggaactggcaacattgtctccgccgtgaatatgacaagccggatgttactgaaccgttttaccatggctcacagaaagcctacgtatgagcgcgatgttgacttgggtaccgggacaaggcacgtggccgtcgaacccgaggtggcaaacctcgatatcataggacagcggattgaaaatatcaaacatgagcacaagtcaacttggcattacgacgaggataacccttataaaacctgggcctaccacggctcctatgaagtaaagccatctggcagcgctagttccatggtgaatggggttgtcaagctgctaacaaaaccctgggacgtgatccctatggtgactcagattgcgatgaccgatacaaccccattcggacaacagagagtctttaaggagaaagttgacactcgcacgcccaaggccaaaaggggtacagcacagataatggaagtgaccgctcgatggctttggggcttcctgagccggaacaagaagccgagaatctgtactagggaggaatttacccgcaaagtacgttctaatgccgcaattggggccgtgttcgtcgacgagaaccaatggaactcagctaaggaggccgtggaagatgagcggttttgggacctcgttcatagagaaagggagctgcacaaacagggaaagtgcgcgacatgcgtgtacaacatgatgggcaaacgcgaaaagaagttgggtgagttcgggaaagcaaagggaagtcgagccatctggtacatgtggctgggcgctcggtttctcgagttcgaagcccttggcttcatgaatgaggatcactggttttccagagaaaacagcctgtctggggtcgagggagagggtttacataaactgggctatattttgagggacatctcgaagatacctgggggaaatatgtacgcagatgacacggctggctgggatacccgcatcactgaagacgatctccagaacgaggccaaaattacagacatcatggaaccagagcacgctctgctagccaaggcaattttcaaacttacctatcagaataaggtggtaagagttcaacggcccgcgaagaacggtactgtgatggatgtcatctcaaggcgtgaccagcgagggagcggacaggtgggcacatacggcctgaatacctttacaaacatggaagcccagctcatacgccaaatggagtccgaggggattttcagtccttctgaactggagactccaaacttggctgaaagagccttagattggctggagaaatatggagtggaacggctcaagaggatggcaatcagcggtgacgactgtgtcgttaaacccatcgatgaccgctttgctaccgcccttacggcactgaatgatatgggcaaggtgagaaaagacattccgcagtgggagccttccaaggggtggaacgattggcagcaggtacccttctgctcacatcactttcaccaactaataatgaaggacggacgggagatcgtggtcccatgtaggaatcaggatgaactggtgggccgagcccgtgttagtcagggtgcggggtggtctctcagagagaccgcttgcttgggaaaaagctacgcccagatgtggcaactgatgtatttccatcgccgggaccttaggctggcagccaacgctatttgttccgccgtgcctgtcgattgggtgcccacatcaagaactacctggagcatccacgcacatcaccagtggatgacaactgaagacatgctctctgtatggaatcgcgtttggattgaggaaaacccatggatggaggataagacccatatctccagttgggaggacgtgccctacttaggcaaacgggaagaccagtggtgcggcagcctgatagggttgacggctagggccacatgggcgaccaatatccaagtcgctattaaccaggtgcgaagactgatcggaaatgagaactacctcgattatatgacttcgatgaagcggtttaaaaatgaatccgaccctgagggtgccctttggtga

SEQ ID NO: 13595 - RNA, 9879 nt, synthetic construct
  misc_feature 1..9879: note = derived and/or modified CDS sequence (opt3) from DENV-1__FJ182018__SS-prME
  source 1..9879: mol_type = other RNA
agcgtgaccatgctgctcatgcttatgcccacagccctggctttccacttgactacgagaggaggggaacctcatatgatcgtctccaagcaggaaagaggaaaatctttactgtttaagacctcagccggtgttaatatgtgcacactaattgccatggacctcggcgaactgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccggtagcttcaaactggagaaggaagtcgccgagacgcagcacggaacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattatcatcggtgccggggaaaaagctctgaagctctcctggttcaagaaaggctcaagtattggaaagatgtttgaggccaccgcaagaggcgccaggcggatggctatcctgggggatacagcctgggacttcggaagcattggtggcgtgtttacgtccgttgggaaacttgtgcatcagatattcggaaccgcatacggcgtcctgttttctggtgtgagctggactatgaagatcgggattggcgtattgctcacatggctgggattaaattcacgaagtacctccctgagcatgacatgtatcgcggtgggcctagttactctctacctgggggtcatggtgcaggctgattctggatgcgtgatcaactggaaaggccgcgaacttaagtgtggttcagggattttcgtcaccaatgaggttcacacgtggacagaacaatataagtttcaggccgacagtccgaaaagattgagcgcagccataggaaaggcttgggaggagggcgtgtgcggtatcaggtccgccacccggctggaaaacattatgtggaaacagatctctaacgagctcaatcatattctgttagaaaacgacatgaagttcactgtggtagtcggcgatgtggcagggatcctggctcagggcaaaaagatgatacgccctcaacccatggagtacaaatattcgtggaaaagctggggcaaggccaagatcattggggcggacgttcagaataccacatttatcattgatggaccaaacactcctgaatgtcccgacgatcagagagcctggaatatctgggaggtggaggactacggcttcggtatatttaccacaaacatttggcttaagttgagggattcccacacgcaggtctgcgaccaccgtctcatgtcagctgcaatcaaagatagtaaggccgtgcatgctgacatggggtattggattgaatctgagaaaaatgaaacctggaagctggcccgggcatccttcatcgaggttaagacttgtatatggccaaaatcccacacactatggtcaaacggagtgctggaaagcgagatgatcattcccaagatctacggcggtcctatttctcaacataattatcgaccaggctacttcacccagactgcggggccgtggcacctcggaaaactggagcttgattttgacttgtgcgaaggcacaaccgtagtcgtggatgagcactgcgggaacagaggaccctccctgaggacgactaccgtgacaggcaagatcatacatgaatggtgttgccgcagttgtaccttacctccactccggttcagaggtgaggacgggtgctggtacggaatggagattaggcccgtcaaagaaaaggaggaaaatctggttaagagcatggtgtctgccggctccggtgaggtagactcatttagtcttggcctgttgtgtatcagcatcatgattgaagaggtgatgcgctcgcgatggtcccggaaaatgctcatgactgggacactggctgtcttctttctactgatcatgggacagctcacctggaacgatctgattcgtctttgcataatggtgggcgccaatgcatctgacagaatggggatgggaacaacttatttggctctgatggccaccttcaagatgaggcctatgtttgcagttggcttactcttccgccggctgacgagcagagaggtgcttctgctaacaatcggtctctcactggtcgccagtgtggaattgccaaactccctggaggaattaggggatggactcgctatgggcattatgatcctgaaacttctgaccgactttcaatctcaccagttgtgggcgactctcctgagcctaaccttcattaagacaactttttccctgcattacgcctggaaaaccatggcaatggttctttcaatcgtgagcctcttccccctgtgtttgagtacgacatctcagaagaccacttggctgccggtcttactcggctccctggggtgcaagcctcttacaatgtttctgatagctgagaataaaatctggggaaggcgaagctggccattgaacgaaggtattatggccgtaggcatcgtgtcgattctcctgtcatctctactgaagaacgatgttccccttgccgggcctctcatcgctggaggcatgctgatagcatgttatgtgattagtggttccagcgccgacttgtctttagagaaagcggctgaggtcagctgggaagaggaagccgagcactccggggcatcacataatatcctggtggaagtacaggatgacggaaccatgaagatcaaagatgaggagcgcgacgatactctcacaattctgcttaaggccaccctgttggctgtgagtggcgtctaccccctaagcataccagcaacgctgttcgtttggtatttctggcagaaaaagaagcagcggtctggcgtgctctgggacactccttcacccccagaagtggagagagccgtcctggatgacgggatctacaggattatgcagcgtggacttttaggtcgcagccaggtgggcgttggggtatttcaagaaaacgtgttccacaccatgtggcacgtcacacggggagcggtgctgatgtatcagggcaaaagactcgagccgagttgggctagcgttaagaaagacttgatctcctacggtgggggatggaggctgcagggctcttggaataccggcgaggaagtgcaggtcattgccgtggagcctgggaagaaccccaaaaatgtacaaacagcaccaggaacttttaagacccccgaaggtgaggtcggcgccatcgctctcgatttcaagcctgggacgtcgggaagcccaatagtgaaccgagaaggcaaaatcgttggtctgtacgggaatggagtggtcacaacttcaggcacctatgtgtccgccattgcacaggctaaggccagtcaggagggcccccttcctgagatcgaagacgaggtttttcggaaacgcaacctgacaattatggatttgcatccggggtctggaaagaccagaaggtacctaccagcgatcgtgcgggaagccataaaacgaaagctgagaactctcattttagcacccacccgcgtcgtggctagcgagatggccgaagctctgaagggtatgcctatcaggtatcaaacaacggcagtaaaatccgagcacactggcaaggagatcgtggaccttatgtgccatgccaccttcacaatgcgtctgctctcaccagttcgggtccccaattacaacatgattatcatggatgaagcccactttaccgacccttctagcatagctgcgagagggtatattagtactagggtgggaatgggcgaggcagccgctatcttcatgacagccaccccgcccggttccgtggaagcatttccacagagcaatgccattatccaggatgaggaacgcgacatacctgagcgatcttggaactcagggtacgagtggattacggatttccccggaaaaactgtctggtttgtaccatccatcaagagtggcaatgacatcgctaactgtttgaggaaaaatggcaagcgggtgattcagctgagcaggaagacattcgataccgaatatcagaaaaccaagaacaacgactgggactacgttgtgactacagatatctcggagatgggggcgaatttccgcgccgaccgtgtcattgatcctagacggtgcctcaaacccgtgatactgaaggacggaccagaaagggttatccttgcaggtccgatgcctgtgaccgtcgcttctgccgcacagcgccgaggcagaattgggcggaaccataataaagagggagatcagtacatctatatgggccagcccctaaacaatgacgaggatcacgcccactggacagaagctaagatgctgttggacaacatcaatactccagagggtattatacccgccttatttgaacctgagagggaaaagtccgcggcaatcgatggggagtaccgcctgagaggcgaggccaggaaaacgttcgtggaactcatgcggcgtggagacctgccagtatggcttagctataaggtggcttcagagggctttcaatacagtgatcgccgatggtgcttcgacggggaaagaaacaatcaggttctggaggaaaacatggatgtcgagatttggaccaaagagggagaaaggaagaaactccggccccgctggttggacgccagaacatattctgaccctctggctctaagggagtttaaggagttcgcagccggtcggcgatccgtgagcggcgatctgatcctcgagattgggaaacttccgcagcatctgactcagagagctcaaaatgccttagacaacttggtgatgctgcacaattcagaacagggaggccgcgcatacaggcatgcgatggaggagctcccagataccatcgaaacactgatgcttctggccctcatagctgtcttgaccggtggggttactctgtttttcttaagtggccggggactaggcaagacgagcatcgggctgctctgtgtgatggcctcctctgtacttctgtggatggcaagcgtggagccccactggattgctgcctccatcattttggaatttttcctgatggtcctcctgatccctgagcccgaccgtcagagaaccccacaggataaccaacttgcatatgtggttataggactcctgtttatgattttgacagtggccgctaatgagatgggtctgttagaaactaccaagaaagacctaggcatcgggcacgtcgcggtagagaaccatcaccatgccgcaatgctggatgtggacctccaccctgcttcagcctggacactttacgccgttgcaaccactattatcacacccatgatgaggcatacgatagaaaacaccactgctaatatctctctgacagccattgcgaaccaggctgccatcttgatgggactggataagggctggccaattagtaaaatggacatcggtgtgcctctcctggcacttgggtgctactcgcaggtcaatccgttaaccctgaccgccgctgtgctcatgttggtcgcacactatgccataattggccccggactgcaagcgaaggctacacgcgaggcccagaaacggactgcagccggcatcatgaagaacccaacggtggatgggatcgttgctattgacctagatcctgtggtatacgacgccaagttcgaaaaacagctgggacagatcatgctccttatactgtgtaccagccaaattttgctgatgcgaacaacttgggcactctgcgagtccatcaccctggctacaggccccttaaccactctttgggagggttctccagggaagttttggaatacgacaattgccgtgtcaatggcgaacatcttcagaggaagctatctggccggcgcaggtctcgctttctccctaatgaaaagtctgggcgggggaaggcgcggcaccggggcccagggagaaactttgggcgagaagtggaaacggcagctgaatcagctctctaagagcgaatttaacacctacaagagatcaggtataatggaggtcgaccgttccgaagcaaaagaggggcttaagaggggagagacaactaaacacgctgttagtcggggcaccgccaagctgcgctggttcgtggaacgaaatttggtcaaacctgagggtaaggtgatcgatctgggctgtgggagaggaggctggagctattactgcgccgggctcaagaaagtaacagaagtgaagggatatacgaaaggcggtcccgggcatgaggaaccgattccaatggcgacctacggatggaacttagttaagctgcactctggcaaagacgtgtttttcatccctcccgagaagtgtgatactcttctgtgcgacattggcgagtcctcaccaaatcccacaatcgaagaggggaggaccctacgggtcctcaaaatggtggaaccttggctgcgcggaaaccaattttgtattaagatcttgaatccgtacatgcccagcgtcgtggagactctggagcagatgcagagaaagcatggtggcatgctcgttaggaacccactttcgcgaaattctacacacgaaatgtattgggtaagttgcgggaccggaaacatagtgtccgctgtcaatatgacgagccggatgctgttaaaccgtttcaccatggcacacagaaaacctacatacgagcgcgatgtggacctgggcgccggtactaggcatgttgctgtggaacccgaggtcgccaacttggatattatcgggcagcggatcgaaaatattaagcacgagcataaatcaacctggcactatgacgaggataacccttacaagacatgggcatatcatggatcctacgaagtgaaaccatctggcagcgccagttccatggtaaatggcgtggttaagctcctgactaagccctgggacgtcatacctatggtgacccaaatcgctatgacagataccactccatttgggcagcagagagtgttcaaagagaaggtcgacacgcgcacacccaaagcgaagaggggaaccgcccaaattatggaagttactgcaaaatggctatggggttttcttagccgaaacaagaagccgcggatctgtaccagagaggagttcacaaggaaagtgcgctctaatgctgccattggcgcagtatttgtggacgagaaccagtggaactcagccaaggaggctgtcgaagatgagcgtttctgggacctggtgcaccgggaaagagagctccacaaacaggggaagtgcgccacgtgcgtttataacatgatgggaaaaagggaaaagaagctgggcgagtttggtaaagcgaaggggagtcgcgcaatctggtacatgtggttgggagcccgattcctggagttcgaagctctcggctttatgaatgaggatcattggttctcccgggaaaacagcctttctggcgtggagggggagggactgcacaaattaggttacatactgagagacatctcgaagattcctggcgggaatatgtatgccgatgacaccgcaggatgggatactaggatcacagaagacgatttgcagaacgaggctcgcattaccgacatcatggaaccagagcatgccctcctggctaaatcaatatttaagctaacttaccaaaataaagtcgtgagagtacagcggcccgccaagaacggcacagttatggatgtgattagcaggcgtgaccagcgaggttccgggcaggtcggaacctatggccttaatacattcactaacatggaagcacaactgatccgccagatggagagtgagggcatcttttctcctagcgaactcgagaccccaaacctggcggaaagagtgttggattggttagagaagtacggggtggaacggctgaaaaggatggccatttccggagacgactgtgtcgttaagcccatagatgaccgcttcgctacggccctcaccgcacttaatgatatgggtaaagtgagaaaggacatcccgcagtgggagccttcaaaaggctggaacgattggcagcaagtacccttttgcagtcaccacttccatcagctgattatgaaggacgggcgggagatcgtggtcccatgtaggaatcaggatgagctagtgggacgagctcgtgtttctcagggcgccggttggagcctgagagagacagcatgcctcgggaagtcctatgcccaaatgtggcagttgatgtactttcaccgccgggacctgaggcttgcggctaacgccatttgttcagcagtgcctgtcgattggatccccactagcagaaccacatggtctatacatgcccaccatcagtggatgactaccgaagacatgctgtccgtgtggaatcgcgtatggatcgaggaaaacccatggatggaggataaaacgcacattagtagctggggagacgttccctatctcggcaagcgggaggaccaatggtgcggctcgttaatcgggctgacagctagggccacctgggcaactaatattcaggtggctatcaaccaggtccgaagattgattggaaatgaaaactacctggattacatgacatccatgaaacggttcaagaatgagggtgaccctgaaggcgccctctggtga

SEQ ID NO: 13596 - RNA, 9879 nt, synthetic construct
  misc_feature 1..9879: note = derived and/or modified CDS sequence (opt3) from DENV-1__FJ410287__SS-prME
  source 1..9879: mol_type = other RNA
agcgtgaccatgctgctcatgcttatgcccacggcactggctttccacttgactacgagaggaggggaacctcatatgatcgtctccaagcaggaaagagggaaatctttactgtttaagacctcagccggtgttaatatgtgcacactcattgccatggacctcggcgagctgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactgctcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattaccagccaggcccccacaaccgagatccagctgactgactacggggcgctcacacttgattgttctcctaggacgggactggacttcaacgaaatggtcttgctaaccatgaaggagaaatcctggctggtgcataagcagtggtttctcgatctgccacttccgtggacttcaggcgccagcacaagtcaagagacctggaatcggcaggacctgttggtaacattcaaaactgcacacgctaagaagcaggaagttgtggtcctcggttctcaagagggggccatgcacaccgctctgacgggcgccaccgaaatccagacatccggaactaccacaatttttgcaggccatttaaaatgccgtctgaagatggataaactaactctcaaggggatgagctatgtgatgtgtaccggatcgttcaaactggagaaggaagtcgccgagacgcagcacggtacagtgcttgttcagataaagtacgagggcaccgacgctccctgcaaaatccctttcttgactcaagatgaaaagggggtgacacagaacggacgcctgattaccgcgaatccaatcgtaactgacaaagagaagcccgtcaacatagaagcagagcctccatttggcgagtcttatattatcatcggtgccggggaaaaagctctcaagctgtcctggttcaagaaaggctcaagtattggaaagatgtttgaggccaccgcaagaggcgccaggcggatggctatccttggggatacagcctgggacttcggaagcattggtggcgtgtttacgtccgttgggaaactggtgcatcagatattcggaaccgcatacggcgtcttgttttctggtgtgagctggactatgaagatcgggattggcgtactcctgacatggttaggactaaattcacgaagtacctccctaagcatgacatgtatcgcggtgggcctcgttactctgtaccttggggtcatggtgcaggctgattctggatgcgtgatcaactggaaaggccgcgaattgaagtgtggttcagggattttcgtcaccaatgaggttcacacgtggacagaacaatataagtttcaggccgacagtcccaaaagactgagcgcagccataggaaaggcttgggaggagggcgtgtgcggtatcaggtccgccacccggctcgaaaacattatgtggaaacagatctctaacgagctgaatcatattttactggaaaacgacatgaagttcactgtggtagtcggcgatgtggcagggatccttgctcagggcaagaagatgatacgcccgcaacctatggagtacaaatattcgtggaaaagctggggcaaggccaagatcattggggcggacgttcagaataccacatttatcattgatggacccaacactccagaatgtcctgacgatcagagagcctggaatatctgggaggtggaggactacggcttcggtatatttaccacaaacatttggttgaagctcagggattcctatacgcaggtctgcgaccaccgtctgatgtcagctgcaatcaaagatagtaaggccgtgcacgctgacatggggtactggattgaatctgagaaaaatgaaacctggaagctagcccgggcctcgttcatcgaggttaagacttgtatatggcccaaatcccatacactgtggtcaaacggagtgctcgaaagcgagatgatcattccaaagatctatggcggtcccatttctcaacacaattaccgacctggctacttcacccagactgcggggccatggcatctgggaaaacttgagttggattttgacctgtgcgaaggcacaaccgtagtcgtggatgagcactgcgggaacagaggaccgtccttaaggacgactaccgtgacaggcaagatcatacacgaatggtgttgccgcagttgtaccctaccccctctgcggttcagaggtgaggacgggtgctggtatggaatggagattaggccagtcaaagaaaaggaggaaaatcttgttaagagcatggtgtctgccggctccggtgaggtagactcatttagtctgggcttgctctgtatcagcatcattatcgaagaggtgatgcgctcgcgatggtcccggaaaatgctgatgactgggacactagctgtcttctttctgctcattatgggacagctgacctggaacgatcttatacgtttgtgcatcatggtgggcgccaatgcatctgacagaatggggatgggaacaacttacctggctttaatggccaccttcaagatgaggcccatgtttgcagttggcctcctgttccgccggcttacgagcagagaggtgctgctactcacaattggtctgtcattggtcgccagtgtggaactgcctaactccttagaggaactcggggatggactggctatgggcatcatgattcttaaactgttgaccgactttcaatctcatcagctctgggcgactctgctaagcctgaccttcatcaagacaactttttcccttcactatgcctggaaaaccatggcaatggttctctcaatagtgagcctgttcccattgtgtctgagtacgacatctcagaagaccacttggttacccgtcctcctgggctcccttgggtgcaagccgctgacaatgtttttgatcgctgagaataaaatttggggaaggcgaagctggcctctcaacgaaggtatcatggccgtaggcattgtgtcgatcctgctatcatctctgcttaagaacgatgttccactcgccgggcccctgatagctggaggcatgttgattgcatgttacgtgatcagtggttccagcgccgacttatctctggagaaagcggctgaggtcagctgggaagaggaagccgagcattccggggcatcacacaatatcctcgtggaagtacaggatgacggaaccatgaagattaaagatgaggagcgcgacgatactctgacaatacttctgaaggccaccttgctagctgtgagtggcgtctatcctctgagcatccccgcaacactcttcgtttggtacttctggcagaagaagaagcagcggtctggcgtgctgtgggacactccatcccctcccgaagtggagagagccgtccttgatgacgggatttataggatcatgcagcgtggattactgggtcgctcacaggtgggcgttggggtatttcaagaaaacgtgttccataccatgtggcacgtcacacggggagcggtgctcatgtaccagggcaaaagattggagccaagttgggctagcgttaagaaagacctgatttcctacggtgggggatggaggctccagggctcttggaataccggcgaggaagtgcaggtcatcgccgtggagccggggaagaaccctaaaaatgtacaaacagcacccggaacttttaagaccccagaaggtgaggtcggcgccatagctctggatttcaagcccgggacgtcgggaagccctatcgtgaaccgagaaggcaaaattgttggtctttatgggaatggagtggtcacaacttcaggcacctacgtgtccgccatcgcacaggctaaggccagtcaggagggcccactgcccgagattgaagacgaggtttttcggaaacgcaacttgacaatcatggatctacaccctgggtctggaaagaccagaaggtatctgccggcgatagtgcgggaagccattaaacgaaagctcagaactttaatcctggcaccaacccgcgtcgtggctagcgagatggccgaagctcttaagggtatgcccatcaggtaccaaacaacggcagtaaaatccgagcatactggcaaggagattgtggacctgatgtgccacgccaccttcacaatgcgtctcttgtcacctgttcgggtcccaaattataacatgatcataatggatgaagcccattttaccgacccctctagcattgctgcgagagggtacatcagtactagggtgggaatgggcgaggcagccgctattttcatgacagccacccctccgggttccgtggaagcatttccccagagcaatgccgtcatccaggatgaggaacgcgacataccagagcgatcttggaactcagggtatgagtggattacggatttccctggaaaaactgtatggtttgtgccctccatcaagagtggcaatgacatcgctaactgtctgaggaaaaatggcaagcgggttattcagctcagcaggaagacattcgataccgaataccagaaaaccaagaacaacgactgggactacgtggtcactacagatatctcggagatgggggcgaatttccgcgccgaccgtgtgattgatccaagacggtgcctgaaacctgttatacttaaggacggacccgaaagggtgatcctagcaggtccaatgccggtcaccgtggcttctgccgcacagcgccgaggcagaattgggcggaaccacaataaagagggagatcagtatatctacatgggccagcctctgaacaatgacgaggatcatgcccactggacagaagctaagatgttgttagacaacatcaatactcccgagggtattataccagccctgtttgaacccgagagggaaaagtccgcggcaatcgatggggagtatcgcctcagaggcgaggccaggaaaacgttcgtagaactgatgcggcgtggagaccttcctgtgtggctgagctacaaggttgcttcagagggctttcaatatagtgatcgccgatggtgcttcgacggggaaagaaacaatcaggtcctcgaggaaaacatggatgtggagatttggaccaaagagggagaaaggaagaaattgcggccacgctggctggacgccagaacatactctgaccccctagctctgagggagtttaaggagttcgcagccggtcggcgatccgtgagcggcgatctcatccttgagattgggaaactgcctcagcacttaactcagagagctcaaaatgccttggacaacctggtcatgctccataattcagaacagggaggccgcgcatataggcacgcgatggaggagctgccggataccatcgaaacacttatgctgctcgccttgatagctgttctgaccggtggggtgactttatttttcctaagtggccggggactgggcaagacgagcatcgggctcctttgtgtaatggcctcctctgtgctgttgtggatggcaagcgtcgagccacattggattgctgcctccatcattctggaatttttcctcatggtgctgcttatccccgagcctgaccgtcagagaacaccccaagataaccaactcgcatacgttgtgataggactgttgtttatgattctgaccgtcgccgctaatgagatgggtttactagaaactaccaagaaagacctgggcatcgggcacgtagcggtggagaaccaccatcacgccgcaatgctcgatgttgaccttcatccagcttcagcctggacactgtacgccgtggcaaccactattatcacacctatgatgaggcacacgatagaaaacaccactgctaatatctctttgacagccattgcgaaccaggctgccatcctgatgggactcgataagggctggcccattagtaaaatggacatcggtgtcccactgcttgcattagggtgctatagccaggtgaatcctctgaccctcaccgccgctgtcttgatgctggtggcacattacgccataattggcccgggactacaagcgaaggctacacgcgaggcccagaaacggactgcagccggcatcatgaagaaccccacggttgatgggatcgtggctattgacctggatccagtagtgtatgacgccaagttcgaaaaacagctcggacagatcatgcttctgatattgtgtaccagccaaattctgctcatgcgaacaacttgggcactgtgcgagtccatcaccttagctacaggccctcttaccactctgtgggagggttctcccgggaagttttggaatacgacaattgccgtctcaatggcgaacatcttcagaggaagctacctcgccggcgcaggtctagctttctccctgatgaaaagtttgggcgggggaaggcgcggcaccggggcccagggagaaactctgggcgagaagtggaaacggcagctcaatcagctttctaagagcgaatttaacacctataagagatcaggtataatggaggttgaccgttccgaagcaaaagaggggctgaagaggggagagacaactaaacacgctgtgagtcggggcaccgccaagttgcgctggttcgtcgaacgaaatctggtgaaaccagagggtaaggtaatcgatctcggctgtgggagaggaggctggagctactattgcgccgggttaaagaaagtgacagaagttaagggatacacgaaaggcggtcctgggcacgaggaacccattccgatggcgacctacggatggaacctggtgaaacttcattctggcaaagacgtctttttcatcccacctgagaagtgtgatactctgctatgcgacattggcgagtcctcacccaatccaacaatcgaagaggggaggaccctccgggtgctgaaaatggtcgaaccctggttgcgcggaaaccaattttgtattaagatcctgaatccttatatgccgagcgtggttgagactctcgagcagatgcagagaaagcacggtggcatgcttgtaaggaaccccctgtcgcgaaattctacacatgaaatgtactgggtgagttgcgggaccggaaacatagtctccgctgtgaatatgacgagccggatgttactgaaccgtttcaccatggcacacagaaaaccaacatatgagcgcgatgttgacttgggcgccggtactaggcacgtggctgtcgaacctgaggtggccaacctcgatattatcgggcagcggatcgaaaatattaagcatgagcacaaatcaacctggcattacgacgaggataacccctataagacatgggcataccacggatcctatgaagtaaaaccttctggcagcgccagttccatggtgaatggcgttgtcaagctgctaactaagccatgggacgtgatacccatggtgacccaaatcgctatgacagataccactccttttgggcagcagagagtcttcaaagagaaggttgacacgcgcacaccaaaagcgaagaggggaaccgcccaaattatggaagtgactgcaaaatggctttggggttttctgagccgaaacaagaagccccggatctgtaccagagaggagttcacaaggaaagtacgctctaatgctgccattggcgcagtgtttgtcgacgagaaccagtggaactcagccaaggaggctgtggaagatgagcgtttctgggacctcgttcatcgggaaagagagctgcacaaacaggggaagtgcgccacgtgcgtgtacaacatgatgggaaaaagggaaaagaagttgggcgagtttggtaaagcgaaggggagtcgcgcaatctggtacatgtggctgggagcccgattcctcgagttcgaagctcttggctttatgaatgaggatcactggttctcccgggaaaacagcctgtctggcgtcgagggggagggattacataaactgggttatatattgagagacatctcgaagattccgggcgggaatatgtacgccgatgacaccgcaggatgggatactaggatcacagaagacgatctccagaacgaggctcgcattaccgacatcatggaacctgagcacgccctgctagctaaatcaatatttaaacttacttatcaaaataaagtggtaagagttcagcggccagccaagaacggcacagtgatggatgtcattagcaggcgtgaccagcgaggttccggacaggtgggaacctacggcctgaatacattcactaacatggaagcacaactcatccgccagatggagagtgagggcatcttttctcccagcgaactggagacccctaacttggcggaaagagtgttagattggctggagaagtatggggtcgaacggctcaaaaggatggccatttccggagacgactgtgttgtgaagccaatagatgaccgcttcgctacggcccttaccgcactgaatgatatgggtaaagtaagaaaggacatcccccagtgggagccgtcaaaaggctggaacgattggcagcaagtgcctttttgcagtcatcacttccaccagctaattatgaaggacgggcgggagatcgtcgtgccctgtaggaatcaggatgaactggttggacgagctcgtgtgtctcagggcgccggttggagcctcagagagacagcatgcttggggaagtcctacgcccaaatgtggcagctgatgtattttcatcgccgggaccttaggctggcggctaacgccatttgttcagcagtcccagtggattggatccctactagcagaaccacatggtctatacacgcccatcaccagtggatgactaccgaagacatgctctccgtatggaatcgcgtttggatcgaggaaaacccctggatggaggataaaacgcatattagtagctggggagacgtgccatacttaggcaagcgggaggaccaatggtgcggctcgctgatcgggttgacagctagggccacctgggcaactaatattcaggtcgctatcaaccaggtgcgaagactgattggaaatgaaaactacctcgattatatgacatccatgaaacggttcaagaatgagggtgaccccgaaggcgccctttggtga

SEQ ID NO: 13597 - RNA, 9879 nt, synthetic construct
  misc_feature 1..9879: note = derived and/or modified CDS sequence (opt3) from DENV-1__FJ432719__SS-prME
  source 1..9879: mol_type = other RNA
tccgtgaccatgctgctcatgcttatgcccacagccctggctttccacttgactacgagaggaggggaacctcatatgatcgtctccaagcaggaaagaggaaaatctttactgtttaagacctcagccggtgttaatatgtgcacactgattgccatggacctcggcgagctgtgtgaagatactatgacctacaaatgcccacggattacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccgcggagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatgtgtactgggtcgttcaaactggagaaggaacttgctgagacccagcacggtacggtcttggtgcagataaagtacgagggcacagacgcgccttgcaaaatcccattctcgacccaagatgaaaagggggttactcagaacggacgcctgattacagcaaatcccatcgtgaccgacaaagagaagcctgtaaacatagaagccgagccaccctttggcgagtcttatattgtcatcggtgctggggaaaaagccctcaagctgtcctggttcaagaaaggctcaagtatcggaaagatgtttgaggcaactgccagaggcgctaggcggatggccattcttggggataccgcatgggacttcggaagcatcggtggcgtgtttacatccgttgggaaactggtgcatcagattttcggaacggcgtacggcgtcttgttttctggtgtgagctggaccatgaagatagggatcggcgtactcctgacttggttaggactaaattcacgaagtacatccctaagcatgacctgtattgctgtgggcctcgttacactgtaccttggggtcatggtgcaggccgattctggatgcgtgatcaactggaaaggccgcgaattgaagtgtggttcagggatcttcgtcactaatgaggttcacacctggacggaacaatataagtttcaggcagacagtccgaaaagactgagcgccgctattggaaaggcctgggaggagggcgtgtgcggtataaggtccgcaacacggctcgaaaacatcatgtggaaacagatttctaacgagctgaatcatatcttactggaaaacgacatgaagttcaccgtggtagtcggcgatgtggctgggattcttgcccagggcaagaagatgatccgccctcaacccatggagtacaaatattcgtggaaaagctggggcaaggcgaagataatcggggccgacgttcagaatactacctttattatcgatggaccaaacacacctgaatgtcccgacgatcagagagcttggaatatttgggaggtggaggactacggcttcggtatctttactaccaacatatggttgaagctcagggattcctatacacaggtctgcgaccaccgtctgatgtcagcagccattaaagatagtaaggctgtgcacgccgacatggggtactggatcgaatctgagaaaaatgaaacgtggaagctagcacgggcgagcttcattgaggttaagacctgtatctggccaaaatcccatactctgtggtcaaacggagtgctcgaaagcgagatgataatccccaagatttatggcggtcctatctctcaacacaattaccgaccaggctacttcacacagaccgccgggccgtggcatctgggaaaacttgagttggattttgacctgtgcgaaggcactacagtagtcgtggatgagcactgcgggaacagaggaccctccttaaggaccacgactgtgaccggcaagattatccacgaatggtgttgccgcagttgtacactccctccactgcggttcagaggtgaggacgggtgctggtatggaatggagataaggcccgtcaaagaaaaggaggaaaatcttgttaagagcatggtgtctgctggctccggtgaggtagactcatttagtctgggcttgctctgtattagcatcatgatcgaagaggtgatgcgctcgcgatggtcccggaaaatgctgatgaccgggactctagccgtcttctttctgctcattatgggacagctgacatggaacgatcttatccgtttgtgcattatggtgggcgcaaatgcttctgacagaatggggatgggaaccacatacctggccttaatggcaactttcaagatgaggcctatgtttgccgttggcctcctgttccgccggcttaccagcagagaggtgctgctactcacgataggtctgtcattggtcgctagtgtggaactgccaaactccttagaggaactcggggatggactggcgatgggcatcatgattcttaaactgttgacagactttcaatctcatcagctctgggccaccctgctaagcctgactttcatcaagaccacattttcccttcactatgcatggaaaactatggctatggttctctcaattgtgagcctgttccccttgtgtctgagtaccacgtctcagaagacaacctggttaccggtcctcctgggctcccttgggtgcaagcctctgactatgtttttgatcgccgagaataaaatatggggaaggcgaagctggccactcaacgaaggtatcatggccgtaggcattgtgtcgatcctgctatcatctctgcttaagaacgatgttcccctcgctgggcctctgattgcaggaggcatgttgatcgcctgttacgtgataagtggttccagcgcggacttatctctggagaaagctgccgaggtcagctgggaagaggaagcagagcattccggggcctcacacaatattctcgtggaagtacaggatgacggaacaatgaagatcaaagatgaggagcgcgacgataccctgactatccttctgaaggctacattgctagcagtgagtggcgtctatcccctgagcattccagccaccctcttcgtttggtacttctggcagaagaagaagcagcggtctggcgtgctgtgggacacgccttcacccccagaagtggagagagcggtccttgatgacgggatatataggatcatgcagcgtggattactgggtcgcagccaggtgggcgttggggtatttcaagaaaacgtgttccatactatgtggcacgtcacccggggagctgtgctcatgtaccagggcaaaagattggagccgagttgggccagcgttaagaaagacctgatttcctacggtgggggatggaggctccagggctcttggaatacaggcgaggaagtgcaggtcatcgcagtggagcctgggaagaaccccaaaaatgtacaaaccgccccaggaacatttaagactcccgaaggtgaggtcggcgctattgccctggatttcaagcctgggacctcgggaagcccaatcgtgaaccgagaaggcaaaatagttggtctttatgggaatggagtggtcacgacatcaggcacttacgtgtccgcaatcgctcaggccaaggcgagtcaggagggccccctgcctgagattgaagacgaggtttttcggaaacgcaacttgaccatcatggatctacacccggggtctggaaagacaagaaggtatctgccagccattgtgcgggaagcaatcaaacgaaagctcagaaccttaatactggctcccactcgcgtcgtggccagcgagatggctgaagcacttaagggtatgcctattaggtaccaaaccacagccgtaaaatccgagcatacgggcaaggagatcgtggacctgatgtgccacgccactttcaccatgcgtctcttgtcaccagttcgggtccccaattataacatgatcattatggatgaagctcattttacagacccttctagcatcgcggcaagagggtacataagtaccagggtgggaatgggcgaggccgctgccattttcatgactgcaacaccgcccggttccgtggaagcctttccacagagcaatgctgtcatccaggatgaggaacgcgacattcctgagcgatcttggaactcagggtatgagtggatcaccgatttccccggaaaaacggtatggtttgtgccatccataaagagtggcaatgacattgcgaactgtctgaggaaaaatggcaagcgggttatccagctcagcaggaagactttcgatacagaataccagaaaaccaagaacaacgactgggactacgtggtcaccactgatatctcggagatgggggccaatttccgcgcagaccgtgtgattgatcctagacggtgcctgaaacccgttatccttaaggacggaccagaaagggtgattctagctggtccgatgcctgtcacagtggcctctgcagcccagcgccgaggcagaatagggcggaaccacaataaagagggagatcagtatatctacatgggccagcccctgaacaatgacgaggatcatgctcactggaccgaagccaagatgttgttagacaacattaatacaccagagggtatcatccccgcgctgtttgaacctgagagggaaaagtccgcagccattgatggggagtatcgcctcagaggcgaggctaggaaaactttcgtagaactgatgcggcgtggagaccttccagtgtggctgagctacaaggttgcctcagagggctttcaatatagtgatcgccgatggtgcttcgacggggaaagaaacaatcaggtcctcgaggaaaacatggatgtggagatatggacgaaagagggagaaaggaagaaattgcggccccgctggctggacgctagaacctactctgaccctctagcactgagggagtttaaggagttcgccgctggtcggcgatccgtgagcggcgatctcatccttgagattgggaaactgccgcagcacttaacacagagagcccaaaatgcattggacaacctggtcatgctccataattcagaacagggaggccgcgcgtataggcacgccatggaggagctgccagatactatcgaaacccttatgctgctcgctttgattgccgttctgacaggtggggtgaccttatttttcctaagtggccggggactgggcaagactagcatcgggctcctttgtgtaatggcatcctctgtgctgttgtggatggctagcgtcgagccccattggatagccgcatccatcattctggaatttttcctcatggtgctgcttatccctgagcccgaccgtcagagaacgccacaggataaccaactcgcctacgttgtgattggactgttgtttatgatcctgaccgtcgctgcgaatgagatgggtttactagaaacaactaagaaagacctgggcatagggcacgtagccgtggagaaccaccatcacgcagctatgctcgatgttgaccttcatcctgcctcagcctggaccctgtacgcagtggctacaaccattatcactcccatgatgaggcacacaattgaaaacacgaccgccaatatctctttgactgcgatagctaaccaggccgcaatcctgatgggactcgataagggctggccaattagtaaaatggacatcggtgtccctctgcttgccttagggtgctatagccaggtgaatccgctgacactcaccgctgcagtcttgatgctggtggcccattacgcgattatcggccccggactacaagctaaggccacccgcgaggcacagaaacggacagccgctggcataatgaagaacccaactgttgatgggattgtggccatcgacctggatcctgtagtgtatgacgcaaagttcgaaaaacagctcggacagatcatgcttctgattttgtgtacgagccaaatcctgctcatgcgaaccacatgggctctgtgcgagtccataactttagccaccggcccccttacaaccctgtgggagggttctccagggaagttttggaatactacgattgcggtctcaatggccaacatcttcagaggaagctacctcgcaggcgctggtctagccttctccctgatgaaaagtttgggcgggggaaggcgcggcacaggggcacagggagaaaccctgggcgagaagtggaaacggcagctcaatcagctttctaagagcgaatttaacacttataagagatcaggtattatggaggttgaccgttccgaagctaaagaggggctgaagaggggagagaccacaaaacacgccgtgagtcggggcactgccaagttgcgctggttcgtcgaacgaaatctggtgaaacctgagggtaaggtaatcgatctcggctgtgggagaggaggctggagctactattgcgcggggttaaagaaagtgaccgaagttaagggatacacaaaaggcggtcccgggcacgaggaaccgataccaatggctacgtacggatggaacctggtgaaacttcattctggcaaagacgtctttttcatccctcccgagaagtgtgataccctgctatgcgacattggcgagtcctcaccaaatcccactatcgaagaggggaggacactccgggtgctgaaaatggtcgaaccttggttgcgcggaaaccaattttgtattaagatcctgaatccgtatatgcccagcgtggttgagaccctcgagcagatgcagagaaagcacggtggcatgcttgtaaggaacccactgtcgcgaaattctactcatgaaatgtactgggtgagttgcgggacaggaaacattgtctccgcagtgaatatgaccagccggatgttactgaaccgtttcacgatggcccacagaaaacctacctatgagcgcgatgttgacttgggcgctggtacaaggcacgtggccgtcgaacccgaggtggcaaacctcgatatcatagggcagcggattgaaaatatcaagcatgagcacaaatcaacttggcattacgacgaggataacccttataagacctgggcctaccacggatcctatgaagtaaaaccatctggcagcgctagttccatggtgaatggcgttgtcaagctgctaacaaagccctgggacgtgatccctatggtgactcaaattgcgatgaccgatacaaccccatttgggcagcagagagtcttcaaagagaaggttgacactcgcacgcccaaagccaagaggggaacagcacaaataatggaagtgaccgctaaatggctttggggttttctgagccgaaacaagaagccgcggatctgtactagagaggagttcaccaggaaagtacgctctaatgccgcaattggcgccgtgtttgtcgacgagaaccagtggaactcagctaaggaggccgtggaagatgagcgtttctgggacctcgttcatcgggaaagagagctgcacaaacaggggaagtgcgcgacatgcgtgtacaacatgatgggaaaaagggaaaagaagttgggcgagtttggtaaagcaaaggggagtcgcgccatctggtacatgtggctgggagctcgattcctcgagttcgaagcccttggctttatgaatgaggatcactggttctcccgggaaaacagcctgtctggcgtcgagggggagggattacataaactgggttatattttgagagacatctcgaagatacctggcgggaatatgtacgcagatgacacggctggatgggataccaggatcactgaagacgatctccagaacgaggcccgcattacagacatcatggaaccagagcacgctctgctagccaaatcaatttttaaacttacctatcaaaataaagtggtaagagttcagcggcccgcaaagaacggcactgtgatggatgtcatcagcaggcgtgaccagcgaggttccggacaggtgggaacatacggcctgaataccttcacaaacatggaagcgcaactcatacgccagatggagagtgagggcatattttctcctagcgaactggagactccaaacttggccgaaagagtgttagattggctggagaagtatggggtcgaacggctcaaaaggatggctatctccggagacgactgtgttgtgaagcccatcgatgaccgcttcgccaccgcacttacggctctgaatgatatgggtaaagtaagaaaggacattccgcagtgggagccttcaaaaggctggaacgattggcagcaagtgcccttttgcagtcatcacttccaccagctaataatgaaggacgggcgggagatcgtcgtgccatgtaggaatcaggatgaactggttggacgagcccgtgtgtctcagggcgcaggttggagcctcagagagaccgcctgcttggggaagtcctacgcgcaaatgtggcagctgatgtattttcatcgccgggaccttaggctggctgccaacgcaatttgttcagccgtccctgtggattggatccccacaagcagaactacctggtctattcacgctcatcaccagtggatgacaactgaagacatgctctccgtatggaatcgcgtttggatcgaggaaaacccatggatggaggataaaacccatataagtagctggggagacgtgccctacttaggcaagcgggaggaccaatggtgcggctcgctgatcgggttgacggccagggcaacatgggctaccaatattcaggtcgccatcaaccaggtgcgaagactgattggaaatgaaaactacctcgattatatgacttccatgaaacggttcaagaatgagtctgaccctgaaggtgcgctttggtga

SEQ ID NO: 13598 - RNA, 9879 nt, synthetic construct
  misc_feature 1..9879: note = derived and/or modified CDS sequence (opt3) from DENV-1__FJ182020__SS-prME
  source 1..9879: mol_type = other RNA
agcgtgacaatgctgctaatgcttatgcccacagcactggctttccacttgactacgcgaggcggggaacctcatatgatcgtctccaagcaggaaagggggaaatctttactgtttaagacatcagccggtgttaacatgtgcacactaattgcaatggacctcggcgagttctgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaagacgcaaactttgtttgccgccgaacattcgtggatagaggctggggtaatgggtgtggactgtttggcaaaggctccttgataacttgcgctaagttcaagtgcgtaaccaaactcgaggggaagattgtgcagtacgaaaacctgaaatattcagtcatcgtgacagttcacaccggagaccagcatcaagtgggtaatgagagtactgaacacggcacgacagccaccattactccccaggcgcctagcaccgagatccagttaacagactacggggccctgaccctcgattgttctccaaggactggacttgactttaacgaaatggtcctgttgacaatgaaggagaaatcctggctagtgcataagcagtggttcctggatctcccgctgccctggacgtcaggcgcaagcaccagtcaagagacttggaatcggaaagaccttctggtaacatttaagaccgctcacgccaagaaacaggaagttgtggtcttgggttctcaggagggggctatgcacacagccctcactggcgcaaccgaaatccaaacgtccggaaccacaactattttcgccggccatctgaagtgccgtttaaaaatggataagctgaccctaaaagggatgagctatgtgatgtgtacaggatcgttcaagctcgagaaggaagtcgctgagactcagcacggtaccgtgctggttcagataaaatacgagggcacggacgcgccttgcaagatcccattttctacacaggatgaaaaaggggtgacccaaaacggacgccttattactgcaaatcccatcgtaacagacaaggagaaacctgtcaacatagaagccgagccacccttcggcgagtcctatattgtgatcggtgctggggaaaaggccttgaagctgtcatggtttaaaaagggcagtagcatcggaaaaatgttcgaggcaaccgccagaggcgctaggcggatggccattctcggggatactgcatgggactttggatccatcggtggcgttttcacctctgtggggaagctggtccatcagatttttggaacagcgtacggcgtgcttttcagcggtgtatcatggacgatgaaaatagggatcggcgtgctgttgacctggctcggactgaatagtcgatccactagcttatctatgacatgtattgctgttggcctggtcaccctatacctcggggtgatggtgcaggccgattcaggatgcgtcatcaactggaagggccgcgaactgaagtgtggtagtgggatctttgttacaaatgaggtgcacacttggaccgaacagtataaattccaagcagacagcccgaagagactttccgccgctattggaaaagcctgggaggagggcgtgtgcggtataaggtctgcaacgcggttggaaaacatcatgtggaagcagatttcgaacgagctgaatcatatcctcctggaaaacgacatgaaatttacagtagtcgtgggcgatgttgctgggattttagcccagggaaagaaaatgatccgccctcagcccatggagtacaagtatagctggaagtcctggggcaaagcgaagataatcggggccgacgtgcaaaataccactttcattatcgatggaccaaacacccctgaatgtcccgacgatcagagagcttggaatatttgggaggtcgaggactacggctttggtatcttcacaactaacatatggctgaaacttagggattcatatacccaggtgtgcgaccaccgtttgatgagtgcagccattaaggattctaaagctgttcacgccgacatggggtactggatcgaaagcgagaagaatgaaacatggaagctcgcacgggcgtccttcattgaggtgaaaacgtgtatctggccaaagtcacataccctgtggagcaacggagtactagaatctgagatgataatccccaaaatttatggcggtcctatctcccagcacaattaccgaccaggctactttactcaaacagccgggccgtggcatctgggaaagctcgagctggatttcgacctttgcgaaggcaccactgtcgtggtggatgagcactgcgggaacagaggacccagtttgaggacaaccacggtcactggcaaaattatccacgaatggtgttgccgcagctgtaccctgcctccattacggtttaagggtgaggacgggtgctggtatggaatggagataagacccgttaaggaaaaagaggaaaatctcgtgaagtctatggtatccgctggctcaggtgaggtggacagtttcagcctgggccttctgtgtatttcgatcatgatcgaagaggtcatgaggtcccgctggtctcgaaaaatgttgatgacagggaccctcgccgtgtttttcctgctaattatgggacagctgacttggaacgatctcatccggctgtgcattatggttggcgcaaatgctagcgaccgtatggggatgggaacaacctaccttgccttgatggcaacatttaagatgagacctatgttcgccgtgggcctgttatttaggcgcctcacttcacgggaggtcctgcttctgaccataggtctaagtctcgtggcttccgttgaactgccaaactctttggaggaactgggggatggattagcgatgggcatcatgattctcaaactgcttacggacttccagagccatcaactgtgggccacattgctctccctgacctttatcaagactaccttctcactacactatgcatggaagacaatggctatggtgctgagcattgtcagtctttttcccctctgtctgtctactacctcccagaaaacgacatggttgccggtactgttaggcagcctcgggtgcaagcctctgaccatgttccttatcgccgagaataaaatatggggaagaaagtcgtggccactgaacgaaggtatcatggccgtgggcattgtttcaatcttgctctctagtctgctcaagaatgatgtgcccctggctgggcctcttattgcaggaggcatgctcatcgcctgttacgtcatatccggtagctctgcggacctgagcttggagaaggctgccgaggtgtcctgggaagaggaagcagagcattcaggggccagtcacaatattttagtagaagtgcaggatgacggaactatgaaaatcaaggatgaggagagggacgatacactgaccatcctcctgaaggctactcttctggcagtcagcggcgtttatcccttgtctattccagccacactattcgtgtggtacttttggcagaaaaagaaacaacgatccggcgtgctgtgggacaccccttcacccccagaagtcgagcgcgcggtgctcgatgacgggatatatcggatcatgcagagaggactgcttggtaggagtcaggttggcgtaggggtgttccaggaaaacgtctttcatacgatgtggcacgtgactcgtggagctgttttaatgtaccaaggcaagcgcctggagccgagctgggcctccgtgaaaaaggacctcatttcttacggtgggggatggcggttgcagggctcgtggaataccggcgaggaagtccaggtgatcgcagtagagcctgggaagaaccccaaaaatgtccagacagccccaggaaccttcaagacaagcgaaggtgaggtgggcgctattgccctggattttaaacccgggacttcaggatcccctatcgttaacagagaaggcaagatagtgggtctctatgggaatggagtcgtgaccacgagtggcacatacgtttctgcaatcgctcaagccaaagcgagccaggagggcccactgcccgagattgaagacgaggtgttcaggaagcgaaaccttactatcatggatctgcaccctgggtccggaaagacccggcgctatttgccggccattgtcagagaagcaatcaaaaggaagctacggacactgatactcgctccaacccgagtggtagcctcagagatggctgaagcattaaaaggtatgcccattagataccagactaccgccgtgaagtctgagcatacaggcaaagagatcgttgacctgatgtgccacgccacgtttactatgcgccttctgagccctgtcagggtgccaaattataacatgatcattatggatgaagctcatttcaccgaccccagttccatcgcggcacgtgggtacataagcacacgggtgggaatgggcgaggccgctgccatttttatgaccgcaactcctccgggttctgtcgaagccttcccccaatcaaatgctgtaatccaggatgaggaaagagacattccagagaggtcctggaacagtgggtatgagtggatcacagattttcctggaaagaccgtgtggttcgttcccagcataaagtcgggcaatgacattgcgaactgtctccgcaaaaatggcaagcgagtgatccagttgtctagaaaaacgttcgatactgaataccagaagaccaagaacaacgactgggactacgtcgtgaccaccgatatctccgagatgggggccaattttcgggcagacagggttattgatccacgccgttgcctgaagcctgtgatcctcaaggacggacccgaaagagtcattctggctggtccaatgccggtgactgtagccagcgcagcccaacggaggggccgcatagggcgaaaccacaataaagagggagatcagtatatctacatgggccagcctcttaacaatgacgaggatcatgctcactggacagaagccaagatgctactggacaacattaatacccccgagggtatcatcccagcgttgttcgaacccgagagagaaaaatcagcagccattgatggggagtatcggttaaggggcgaggctcgcaagacatttgtggaactgatgagaaggggagacctccctgtttggctgagttacaaagtcgcctctgagggcttccagtattccgatcggcgttggtgctttgacggggaacgcaacaatcaagtgcttgaggaaaacatggatgtggagatatggactaaggagggagaaaggaaaaagctgagaccaagatggctcgacgctcggacgtacagcgaccccttggcactgcgcgagttcaaggaatttgccgctggtagaaggtcagtcagtggcgatctaatcctggagattgggaaactccctcagcaccttacccagcgggcccagaatgcactggacaacttagttatgttgcataatagcgaacaaggaggccgagcgtatagacacgccatggaggagctgccggatacaatcgaaactctcatgctgcttgctctgattgccgtgctcaccggtggggtaacattgttctttctgtccggccgcggattaggcaagacctctatcgggctactgtgtgtgatggcaagctccgtcctcctttggatggcttcagtggagccacattggatagccgcatctatcattctggagttctttttgatggttctgctcatccccgagcctgacaggcagcggactccccaggataaccagctggcctacgtggtcattggacttctcttcatgatcctgacggtagctgcgaatgagatgggtttgctggaaaccaccaaaaaggacttaggcatagggcacgtggccgttgagaaccaccatcacgcagctatgctagatgtggacctgcatccagccagtgcctggactctctacgcagtcgctaccacaattatcacccctatgatgcgtcacactattgaaaacacaacggccaatatctcgcttaccgcgatagctaaccaagccgcaatcctgatgggattggataaaggctggcccattagcaagatggacatcggtgtgccactgctcgccctggggtgctattcccaggtcaatcctcttactttaacagctgcagtgctgatgctcgttgcccattacgcgattatcggcccgggattgcaggctaaggccaccagagaggcacagaaaaggaccgccgctggcataatgaagaaccccacagtggatgggattgtagccatcgacctggatccagtggtctatgacgcaaaatttgaaaagcagctaggacagatcatgctgctcattctttgtacttctcagatcctgttgatgcgcacgacctgggctctgtgcgagtcaataacactcgccactggccctctgaccacattatgggagggtagccccgggaaattctggaataccactattgcggtttccatggccaacatcttccggggaagttaccttgcaggcgctggtctggccttttctctcatgaaaagcctaggcgggggacgaagaggcacgggggcacaaggagaaacactgggcgagaagtggaaaaggcagttgaatcagctgtcaaagtccgagttcaacacctataaacgcagtggtattatggaggtggaccggagcgaagctaaggaggggctcaaaagaggagagactaccaagcacgccgtctctcgtggcacagccaaacttaggtggtttgtggaacggaatctggtaaaaccagagggtaaggtgatcgatttgggctgtgggcgcggaggctggtcctactattgcgcggggctgaaaaaggttactgaagtgaaaggatacaccaagggcggtcctgggcacgaggaacccataccgatggctacatacggatggaacctcgtcaaattacattcaggcaaggacgtgttctttatcccacctgagaagtgtgatacgctgctttgcgacattggcgagagctcgcccaatccaaccatcgaagaggggcgaactctgagagtcctaaaaatggtggaaccctggctcaggggaaaccagttctgtattaagatcctgaatccttatatgccgtctgttgtagagacattggagcaaatgcagcggaaacacggtggcatgctggtgcgcaaccccctcagtagaaattccacccatgaaatgtactgggtcagctgcgggactggaaacattgtgtcagcagttaatatgacatccaggatgcttctgaaccgatttaccatggcccaccggaagccaacgtatgagcgtgatgtggacttaggcgctggtaccagacacgtcgccgtggaacctgaggtagcaaacctggatatcatagggcagcgcattgaaaatatcaaacatgagcacaagtctacatggcattacgacgaggataacccctataagacttgggcctaccacggaagctatgaagtgaaacctagtggctccgctagctctatggttaatggcgtcgtgaagttgctcaccaaaccatgggacgtgatccccatggtcacacagattgcgatgactgataccacacctttcgggcaacagagggtttttaaggagaaagtggacacccggactccaaaggccaagagaggaacggcacagataatggaagtaacagctaaatggctgtggggtttcctatcacgcaacaagaaacccaggatctgtacccgagaggaatttactcggaaggtgagaagtaatgccgcaattggcgccgtcttcgtggacgagaaccaatggaactccgctaaagaggccgttgaagatgagaggttttgggaccttgtgcatcgcgaacgtgagctgcacaagcaggggaagtgcgcgacctgcgtctacaacatgatgggaaaacgggaaaagaaactcggcgagttcggtaaggcaaaagggagcagagccatctggtacatgtggctgggagctaggttcttggagtttgaagccctgggcttcatgaatgaggatcactggttttctcgcgaaaactcgctctcaggcgtggagggggagggacttcataagctgggttatattttacgagacatcagcaaaataccgggcgggaatatgtacgcagatgacacagctggatgggatacgcggatcaccgaagacgatctgcagaacgaggccaagattactgacatcatggaacctgagcacgctttgctcgccaagtccattttcaaactgacatatcagaataaggtagttagagtgcaaaggccagccaaaaacggcaccgtcatggatgtgatcagtcgcagagaccagcggggttctggacaggtgggaacttacggcctaaatacatttaccaacatggaagcgcagcttataaggcaaatggagagcgagggcattttctccccctcagaactggagacacctaacctcgccgggcgtgtcctggattggttggaaaagcatggagttgagcgattaaaacgcatggctatcagtggtgacgactgtgtggtaaagccaatcgatgacagatttgccactgcactgaccgctctcaatgatatgggcaaggtgcggaaagacattccccagtgggaaccgtctaaggggtggaacgattggcagcaggtccctttctgcagccaccactttcatcaacttataatgaaagacggaagggagatcgtggttccctgtcgcaatcaggatgagctggtgggcagagcccgggtctcccagggtgcagggtggtcactaagggaaacggcctgcctgggaaagagctatgcgcagatgtggcaactcatgtacttccaccgacgtgacttgagactggctgccaacgcaatttgttctgccgtgccagtagattgggttcctacctcccgcacaacttggagtatccatgctcaccatcagtggatgaccacagaggacatgcttagcgtgtggaatcgggtctggattgaagagaacccctggatggaagataaaactcacatctcgtcctggggcgacgtgccatatctgggcaagagggaggaccagtggtgcgggtctctcataggattaaccgccagagcaacgtgggctacaaatatccaagttgccattaaccaggtgcgccggctgatcggtaatgagaactacttggattacatgacctcaatgaagaggtttaaaaatgaaagcgaccccgagggcgcgctgtggtga

SEQ ID NO: 13599 - RNA, 9879 nt, synthetic construct
  misc_feature 1..9879: note = derived and/or modified CDS sequence (opt3) from DENV-1__FJ182022__SS-prME
  source 1..9879: mol_type = other RNA
agcgtgaccatgctgctcatgcttatgcccaccgccctggctttccacttgactacgcggggcggggaacctcatatgatcgtctccaagcaggaaaggggaaagtctttactgtttaagacctcagccggtgttaatatgtgcacgctaattgccatggacctcggcgaactgtgtgaagatactatgacctacaaatgcccacggattacagaaaccgaaccggacgatgtggactgttggtgcaatgcgactgatacatgggtgacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaggacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaggcccctacaaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctccgcgggatgtcctatgtgatgtgtaccgggagcttcaagctggagaaagaagtcgccgagacgcagcacggtacagtgcttgttcagataaagtacgagggcaccgacgctccttgcaagatcccattctcgactcaagatgaaaaaggggtgacacagaacggaagattgattaccgcgaatcccatcgtaactgacaaggagaaacctgtcaacatagaagcagagccaccctttggcgagtcttatattgtgatcggtgccggggaaaaggctctgaaactctcctggttcaagaagggctcaagtatcggaaaaatgtttgaggccaccgcaaggggcgcccggcgaatggctattctgggggatacagcctgggacttcggaagcatcggtggcgtttttacgtccgtggggaaacttgtccatcagattttcggaaccgcatacggcgtgctgttttctggtgtaagctggactatgaaaatagggatcggcgtgttgctcacatggctgggattaaattcacgcagtacctccctgagcatgacatgtattgcggttggcctagtcactctctacctgggggtgatggtgcaggctgattctggatgcgtcatcaactggaagggcagagaacttaaatgtggttcagggatcttcgttaccaatgaggtgcacacgtggacagaacaatataagtttcaggccgacagtccgaagaggttgagcgcagccattggaaaggcttgggaggagggcgtgtgcggtatacggtccgccacccgcctggaaaacatcatgtggaagcagatttctaacgagctcaatcatatcctgttagaaaacgacatgaaattcactgtagtcgtgggcgatgttgcagggattctggctcagggaaagaaaatgatcagacctcaacccatggagcacaagtactcgtggaaaagctggggcaaggccaagataatcggggcggacgtgcagaataccacatttattatcgatggaccaaacactcctgaatgtcccgacgatcagagggcctggaatatttgggaggtcgaggactatggcttcggtatctttaccacaaacatatggcttaaattgcgtgattcctacacacaggtgtgcgaccaccggctcatgtcagctgcaattaaggatagtaaagccgttcatgctgacatggggtattggatcgaatctgagaagaatgaaacctggaaactggcccgagcatccttcattgaggtgaagacttgtatctggccaaagtcccacacactatggtcaaacggagtactggaaagcgagatgataatccccaaaatttacggcggtcctatctctcaacataattatagaccaggctacttcacccagactgcggggccgtggcacctcggaaagctggagcttgattttgacttgtgcgaaggcacaaccgtcgtggtggatgagcactgcgggaacaggggaccctccctgcgcacgactaccgtcacaggcaaaattatccatgaatggtgttgccggagttgtaccttacctccactcagattcaggggtgaggacgggtgctggtacggaatggagatacgccccgttaaggaaaaagaggaaaatctggtaaagagcatggtatctgccggctccggtgaggtggactcatttagtcttggcctgttgtgtattagcatcatgatcgaagaggtcatgcgatcgcggtggtcccgtaagatgctcatgactgggacactggctgtgttctttctactgattatgggacagctcacctggaacgatctgatcagactttgcattatggttggcgccaatgcatctgacaggatggggatgggaacaacttatttggctctgatggccaccttcaaaatgcgccctatgtttgcagtgggcttactcttccggagactgacgagcagggaggtccttctgctaacaataggtctctcactggtggccagtgttgaattgccaaactccctggaggaattaggggatggactcgctatgggcatcatgattctgaaacttctgaccgactttcaatctcaccagttgtgggcgactctcctgagcctaaccttcatcaaaacaactttttccctgcattacgcctggaagaccatggcaatggtgctttcaattgtcagcctcttccccctgtgtttgagtacgacatctcagaaaaccacttggctgccggtattactcggctccctggggtgcaagcctcttacaatgtttctgatcgctgagaataagatatggggacgacgcagctggccattgaacgaaggtatcatggccgtgggcattgtttcgatcctcctgtcatctctactgaaaaacgatgtgccccttgccgggcctctcattgctggaggcatgctgatcgcatgttatgtcataagtggttccagcgccgacttgtctttagagaaggcggctgaggtgagctgggaagaggaagccgagcactccggggcatcacataatattctggtagaagtgcaggatgacggaaccatgaaaatcaaggatgaggagcgggacgatactctcacaatcctgcttaaagccaccctgttggctgtcagtggcgtttaccccctaagcattccagcaacgctgttcgtgtggtatttctggcaaaagaaaaagcagagatctggcgtgctctgggacactccttcacccccagaagtcgagagggccgtgctggatgacgggatataccgtatcatgcagcgcggacttttaggtcggagccaggttggcgtaggggtgtttcaagaaaacgtcttccacaccatgtggcacgtgacaagaggagcggttctgatgtatcagggcaagaggctcgagccgagttgggctagcgtgaaaaaggacttgatttcctacggtgggggatggcgactgcagggctcttggaataccggcgaggaagtccaggtgatcgccgtagagcctgggaaaaaccccaagaatgtccaaacagcaccaggaacttttaaaacccccgaaggtgaggtgggcgccattgctctcgatttcaagcctgggacgtcgggaagcccaatcgttaaccgggaaggcaagatagtgggtctgtacgggaatggagtcgtgacaacttcaggcacctatgtttccgccatcgcacaggctaaagccagtcaggagggcccccttcctgagattgaagacgaggtgtttcgcaagagaaacctgacaatcatggatttgcatccggggtctggaaaaaccaggcggtacctaccagcgattgtccgagaagccatcaagagaaaactgcgcactctcatattagcacccaccagggtggtagctagcgagatggccgaagctctgaagggtatgcctattcgttatcaaacaacggcagtgaagtccgagcacactggcaaagagatcgttgaccttatgtgccatgccaccttcacaatgcggctgctctcaccagtcagagtgcccaattacaacatgatcattatggatgaagcccactttaccgacccttctagcatcgctgcgagggggtatataagtactcgcgtgggaatgggcgaggcagccgctattttcatgacagccaccccgcccggttccgtcgaagcatttccacagagcaatgccgtaatccaggatgaggaacgagacattcctgagagatcttggaactcagggtacgagtggatcacggatttccccggaaagactgtgtggtttgttccatccataaaaagtggcaatgacattgctaactgtttgcggaagaatggcaaaagggtgatccagctgagccgcaagacattcgataccgaatatcaaaagaccaaaaacaacgactgggactacgtcgtgactacagatatctcggagatgggggcgaatttccgtgccgacagagttattgatcctcggaggtgcctcaagcccgtgatcctgaaagacggaccagaacgcgtcattcttgcaggtccgatgcctgtgaccgtagcttctgccgcacagcgaagaggccggatagggaggaaccataataaggagggagatcagtacatctatatgggccagcccctaaacaatgacgaggatcacgcccactggacagaagctaaaatgctgttggacaacattaatactccagagggtatcatccccgccttatttgaacctgagcgcgaaaagtccgcggcaattgatggggagtacagactgaggggcgaggcccggaagacgttcgtggaactcatgcgtcgcggagacctgccagtttggcttagctataaagtcgcttcagagggctttcaatacagtgatcgaagatggtgcttcgacggggaaaggaacaatcaggtgctggaggaaaacatggatgtggagatatggaccaaggagggagaacggaaaaagctccgccccagatggttggacgccaggacatattctgaccctctggctctacgggagtttaaagagttcgcagccggtcgaagatccgtcagcggcgatctgatcctcgagattgggaaacttccgcagcatctgactcagcgcgctcaaaatgccttagacaacttggttatgctgcacaattcagaacagggaggcagggcataccggcatgcgatggaggagctcccagataccatcgaaacactgatgcttctggccctcattgctgtgttgaccggtggggtaactctgtttttcttaagtggccgtggactaggcaaaacgagcatcgggctgctctgtgtgatggcctcctctgtccttctgtggatggcaagcgtggagccccactggatagctgcctccatcattttggaatttttcctgatggttctcctgatccctgagcccgacagacagaggaccccacaggataaccaacttgcatatgtggtcattggactcctgtttatgatcttgacagtagccgctaatgagatgggtctgttagaaactaccaagaaggacctaggcatagggcacgtggcggttgagaaccatcaccatgccgcaatgctggatgtggacctccaccctgcttcagcctggacactttacgccgtcgcaaccactattatcacacccatgatgcgccatacgattgaaaacaccactgctaatatctctctgacagccatagcgaaccaggctgccatcttgatgggactggataaaggctggccaattagtaagatggacatcggtgtgcctctcctggcacttgggtgctactcgcaggtcaatccgttaaccctgaccgccgctgtgctcatgttggttgcacactatgccattatcggccccggactgcaagcgaaagctacacgggaggcccagaagcgaactgcagccggcataatgaaaaacccaacggtggatgggattgtagctatcgacctagatcctgtggtctacgacgccaagttcgaaaagcagctgggacagatcatgctccttattctgtgtaccagccaaatcttgctgatgagaacaacttgggcactctgcgagtccataaccctggctacaggccccttaaccactctttgggagggttctccagggaaattttggaatacgacaattgccgtttcaatggcgaacatcttcaggggaagctatctggccggcgcaggtctcgctttctccctaatgaagagtctgggcgggggacgccggggcaccggggcccagggagaaactttgggcgagaaatggaagagacagctgaatcagctctctaaaagcgaatttaacacctacaagcgttcaggtattatggaggtggacaggtccgaagcaaaggaggggcttaaacggggagagacaactaagcacgctgtcagtcgcggcaccgccaaactgcgatggttcgtggaaagaaatttggtaaagcctgagggtaaagtgatcgatctgggctgtgggaggggaggctggagctattactgcgccgggctcaagaaggttacagaagtgaaaggatatacgaagggcggtcccgggcatgaggaaccgataccaatggcgacctacggatggaacttagtcaaactgcactctggcaaggacgtgtttttcatccctcccgagaaatgtgatactcttctgtgcgacattggcgagtcctcaccaaatcccacaatcgaagaggggcggaccctacgcgtcctcaagatggtggaaccttggctgagaggaaaccaattttgtattaaaatcttgaatccgtacatgcccagcgttgtagagactctggagcagatgcagaggaagcatggtggcatgctcgtgcgaaacccactttcgagaaattctacacacgaaatgtattgggtcagttgcgggaccggaaacattgtgtccgctgttaatatgacgagccgtatgctgttaaacagattcaccatggcacaccgcaagcctacatacgagagggatgtggacctgggcgccggtactcggcatgtcgctgtggaacccgaggtagccaacttggatatcatagggcagagaattgaaaatatcaaacacgagcataagtcaacctggcactatgacgaggataacccttacaaaacatgggcatatcatggatcctacgaagtgaagccatctggcagcgccagttccatggttaatggcgtcgtgaaactcctgactaagccctgggacgtgatccctatggtcacccaaattgctatgacagataccactccatttgggcagcagcgcgttttcaaggagaaagtggacacgaggacacccaaggcgaaacgaggaaccgcccaaataatggaagtaactgcaaagtggctatggggttttcttagccggaacaaaaagccgagaatctgtaccagggaggagttcacacgcaaggtgcgttctaatgctgccattggcgcagtctttgtggacgagaaccagtggaactcagccaaagaggctgttgaagatgagcggttctgggacctggtgcacagagaaagggagctccacaagcaggggaaatgcgccacgtgcgtctataacatgatgggaaagcgcgagaagaagctgggcgagtttggtaaggcgaaagggagtcgagcaatctggtacatgtggttgggagcccggttcctggagttcgaagctctcggctttatgaatgaggatcattggttctccagagaaaacagcctttctggcgtggagggggagggactgcacaagttaggttacattctgagggacatctcgaaaatacctggcgggaatatgtatgccgatgacaccgcaggatgggatactcgcatcacagaagacgatttgcagaacgaggctagaattaccgacatcatggaaccagagcatgccctcctggctaagtcaatttttaaactaacttaccaaaataaggtagttcgggtgcagaggcccgccaaaaacggcacagtcatggatgtgatcagccgtcgagaccagcgcggttccggacaggtgggaacctatggccttaatacattcactaacatggaagcacaactgataagacagatggagagtgagggcatattttctcctagcgaactcgagaccccaaacctggcggaacgggtcttggattggttagagaagtacggggttgaaaggctgaagcgcatggccatctccggagacgactgtgtggtaaaacccatcgatgacagattcgctacggccctcaccgcacttaatgatatgggtaaggtgcggaaagacattccgcagtgggagccttcaaagggctggaacgattggcagcaagtccccttttgcagtcaccacttccatcagctgataatgaaagacgggagggagatcgtggttccatgtcgaaatcaggatgagctagtgggacgtgctagagtctctcagggcgccggttggagcctgcgcgagacagcatgcctcgggaagtcctatgcccaaatgtggcagttgatgtactttcaccggagggacctgagacttgcggctaacgccatttgttcagcagtgcctgtagattggatccccactagccgcaccacatggtctattcatgcccaccatcagtggatgactaccgaagacatgctgtccgtttggaatcgggtgtggatcgaggaaaacccatggatggaggataagacgcacataagtagctggggagacgtcccctatctcggcaaaagggaggaccaatggtgcggctcgttaatcgggctgacagctcgagccacctgggcaactaatattcaggtggctatcaaccaggttagacggttgattggaaatgaaaactacctggattacatgacatccatgaagaggttcaaaaatgagtctgaccctgaaggtgccctctggtga

SEQ ID NO: 13600 - RNA, 9879 nt, synthetic construct
  misc_feature 1..9879: note = derived and/or modified CDS sequence (opt3) from DENV-1__FJ024447__SS-prME
  source 1..9879: mol_type = other RNA
agcgtgaccatgctgctcatgcttatgcccacagccctggctttccacttgactacgagaggaggggagcctcatatgatcgtctccaagcaggaaagaggaaaatctttactgtttaagacctcagccggtgttaatatgtgcacacttattgccatggacctcggcgagctgtgtgaagatactatgacctacaaatgcccacggattacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactgctcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccggatcgttcaaactggagaaggaagtcgccgagacgcagcacggtacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattgtgatcggtgccggggaaaaagctctgaagctctcctggttcaagaaaggctcaagtatcggaaagatgtttgaggccaccgcaagaggcgccaggcggatggctattctgggggatacagcctgggacttcggaagcatcggtggcgtttttacgtccgtggggaaagtcgtgcatcagattttcggaaccgcatacggcgtactattttctggtgtgagctggactatgaagatagggatcggcgttctgttgacatggctcggactaaattcacgaagtacctccttaagcatgacatgtattgcggtcggcctggtgactctatacctcggggtgatggtccaggctgattctggatgcgttatcaactggaaaggccgcgaactgaagtgtggttcagggatcttcgtgaccaatgaggtgcacacgtggacagaacaatataagtttcaggccgacagtccgaaaagacttagcgcagccattggaaaggcttgggaggagggcgtatgcggtataaggtccgccacccggttggaaaacatcatgtggaaacagatttctaacgagctgaatcatatcctcctggaaaacgacatgaagttcactgtcgtggttggcgatgtggcagggattttagctcagggcaagaagatgatccgccctcaacccatggagtacaaatattcgtggaaaagctggggcaaggccaagataatcggggcggacgtccagaataccacatttattatcgatggaccaaacactcctgaatgtcccgacgatcagagagcctggaatatttgggaggtggaggactacggcttcggtatctttaccacaaacatatggctgaaacttagggattcctatacgcaggtttgcgaccaccgtttgatgtcagctgcaattaaagatagtaaggccgtgcacgctgacatggggtactggatcgaatctgagaaaaatgaaacctggaagctcgcccgggcatccttcattgaggtaaagacttgtatctggccaaaatcccatacactgtggtcaaacggagtcctagaaagcgagatgataatccccaagatttatggcggtcctatctctcaacacaattaccgaccaggctacttcacccagactgcggggccgtggcatctgggaaaactcgagctggattttgacctttgcgaaggcacaaccgtggtggtcgatgagcactgcgggaacagaggaccctccttgaggacgactaccgttacaggcaagattatccacgaatggtgttgccgcagttgtaccctgcctccattacggttcagaggtgaggacgggtgctggtatggaatggagataaggcccgtgaaagaaaaggaggaaaatctcgtaaagagcatggtgtctgccggctccggtgaggtcgactcatttagtctgggccttctgtgtattagcatcatgatcgaagaggtgatgcgctcgcgatggtcccggaaaatgttgatgactgggacactcgctgttttctttctgctaattatgggacagctgacctggaacgatctcatccgtctgtgcattatggtgggcgccaatgcatctgacagaatggggatgggaacaacttaccttgctttgatggccaccttcaagatgaggcctatgtttgcagtcggcctgttattccgccggctcacgagcagagaggtgctgcttctgacaataggtctatcactcgttgccagtgtggaactgccaaactccttggaggaactgggggatggattagctatgggcatcatgattctcaaactgcttaccgactttcaatctcatcagctgtgggcgactttgctcagcctgaccttcatcaagacaactttttccctacactatgcctggaaaaccatggcaatggtcctgtcaattgtaagccttttccccctctgtctgagtacgacatctcagaagaccacttggttgccggtgctgttaggctccctcgggtgcaagcctctgacaatgtttcttatcgctgagaataaaatatggggaaggcgaagctggccactgaacgaaggtatcatggccgttggcattgtgtcgatcttgctctcatctctgctaaagaacgatgtccccctggccgggcctcttattgctggaggcatgctcatcgcatgttacgtgataagtggttccagcgccgacctgtctttggagaaagcggctgaggtaagctgggaagaggaagccgagcattccggggcatcacacaatattttagtggaagtccaggatgacggaaccatgaagatcaaagatgaggagcgcgacgatactctgacaatcctcctgaaggccacccttctggctgttagtggcgtgtatcccttgagcattccagcaacgctattcgtgtggtacttctggcagaagaagaagcagcggtctggcgtcctgtgggacactccttcacccccagaagtggggagagccgttctcgatgacggaatatataggatcatgcagcgtggtctgcttggccgcagccaggtaggggtgggagtctttcaagagaacgtgttccataccatgtggcacgttacacggggcgcggtgttaatgtaccagggtaaaagactggaaccgagttgggctagcgtcaagaaagacctcatttcctacgggggaggctggaggttgcagggctcttggaataccggggaggaggtgcaggtaatcgccgtcgaacctggaaagaaccccaaaaatgtgcaaacagcaccaggtacttttaagacccccgagggcgaagttggggccattgctctggatttcaagcctggaacgtcgggcagcccaatcgtgaaccgagagggtaaaatagtcgggctctatggaaatggcgtggttacaacttcaggcacctacgtgtccgccatcgcacaggctaaggccagtcaggaagggcccctgcctgagattgaggacgaagtctttcggaaacgcaaccttacaatcatggatctgcacccgggatctggtaagaccagaaggtatttgccagcgattgtgcgggaggccatcaaacgaaagctaagaactctgatactcgcacccacccgcgtagtggctagcgaaatggccgaggctttaaagggcatgcctattaggtaccaaacaacggcagttaaatccgaacatactgggaaggagatcgtcgacctgatgtgccacgccaccttcacaatgcgtcttctgtcaccagtgcgggtgcccaattataacatgatcattatggatgaggcccattttaccgacccttctagcatcgctgcgagaggatacataagtactagggtcggcatgggtgaagcagccgctattttcatgacagccaccccgcccgggtccgtagaggcatttccacagagcaatgccgtgatccaggatgaggaacgcgacattcctgaacgatcttggaactcaggatatgagtggatcacggatttccccggcaaaactgtttggtttgtgccatccataaagagtggcaatgacattgctaactgtctcaggaaaaatgggaagcgggtcatccagttgagcaggaagacattcgataccgagtaccagaaaaccaagaacaacgactgggactacgtggttactacagatatctcggaaatgggagcgaatttccgcgccgaccgtgtgattgatcctagacggtgcctgaaacccgtcatcctcaaggacggtccagagagggtgattctggcaggcccgatgcctgtaaccgtggcttctgccgcacagcgccgagggagaataggacggaaccacaataaagaaggcgatcagtatatctacatgggtcagccccttaacaatgacgaggatcatgcccactggacagaggctaagatgctactggacaacattaatactccagaagggatcatccccgccttgtttgagcctgaaagggagaagtccgcggcaattgatggcgaatatcgcttaagaggagaggccaggaaaacgttcgttgagctgatgcggcgtggcgacctcccagtctggctgagctacaaggtggcttcagaagggtttcaatatagtgatcgccgatggtgcttcgacggagagagaaacaatcaggtgcttgaagagaacatggatgtcgaaatatggaccaaagagggtgagaggaagaaactgcggccccgctggctcgacgccagaacatactctgaccctttggctctgagggaatttaaggagttcgcagccggccggcgatccgttagcggggatctaatcctggaaattggaaaactcccgcagcaccttactcagagagctcaaaatgccctggacaacttagtgatgttgcataattcagagcagggcggtcgcgcatataggcacgcgatggaggaactgccagataccatcgagacactcatgctgcttgccctgattgctgtactcaccgggggcgtgactttgtttttcctgagtggacggggcttagggaagacgagcatcggactactgtgtgtcatggcctcctctgtgctcctttggatggcaagcgttgaaccccattggatagctgcctccatcattctggagtttttcttgatggtgctgctcatccctgaacccgaccgtcagagaaccccacaggataaccaactggcatacgtcgtaattggtcttctctttatgatcctgacagtggccgctaatgagatgggcttgctggagactaccaagaaagacttagggataggacacgttgcggtggaaaaccaccatcacgccgcaatgctagatgtcgacctgcatcctgcttcagcctggacactctacgccgtggcaaccactattatcacacccatgatgaggcacacgattgagaacaccactgctaatatctctcttacagccatagcgaaccaggctgccatcctgatgggcttggataagggttggccaattagtaaaatggacatcggggtccctctgctcgcactgggctgctatagccaggtgaatccgcttaccttaaccgccgctgttctgatgctcgtggcacattacgccattatcggacccggcttgcaagcgaaggctacacgcgaagcccagaaacggactgcagccgggataatgaagaacccaacggtagatggaattgtggctatcgacctggatcctgtcgtttatgacgccaagttcgagaaacagctaggccagatcatgctgctcattctttgtaccagccaaatcctgttgatgcgaacaacttgggcactgtgcgaatccataaccctcgctacaggtcccctgaccactttatgggaggggtctccaggaaagttttggaatacgacaattgccgtgtcaatggcgaacatcttcagaggcagctaccttgccggtgcaggcctggctttctccctcatgaaaagtctagggggaggcaggcgcgggaccggagcccagggcgagactctgggtgaaaagtggaaacggcagttgaatcagctgtctaagagcgagtttaacacctataagagatcagggattatggaagtcgaccgttccgaggcaaaagaaggactcaagaggggcgagacaactaaacacgctgtgagtcggggtaccgccaaacttcgctggttcgtagagcgaaatctggtgaaacctgaaggcaaggttatcgatttggggtgtggaagaggcgggtggagctactattgcgccggactgaagaaagtgacagaggtcaagggctacacgaaaggtgggcccggacacgaggagccgataccaatggcgacctacggctggaacctcgtgaagttacattctggcaaagacgtctttttcatccctcccgaaaagtgtgatactctgctttgcgacattggggagtcctcaccaaatcccacaatcgaggaaggaaggaccctgcgggtgctaaaaatggttgagccttggctccgcggtaaccaattttgtattaagatcctgaatccgtatatgcccagcgtagtggaaactttggagcagatgcagagaaagcacggcgggatgctggtcaggaacccactctcgcgaaattctacacatgagatgtactgggtgagttgcggaaccggcaacattgtttccgctgtgaatatgacgagccggatgcttctgaaccgtttcaccatggcacacagaaaacctacatatgaacgcgatgtcgacttaggtgccgggactaggcacgtggctgtagagcccgaagtggccaacctggatatcataggacagcggattgagaatatcaagcatgaacacaaatcaacctggcattacgacgaggataacccttataagacatgggcataccacggctcctatgaggttaaaccatctggcagcgccagttccatggtcaatggggtggtgaagttgctcactaagccctgggacgtcatccctatggttacccaaattgctatgacagataccactccatttggacagcagagagtgttcaaagaaaaggtagacacgcgcacacccaaagcgaagaggggtaccgcccaaataatggaggtgactgcaaaatggctgtggggctttctaagccgaaacaagaagccgcggatctgtaccagagaagagttcacaaggaaagtccgctctaatgctgccattggggcagtgtttgttgacgaaaaccagtggaactcagccaaggaggctgtggaggatgaacgtttctgggaccttgtccatcgggagagagaactgcacaaacagggaaagtgcgccacgtgcgtgtacaacatgatgggcaaaagggagaagaagctcggtgaatttgggaaagcgaagggaagtcgcgcaatctggtacatgtggctgggcgcccgattcttggagttcgaggctctgggctttatgaatgaagatcactggttctcccgggagaacagcctctctggggtagaaggagagggtcttcataaactgggctatattttaagagacatctcgaatatacctgggggaaacatgtacgccgatgacaccgcaggctgggatactaggatcacagaggacgatctgcagaatgaagctcgcattaccgacatcatggagccagaacacgccttgctcgctaagtcaatttttaaactgacttatcaaaacaaggttgtgagagtccagcggcccgccaaaaatggtacagtgatggatgtgatcagcaggcgtgaccagcgagggtccggacaggtcggcacctacggcctaaacacattcactaacatggaggcacaacttatacgccagatggaaagtgaggggatattttctcctagcgagctggaaaccccaaatctcgcggagagagttctggattggttggaaaagtatggagtggagcggttaaagaggatggccatctccggtgacgactgtgtagtgaaacccatcgatgaccgcttcgctacggccctgaccgcactcaacgatatgggcaaggtcagaaaagacattccgcagtgggaaccttcaaaggggtggaatgattggcagcaagtgcccttttgcagtcatcacttccaccagcttataatgaaagacggacgggagatcgttgtgccatgtaggaaccaggatgagctggtcggccgagctcgtgtgtctcagggtgccgggtggagcctaagagaaacagcatgcctgggaaagtcctacgcccaaatgtggcagctcatgtattttcatcgccgggacttgaggctggcggctaatgccatttgttcagcagtacctgttgattggatccccactagcagaaccacatggtctattcacgcccatcaccagtggatgactaccgaggacatgctttccgtgtggaaccgcgtctggatcgaagagaatccatggatggaagataagacgcatataagtagctggggcgacgtgccctacctgggcaaacgggaggaccaatggtgcgggtcgctcatcggattaacagctagggccacctgggcaactaacattcaggttgctatcaatcaggtgcgaagactgattggtaacgagaattacttggattatatgacatccatgaagcggttcaaaaacgaatctgaccctgagggcgccctgtggtga

SEQ ID NO: 13601 - RNA, 9879 nt, synthetic construct
  misc_feature 1..9879: note = derived and/or modified CDS sequence (opt3) from DENV-1__FJ182025__SS-prME
  source 1..9879: mol_type = other RNA
agcgtgaccatgctgctcatgcttatgcccacggccctggctttccacttgactacgagaggaggggagcctcatatgatcgtctccaagcaggaaagaggaaaatctttactgtttaagacctcagccggtgttaatatgtgcacactgattgccatggacctcggcgagctgtgtgaagatactatgacctacaaatgcccacggataacagagaccgaaccggacgatgtggactgttggtgcaatgcgactgatacatgggtgacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctacaaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccggtagcttcaaactggagaaggaagtcgccgagacgcagcacggaacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattgtgatcggtgccggggaaaaagctctgaagctctcctggttcaagaaaggctcaagtatcggaaagatgtttgaggccaccgcaagaggcgccaggcggatggctattctgggggatacagcctgggacttcggaagcatcggtggcgtttttacgtccgtggggaaacttgtccatcagattttcggaaccgcatacggcgtgctgttttctggtgtaagctggactatgaagatagggatcggcgtgttgctcacatggctgggattaaattcacgaagtacctccctgagcatgacatgtattgcggttggcctagtcactctctacctgggggtgatggtgcaggctgattctggatgcgtcatcaactggaaaggccgcgaacttaagtgtggttcagggatcttcgttaccaatgaggtgcacacgtggacagaacaatataagtttcaggccgacagtccgaaaagattgagcgcagccattggaaaggcttgggaggagggcgtgtgcggtataaggtccgccacccggctggaaaacatcatgtggaaacagatttctaacgagctcaatcatatcctgttagaaaacgacatgaagttcactgtagtcgtgggcgatgttgcagggattctggctcagggcaaaaagatgatccgccctcaacccatggagtacaaatattcgtggaaaagctggggcaaggccaagataatcggggcggacgtgcagaataccacatttattatcgatggaccaaacactcctgaatgtcccgacgatcagagagcctggaatatttgggaggtcgaggactacggcttcggtatctttaccacaaacatatggcttaagttgagggattcctatacacaggtgtgcgaccaccgtctcatgtcagctgcaattaaagatagtaaggccgttcacgctgacatggggtactggatcgaatctgagaaaaatgaaacctggaagctggcccgggcatccttcattgaggtgaagacttgtatctggccaaaatcccatacactatggtcaaacggagtactggaaagcgagatgataatccccaagatttatggcggtcctatctctcaacacaattaccgaccaggctacttcacccagactgcggggccgtggcatctcggaaaactggagcttgattttgacttgtgcgaaggcacaaccgtcgtggtggatgagcactgcgggaacagaggaccctccctgaggacgactaccgtcacaggcaagattatccacgaatggtgttgccgcagttgtaccttacctccactccggttcagaggtgaggacgggtgctggtatggaatggagataaggcccgttaaagaaaaggaggaaaatctggtaaagagcatggtatctgccggctccggtgaggtggactcatttagtcttggcctgttgtgtattagcatcatgatcgaagaggtcatgcgctcgcgatggtcccggaaaatgctcatgactgggacactggctgtgttctttctactgattatgggacagctcacctggaacgatctgatccgtctttgcattatggttggcgccaatgcatctgacagaatggggatgggaacaacttacttggctctgatggccaccttcaagatgaggcctatgtttgcagtgggcttactcttccgccggctgacgagcagagaggtccttctgctaacaataggtctctcactggtggccagtgttgaattgccaaactccctggaggaattaggggatggactcgctatgggcatcatgattctgaaacttctgaccgactttcaatctcatcagttgtgggcgactctcctgagcctaaccttcatcaagacaactttttccctgcactatgcctggaaaaccatggcaatggtgctttcaattgtcagcctcttccccctgtgtttgagtacgacatctcagaagaccacttggctgccggtattactcggctccctggggtgcaagcctcttacaatgtttctgatcgctgagaataaaatatggggaaggcgaagctggccattgaacgaaggtatcatggccgtgggcattgtttcgatcctcctgtcatctctactgaagaacgatgtgccccttgccgggcctctcattgctggaggcatgctgatcgcatgttacgtcataagtggttccagcgccgacttgtctttagagaaagcggctgaggtgagctgggaagaggaagccgagcattccggggcatcacacaatattctggtagaagtgcaggatgacggaaccatgaagatcaaagatgaggagcgcgacgatactctcacaatcctgcttaaggccaccctgttggctgtcagtggcgtttatcccctaagcattccagcaacgctgttcgtgtggtacttctggcagaaaaagaagcagcggtctggcgtgctctgggacactccttcacccccagaagtcgggagagccgtgctggatgacggaatatataggatcatgcagcgtggtcttttaggccgcagccaggttggggtaggagtgtttcaagagaacgtcttccataccatgtggcacgtgacacggggcgcggttctgatgtaccagggtaaaagactcgaaccgagttgggctagcgtgaagaaagacttgatttcctacgggggaggctggaggctgcagggctcttggaataccggggaggaggtccaggtgatcgccgtagaacctggaaagaaccccaaaaatgtccaaacagcaccaggtacttttaagacccccgagggcgaagtgggggccattgctctcgatttcaagcctggaacgtcgggcagcccaatcgttaaccgagagggtaaaatagtggggctgtatggaaatggcgtcgtgacaacttcaggcacctacgtttccgccatcgcacaggctaaggccagtcaggaagggccccttcctgagattgaggacgaagtgtttcggaaacgcaacctgacaatcatggatttgcacccgggatctggtaagaccagaaggtatctaccagcgattgtccgggaggccatcaaacgaaagctgagaactctcatattagcacccacccgcgtggtagctagcgaaatggccgaggctctgaagggcatgcctattaggtaccaaacaacggcagtgaaatccgaacatactgggaaggagatcgttgaccttatgtgccacgccaccttcacaatgcgtctgctctcaccagtccgggtgcccaattataacatgatcattatggatgaggcccattttaccgacccttctagcatcgctgcgagaggatacataagtactagggtgggcatgggtgaagcagccgctattttcatgacagccaccccgcccgggtccgtcgaggcatttccacagagcaatgccgtaatccaggatgaggaacgcgacattcctgaacgatcttggaactcaggatatgagtggatcacggatttccccggcaaaactgtgtggtttgttccatccataaagagtggcaatgacattgctaactgtttgaggaaaaatgggaagcgggtgatccagctgagcaggaagacattcgataccgagtaccagaaaaccaagaacaacgactgggactacgtcgtgactacagatatctcggaaatgggagcgaatttccgcgccgaccgtgttattgatcctagacggtgcctcaaacccgtgatcctgaaggacggtccagagagggtcattcttgcaggcccgatgcctgtgaccgtagcttctgccgcacagcgccgagggagaataggacggaaccacaataaagaaggcgatcagtatatctacatgggtcagcccctaaacaatgacgaggatcatgcccactggacagaggctaagatgctgttggacaacattaatactccagaagggatcatccccgccttatttgagcctgaaagggagaagtccgcggcaattgatggcgaatatcgcctgagaggagaggccaggaaaacgttcgtggagctcatgcggcgtggcgacctgccagtttggcttagctacaaggtcgcttcagaagggtttcaatatagtgatcgccgatggtgcttcgacggagagagaaacaatcaggtgctggaagagaacatggatgtggaaatatggaccaaagagggtgagaggaagaaactccggccccgctggttggacgccagaacatactctgaccctctggctctaagggaatttaaggagttcgcagccggccggcgatccgtcagcggggatctgatcctcgaaattggaaaacttccgcagcacctgactcagagagctcaaaatgccttagacaacttggttatgctgcataattcagagcagggcggtcgcgcatataggcacgcgatggaggaactcccagataccatcgagacactgatgcttctggccctcattgctgtgttgaccgggggcgtaactctgtttttcttaagtggacggggcctagggaagacgagcatcggactgctctgtgtgatagcctcctctgtccttctgtggatggcaagcgtggaaccccattggatcgctgcctccattatcttggagtttttcctgatggttctcctgattcctgaacccgaccgtcagagaaccccacaggataaccaacttgcatacgtggtcatcggtctcctgtttatgatattgacagtagccgctaatgagatgggcctgttagagactaccaagaaagacctagggattggacacgtggcggttgaaaaccaccatcacgccgcaatgctggatgtggacctccatcctgcttcagcctggacactttacgccgtcgcaaccactatcattacacccatgatgaggcacacgatcgagaacaccactgctaatatatctctgacagccatcgcgaaccaggctgccattttgatgggcctggataagggttggccaatcagtaaaatggacattggggtgcctctcctggcacttggctgctattcgcaggtcaatccgttaaccctgaccgccgctgtgctcatgttggttgcacattacgccatcataggacccggcctgcaagcgaaggctacacgcgaagcccagaaacggactgcagccgggattatgaagaacccaacggtggatggaatcgtagctatcgacctagatcctgtggtctatgacgccaagttcgagaaacagctgggccagattatgctccttatcctgtgtaccagccaaatattgctgatgcgaacaacttgggcactctgcgaatccattaccctggctacaggtcccttaaccactctttgggaggggtctccaggaaagttttggaatacgacaatcgccgtttcaatggcgaacattttcagaggcagctacctggccggtgcaggcctcgctttctccctaatgaaaagtctagggggaggcaggcgcgggaccggagcccagggcgagactttgggtgaaaagtggaaacggcagctgaatcagctctctaagagcgagtttaacacctataagagatcagggatcatggaagtggaccgttccgaggcaaaagaaggacttaagaggggcgagacaactaaacacgctgtcagtcggggtaccgccaagctgcgctggttcgtggagcgaaatttggtaaaacctgaaggcaaggtgatagatctggggtgtggaagaggcgggtggagctactattgcgccggactcaagaaagttacagaggtgaagggctacacgaaaggtgggcccggacacgaggagccgatcccaatggcgacctacggctggaacttagtcaagctgcattctggcaaagacgtgtttttcattcctcccgaaaagtgtgatactcttctgtgcgacatcggggagtcctcaccaaatcccacaattgaggaaggaaggaccctacgggtcctcaaaatggtggagccttggctgcgcggtaaccaattttgtatcaagattttgaatccgtatatgcccagcgttgtagaaactctggagcagatgcagagaaagcacggcgggatgctcgtgaggaacccactttcgcgaaattctacacatgagatgtactgggtcagttgcggaaccggcaacatcgtgtccgctgttaatatgacgagccggatgctgttaaaccgtttcaccatggcacacagaaaacctacatatgaacgcgatgtggacctgggtgccgggactaggcacgtcgctgtggagcccgaagtagccaacttggatataattggacagcggatcgagaatatcaagcatgaacacaaatcaacctggcattacgacgaggataacccttataagacatgggcataccacggctcctatgaggtgaaaccatctggcagcgccagttccatggttaatggggtcgtgaagctcctgactaagccctgggacgtgattcctatggtcacccaaatagctatgacagataccactccatttggacagcagagagttttcaaagaaaaggtggacacgcgcacacccaaagcgaagaggggtaccgcccaaatcatggaggtaactgcaaaatggctatggggctttcttagccgaaacaagaagccgcggatttgtaccagagaagagttcacaaggaaagtgcgctctaatgctgccatcggggcagtctttgtggacgaaaaccagtggaactcagccaaggaggctgttgaggatgaacgtttctgggacctggtgcatcgggagagagaactccacaaacagggaaagtgcgccacgtgcgtctacaacatgatgggcaaaagggagaagaagctgggtgaatttgggaaagcgaagggaagtcgcgcaatttggtacatgtggttgggcgcccgattcctggagttcgaggctctcggctttatgaatgaagatcactggttctcccgggagaacagcctttctggggtggaaggagagggtctgcataaattaggctatatcctgagagacatatcgaatatccctgggggaaacatgtacgccgatgacaccgcaggctgggatactaggattacagaggacgatttgcagaatgaagctcgcatcaccgacattatggagccagaacacgccctcctggctaagtcaatctttaaactaacttatcaaaacaaggtagttagagtgcagcggcccaccaaaaatggtaccgtcatggatgtgataagcaggcgtgaccagcgagggtccggacaggtgggcacatacggccttaacactttcaccaacatggaggcccaactgattcgccagatggaaagtgaggggatcttttctcctagcgagctcgaaacgccaaatctggcagagagagtcttggattggttagaaaagtatggagttgagcggctgaagaggatggcgatctccggtgacgactgtgtggtaaaacccgtggatgaccgcttcgccaccgctctcacagcccttaacgatatgggcaaggtcagaaaagacattccgcagtgggaaccttcaaaggggtggaatgattggcagcaagtgcccttttgcagtcatcacttccaccagctgataatgaaagacggacgggagatcgttgtgccatgtaggaaccaggatgagctagtcggccgagcacgtgtgtctcagggtgctgggtggagcctgagagaaactgcctgcctcggaaagtcctacgcacaaatgtggcagttgatgtattttcatcgccgggacctgaggcttgccgcgaatgctatttgttcagccgtacctgttgattggatccccaccagcagaacaacttggtctattcacgcacatcaccagtggatgaccacggaggacatgctgtccgtgtggaaccgcgtctggatcgaagagaatccatggatggaagataagacacatataagtagctggggcgacgtgccctacctcggcaaacgggaggaccaatggtgcgggtcgttaatcggactgaccgccagggctacttgggccacaaacattcaggttgcaatcaatcaggtgcgaagattgattggtaacgagaattacctggattatatgacctccatgaagcggttcaaaaacgaatctgaccctgagggcgctctctggtga

SEQ ID NO: 13602 - RNA, 9879 nt, synthetic construct
  misc_feature 1..9879: note = derived and/or modified CDS sequence (opt3) from DENV-1__FJ373297__SS-prME
  source 1..9879: mol_type = other RNA
agcgtgacaatgctgctcatgcttatgcccacagcactggctttccacttgactacgagaggaggggaacctcatatgatcgtctccaagcaggaaaggggaaaatctttactgtttaagacatcagccggtgttaacatgtgcacactgattgccatggacctcggcgaactgtgtgaagatactatgacctacaaatgcccacggataacagaagtggaaccggacgatgtagactgttggtgcaataccactgatacatgggtgacctatgggacgtgtagtcaaactggagagcaccgccgagacaagcgtagcgtcgcgcttgctccccatgtgggcctgggtttggagaccagagccgaaacatggatgtcctctgagggggcatggaaacagatccagaaggttgaaacttgggccctcaggcaccctggattcaccgtgattgctctgtttctggcacatgccatcggcacatcgattacccagaagggcatcatattcatcctcttaatgctggtcacgccatcaatggctatgcggtgcgtggggattggaagccgcgattttgtagagggtcttagtggcgccacttgggttgacgtggtcttggagcacgggtcctgtgtgacaaccatggcgaaagataagcccactctggacatcgaactactcaaaacagaggtgaccaaccctgcagtcctgagaaaactttgcattgaagccaaaatctctaatacgaccacagatagcagatgtccaactcaaggagaggctaccctggttgaagaacaggacgccaacttcgtgtgccggcgcacatttgtagatcgaggctggggtaatgggtgtggattgttcggcaagggctccctcataacttgcgcaaagtttaaatgcgtgaccaagctggaggggaaaattgtccagtacgaaaacttaaagtattcagtgatcgttacagtgcacaccggagaccagcatcaagtcggtaatgagagtactgaacacggcacgacagctaccattactccccaggcccctaccagcgagatccagctgacagactacggggcgctcacccttgattgttctccaagaactggactggacttcaacgaaatggtgttgctaacaatgaaagagaagtcctggctggtacataaacagtggtttctcgatctgccgcttccctggacgtcaggcgccagcaccagtcaagagacttggaataggcaggacctgttggttacattcaagaccgcacacgctaagaaacaggaagtggtcgtgctcggttctcaagagggggccatgcacacagctctgactggcgccaccgaaatccagacgtccggaaccacaactatttttgcaggccatttaaagtgccggctgaaaatggataagctaaccctcaaagggatgagctatgtcatgtgtacaggactgttcaaacttgagaaggaagtggccgagactcagcacggtaccgttttggtgcagataaaatacgagggcacggacgctccttgcaagatcccattctcgacacaagatgaaaaaggggtaacccagaacggacgtctgattactgcgaatcccatcgtcacagacaaggagaaacctgtgaacatagaagcagagccaccctttggcgagtcttatattgttatcggtgccggggaaaaggctctcaagctgtcctggttcaaaaagggctcaagtatcggaaaaatgtttgaggccaccgcacgcggcgccagaaggatggctattcttggggatactgcctgggacttcggaagcatcggtggcgtgtttacctccgtcgggaagctggtgcatcagattttcggaacagcatacggcgtattgttttctggtgtgagctggacgatgaaaatagggatcggcgttctcctgacctggttaggactaaattcacggagtacttccctaagcatgacatgtattgcggtcggcctcgtgaccctgtaccttggggtgatggtccaggctgattctggatgcgttatcaactggaagggccgagaattgaagtgtggttcagggatcttcgtgacaaatgaggtgcacacttggaccgaacaatataaatttcaggccgacagtccgaagcgcctgagcgcagccattggaaaggcttgggaggagggcgtatgcggtataagatccgccacgaggctcgaaaacatcatgtggcggcagatttctaacgagctgaatcatatcttactggaaaacgacatgaagttcacagtcgtggttggcgatgtggtcgggattcttgcacagggcaagaagatgatccgccctcaacccatggagcacaaatactcgtggaaaagctggggcaaggctaagataatcggggccgacgtgcagaataccacttttattatcgatggaccaaacacccctgaatgtcccgacgatcagagagcgtggaatatttgggaggttgaggactatggcttcggtatctttacaactaacatatggttgaagctcagggattcctacacccaggtgtgcgaccaccgtctgatgtcagccgctattaaagatagtaaggcagtacatgccgacatggggtattggatcgaatctgagaaaaatgaaacatggaagctagctcgggccagcttcattgaggtcaagacgtgtatctggccaaaatcccacaccctgtggtcaaacggagtgctcgaaagcgagatgataatccccaagatttacggcggtcctatctctcaacataattatcgaccaggctacttcactcagacagcagggccgtggcacctgggaaaacttgagttggattttgacctgtgcgaaggcaccactgtggtcgttgatgagcactgcgggaacagaggaccctccttaaggacaaccacggtgactggcaagattatccatgaatggtgttgccgcagttgtaccctccctccactgcggttcaaaggtgaggacgggtgctggtacggaatggagataagacccgtaaaggaaaaggaggaaaatcttgtgaaaagcatggtctctgcgggctccggtgaggtggactcatttagtctgggcttgctctgtattagcatcatgatcgaagaggttatgaggtcgcgctggtcccgaaagatgctgatgacagggaccctagccgtgttctttctgctcattatgggacagctgacttggaacgatcttatccggtcttgcattatggtcggcgctaatgccagcgaccgtatggggatgggaacaacctatttggcactgatggctacattcaaaatgagacctatgtttgccgtgggcttactcttcaggcgcctgacttcacgggaggttcttctgctaaccataggtctcagtctggtggcatccgtcgaattgccaaactctctggaggaattaggggatggactcgccatgggcatcatgattctgaaacttctgacggactttcaaagctaccagttgtgggctacactcctgtccctaaccttcatcaaaactaccttttcactgcactatgcgtggaagacaatggccatggtacttagcattgtgagtctcctgcccttgtgtctgtctactacctcccagaagacgacatggttaccggttctcctgggcagccttgggtgcaaacctctgaccatgttcttgatcgcagagaataagatatggggaagaaaatcgtggccactcaacgaaggtatcatggctgtgggcattgtctcaatcctgctatctagtctgcttaagaacgatgtgcccctcgccgggcctctgattgccggaggcatgttgatcgcttgttacgtaatatccggtagctctgcagacttaagcctggagaaagccgcggaggtgtcctgggaagaggaagctgagcattcaggggccagtcacaatattctcgtcgaagttcaggatgacggaactatgaagatcaaagatgaggagagggacgatacactgaccatccttctgaaggcaactttgctagccgtgagcggcgtgtatcccctgtctattccagctacactctttgtctggtacttctggcaaaagaaaaagcagcgatccggcgtgctgtgggacaccccttcacccccagaagttgagcgcgcagtacttgatgacgggatatatcggatcatgcagagaggattactgggtaggagtcaggtgggcgtcggggtgttccaagaaaacgtttttcatacgatgtggcacgtgactcgtggagccgtcctcatgtaccagggcaaacgcttggagccgagctgggcgtccgtgaagaaagacctgatttcttacggtgggggatggcggctccagggctcgtggaataccggcgaggaagtacaggtcatcgctgtggagcctgggaagaaccccaagaatgttcaaacagccccaggaaccttcaaaacacccgaaggtgaggtgggcgcaattgccctggattttaagcctgggactagcggatcaccaatcgtcaacagagaaggcaaaatagtgggtctttatgggaatggagttgtgaccacgtccggcacatacgtcagtgctatcgcccaggcaaaggcttctcaggagggccccctgcctgagattgaagacgaggtgttcaggaaacgaaacttgactatcatggatctacacccggggagcggaaagacccggcgctatctgccagccattgtaagagaagcgatcaagaggaaactccggacattaatactggcccccacccgagtggttgcatccgagatggctgaagcccttaagggtatgcctattagataccaaactaccgctgtcaaatcagagcatacaggccgcgagatcgtggacctgatgtgccacgcaacgtttactatgaggctcttgtctccagtgcgtgtccccaattataacatgatcattatggatgaagcccatttcaccgaccctagcagtatcgccgctcgggggtacatatccacaagagtaggaatgggcgaggcggcagccatttttatgaccgctactccgcccggtagcgtggaagccttcccacagtctaatgcagttatccaggatgaggaaagggacattcctgagcgctcatggaactccgggtatgagtggatcacagattttcccggaaagaccgtgtggttcgtcccaagtataaaaagcggcaatgacattgccaactgtctgcgaaagaatggcaagagagtgatccagctctcgcggaaaacgtttgatactgaataccaaaagaccaagaacaacgactgggactacgttgtgaccaccgatatctctgagatgggggctaatttcagggcggaccgcgtcattgatcctcgtagatgcctgaagcccgtgatccttaaagacggaccagaacgggtaattctagccggtccgatgcctgtgactgttgcatccgctgcccagaggcgcggccgaatagggagaaaccacaataaggagggagatcagtatatctacatgggccagcccctgaacaatgacgaggatcatgcacactggacagaagccaagatgttgttagacaacattaataccccagagggtatcatccccgctctgttcgaacctgagcgggaaaagagcgccgcgattgatggggagtataggctccgcggcgaggcaagaaagacatttgtcgagctgatgaggcggggagaccttccagtgtggctgtcatacaaagtggccagtgagggcttccaatattctgatcgtcgctggtgctttgacggggaacgaaacaatcaggtcctcgaggaaaacatggatgttgagatatggactaaggagggagaaaggaaaaagttgaggccccggtggctggacgctcgcacgtactccgaccctctagccctgagagagttcaaagaatttgctgcaggtaggcggagcgtgtcaggcgatctcatccttgagattgggaagctgccgcagcacttaacccagcgagcccaaaatgctttggacaacctggtaatgctccataatagtgaacagggaggcagagcctatcgccacgcaatggaggagctgccagatacaatcgaaactcttatgctgctcgcgttgattgccgtgctgaccggtggggtcacattattctttctaagcggcaggggactgggcaagacctccatcgggctcctttgtgtgatggcttctagcgccctgttgtggatggcatccgttgagccccattggatagctgcctcaatcattctggagttctttctcatggtgctgcttatccctgagcccgaccggcagcgtactccacaggataaccaactcgcatacgtcgtaattggactgttgttcatgatcctgacggtggccgctaatgagatgggtttactagaaaccaccaaaaaggacctgggcatagggcacgttgcggtggagaaccaccatcacgccactatgctcgatgtcgaccttcatcctgcatctgcttggaccctgtacgccgtggccacaaccattatcactcccatgatgagacacacaattgaaaacacgaccgcaaatatcagtttgactgctatagccaaccaggcggctatcctgatgggactcgataaaggctggccaatttcgaagatggacatcggtgtccctctgcttgccttagggtgctatagccaggtgaatccgctgacactcaccgcagccgttttgatgctggtggctcattacgcaattatcggccccggactacaagccaaagcgaccagggaggctcagaagcgcacagccgcaggcataatgaagaacccaactgtagatgggattgtggccatcgacctggatcctgtcgtttatgacgctaaatttgaaaagcagctcggacagatcatgcttctgattttgtgtacgtcccaaatcctgctcatgcggaccacatgggccctgtgcgagtctataactttagcaaccggcccccttacaaccctgtgggagggttcaccagggaaattctggaatactacgattgctgtgagcatggccaacatctttcgaggatcctacctcgcgggcgccggtctagcattcagtctgatgaagtctttgggcgggggaagaaggggcacaggggctcagggagaaaccctgggcgagaaatggaagcgccagctcaatcagcttagcaagtcagagttcaacacttataaacggtccggtattatggaggtcgacagaagtgaagccaaggaggggctgcgtaggggagagaccacaaaacacgcagtgagccggggcactgctaagttgcgctggtttgtagaacgaaatctggtgaaacctgagggtaaggttatcgatctcggctgtgggagaggaggctggtcttactattgcgccgggttaaagaaagtgaccgaagtcaagggatacacaaaaggcggtcccgggcacgaggaaccgataccaatggccacgtacggatggaacctggtgaaacttcattccggcaaagacgtcttctttatccctcccgagaagtgtgataccctgctatgcgacattggcgagtcaagcccaaatcccactatcgaagaggggaggacactccgggtgctgaaaatggttgaaccttggttgcgcggaaaccaattctgtattaagatcctgaatccgtatatgccctcggtagtggagaccctcgagcagatgcagagaaagcacggtggcatgcttgtcaggaacccactgtctcgaaatagtactcatgaaatgtactgggtgtcctgcgggacaggaaacattgttagcgcggtgaatatgacctcacggatgttactgaaccgttttacgatggctcacagaaaacctacctatgagcgcgatgtcgacttgggcgcaggtacaaggcacgtggccgtagaacccgaggtggctaacctcgatatcatagggcagcggattgaaaatatcaagcatgagcacaaatccacttggcattacgacgaggataacccttataagacctgggcctaccacggatcttatgaagttaaaccaagcggcagtgcatccagcatggtcaatggcgtggtgaagctgctaacaaagccctgggacgtcatccctatggttactcaaattgccatgaccgatacaaccccattcgggcagcagagagtgtttaaagagaaggtagacactcgcacgcccaaagctaagaggggaacagcgcaaataatggaagtgaccgcccgatggctttggggtttcctgtctcggaacaaaaagccgagaatctgtactagggaggaatttacccgcaaggtccgttcaaatgcagctattggcgccgtgttcgttgacgagaaccagtggaatagtgcaaaagaggccgtggaagatgagcggttttgggacctcgtccatagagaaagggagctgcacaagcaggggaaatgcgctacatgcgtgtacaacatgatgggaaagcgcgagaaaaagttgggcgagttcggtaaggccaaagggtcccgagcgatctggtacatgtggctgggagcacggtttctcgagttcgaagcccttggcttcatgaatgaggatcactggtttagcagagaaaactctctgtcgggcgtagagggggagggattacataagctgggttatattttgagggacatctcaaaaatacctggcgggaatatgtacgctgatgacacggccggatgggatacccgcatcactgaagacgatctccagaacgaggcaaagattacagacatcatggaaccagagcacgctctgctagccaccagcattttcaaacttacttatcaaaataaggttgtgagagtccagcggcccgctaggaacggcacagtgatggatgtgatctcccgtcgagaccagcgcggtagtgggcaggtcggaacctacggcctgaatacatttactaacatggaagcccaactcataagacagatggagtctgagggcattttcagcccttccgaactggagaccccaaacttggcagaacgggttttagattggctggagaaacatggggtggaaaggctcaagcgcatggcgatctcaggagacgactgtgtagtgaagcccatcgatgacagatttgccacggctcttagtgccctgaatgatatgggtaaagtccggaaggacattccgcagtgggagccttctaaaggctggaacgattggcagcaagtgcccttctgcagccaccactttcatcagctaataatgaaggacgggagggagatcgttgtgccatgtcgaaatcaggatgaactggtcggacgtgcaagagtgtcccagggcgctggttggtcactccgcgagaccgcctgcttggggaaaagctatgcacaaatgtggcagctgatgtacttccaccggagggaccttagactggccgcgaacgctatttgttctgccgtacctgttgattgggtgcccacaaatcgcactacctggtccatccatgcacaccatcagtggatgacaactgaagacatgctcagtgtctggaaccgggtgtggattgaggaaaatccatggatggaggataagacccacatcagctcgtggggagacgttccctatttaggcaagagggaggaccaatggtgcggctccctgatagggttgacggcccgagctacatgggccaccaacatccaggtggcaattaatcaggtcagacggctgatcggaaacgaaaattacctcgattacatgacttctatgaaaaggtttaagaacgactcagatcctgagggtgctctttggtga

SEQ ID NO: 13603 - RNA, 9879 nt, synthetic construct
  misc_feature 1..9879: note = derived and/or modified CDS sequence (opt3) from DENV-1__FJ024448__SS-prME
  source 1..9879: mol_type = other RNA
agcgtgaccatgctgctcatgcttatgcccaccgcactggctttccacttgactacgcggggcggggaacctcatatgatcgtctccaagcaggaaaggggaaaatctttactgtttaagacctcagccggtgttaacatgtgcacgctaattgccatggacctcggcgaactgtgtgaagatactataacctacaaatgcccacggatcacagaaaccgaaccggacgatgtggactgttggtgcaatgcgactgatacatgggtgacctatgggacgtgtagtcaaactggagagcaccgccgagacaagcgtagcgtggctcttgcaccccatgtcggcctgggtttggagaccagaacagaaacttggatgtcctctgagggggcatggaaacagattcagagggtggaaacctgggccctccggcaccctggattcacagttatcgctctgtttctggcacatgccattggcacctcgatcacgcagaagggcataatcttcattctcttaatgctggtgactccatcaatggctatgcgctgcgtcgggatcggaagcagagattttgtggagggtcttagtggcgccacatgggtagacgttgtgttggagcacgggtcctgtgtcaccactatggcgaaggataaacccacactggacattgaactactcaagaccgaggtgacgaaccctgcagtgctgaggaaactttgcatcgaagccaagatatctaataccacaactgatagccggtgtccaacccaaggagaggctacactggtcgaagaacaggacgccaacttcgtttgccgccgaacttttgtggatagaggctggggtaatgggtgtggattgttcggcaaaggctccctcattacctgcgcaaagtttaagtgcgtaacaaaactggaggggaagatcgtgcagtacgaaaacttaaaatattcagtcattgtgaccgttcacactggagaccagcatcaagtgggtaatgagagtacggaacacggcacaaccgctactatcacaccccaggcccctacaaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaattcagacatctggaactaccacaatatttgcaggccatttaaaatgccgtctgaagatggataaactaactctccgcgggatgtcctatgtgatgtgtaccgggtcgttcaagctggagaaagaagtcgccgagacgcagcacggtacagtgcttgttcagatcaagtacgagggcaccgacgctccttgcaagattccattctcgactcaagatgaaaaaggggtgacacagaacggaagattgatcaccgcgaatcccatagtaactgacaaggagaaacctgtcaacattgaagcagagccaccctttggcgagtcttatatcgtgatcggtgccggggaaaaggctctgaaactctcctggttcaagaagggctcaagtattggaaaaatgtttgaggccaccgcaaggggcgcccggcgaatggctatcctgggggatacagcctgggacttcggaagcattggtggcgtttttacgtccgtggggaaacttgtccatcagatattcggaaccgcatacggcgtgctgttttctggtgtaagctggactatgaaaatcgggattggcgtgttgctcacatggctgggattaaattcacgcagtacctccctgagcatgacatgtatcgcggttggcctagtcactctctacctgggggtgatggtgcaggctgattctggatgcgtcatcaactggaagggcagagaacttaaatgtggttcagggattttcgttaccaatgaggtgcacacgtggacagaacaatataagtttcaggccgacagtccgaagaggttgagcgcagccataggaaaggcttgggaggagggcgtgtgcggtatccggtccgccacccgcctggaaaacattatgtggaagcagatctctaacgagctcaatcatattctgttagaaaacgacatgaaattcactgtagtcgtgggcgatgttgcagggatcctggctcagggaaagaaaatgataagacctcaacccatggagcacaagtactcgtggaaaagctggggcaaggccaagatcattggggcggacgtgcagaataccacatttatcattgatggaccaaacactcctgaatgtcccgacgatcagagggcctggaatatctgggaggtcgaggactatggcttcggtatatttaccacaaacatttggcttaaattgcgtgattcctacacacaggtgtgcgaccaccggctcatgtcagctgcaatcaaggatagtaaagccgttcatgctgacatggggtattggattgaatctgagaagaatgaaacctggaaactggcccgagcatccttcatcgaggtgaagacttgtatatggccaaagtcccacacactatggtcaaacggagtactggaaagcgagatgatcattcccaaaatctacggcggtcctatttctcaacataattatagaccaggctacttcacccagactgcggggccgtggcacctcggaaagctggagcttgattttgacttgtgcgaaggcacaaccgtcgtggtggatgagcactgcgggaacaggggaccctccctgcgcacgactaccgtcacaggcaaaatcatacatgaatggtgttgccggagttgtaccttacctccactcagattcaggggtgaggacgggtgctggtacggaatggagattcgccccgttaaggaaaaagaggaaaatctggtaaagagcatggtatctgccggctccggtgaggtggactcatttagtcttggcctgttgtgtatcagcatcatgattgaagaggtcatgcgatcgcggtggtcccgtaagatgctcatgactgggacactggctgtgttctttctactgatcatgggacagctcacctggaacgatctgattagactttgcataatggttggcgccaatgcatctgacaggatggggatgggaacaacttatttggctctgatggccaccttcaaaatgcgccctatgtttgcagtgggcttactcttccggagactgacgagcagggaggtccttctgctaacaatcggtctctcactggtggccagtgttgaattgccaaactccctggaggaattaggggatggactcgctatgggcattatgatcctgaaacttctgaccgactttcaatctcaccagttgtgggcgactctcctgagcctaaccttcattaaaacaactttttccctgcattacgcctggaagaccatggcaatggtgctttcaatcgtcagcctcttccccctgtgtttgagtacgacatctcagaaaaccacttggctgccggtattactcggctccctggggtgcaagcctcttacaatgtttctgatagctgagaataagatctggggacgacgcagctggccattgaacgaaggtattatggccgtgggcatcgtttcgattctcctgtcatctctactgaaaaacgatgtgccccttgccgggcctctcatcgctggaggcatgctgatagcatgttatgtcattagtggttccagcgccgacttgtctttagagaaggcggctgaggtgagctgggaagaggaagccgagcactccggggcatcacataatatcctggtagaagtgcaggatgacggaaccatgaaaatcaaggatgaggagcgggacgatactctcacaattctgcttaaagccaccctgttggctgcaagtggcgtctaccccctaagcataccagccacgctgttcgtttggtatttctggcaaaagaaaaagcagagatctggcgtgctctgggacactccttcacccccagaagtggagagggcggtcctggatgacgggatctaccgtattatgcagcgcggacttttaggtcggagccaggtgggcgttggggtatttcaagaaaacgtgttccacaccatgtggcacgtcacaagaggagctgtgctgatgtatcagggcaagaggctcgagccgagttgggccagcgttaaaaaggacttgatctcctacggtgggggatggcgactgcagggctcttggaataccggcgaggaagtgcaggtcattgcagtggagcctgggaaaaaccccaagaatgtacaaacagccccaggaacttttaaaacccccgaaggtgaggtcggcgctatcgccctcgatttcaagcctgggacgtcgggaagcccaatagtgaaccgggaaggcaagatcgttggtctgtacgggaatggagtggtcacaacttcaggcacctatgtgtccgcaattgctcaggccaaagcgagtcaggagggcccccttcctgagatcgaagacgaggtttttcgcaagagaaacctgacaattatggatttgcatccggggtctggaaaaaccaggcggtacctaccagccatcgtgcgagaagcaataaagagaaaactgcgcactctcattttagctcccaccagggtcgtggccagcgagatggctgaagcactgaagggtatgcctatccgttatcaaacaacggccgtaaagtccgagcacactggcaaagagatcgtggaccttatgtgccatgccaccttcacaatgcggctgctctcaccagttagagtccccaattacaacatgattatcatggatgaagctcactttaccgacccttctagcatagcggcaagggggtatattagtactcgcgtgggaatgggcgaggccgctgccatcttcatgacagcaaccccgcccggttccgtggaagcctttccacagagcaatgctgtcattcaggatgaggaacgagacatccctgagagatcttggaactcagggtacgagtggataacggatttccccggaaagactgtatggtttgtgccatccattaaaagtggcaatgacatcgcgaactgtttgcggaagaatggcaaaagggttatccagctgagccgcaagacattcgataccgaatatcaaaagaccaaaaacaacgactgggactacgtggtcactacagatatttcggagatgggggccaatttccgtgcagacagagtgatcgatcctcggaggtgcctcaagcccgttattctgaaagacggaccagaacgcgtgatacttgctggtccgatgcctgtcaccgtggcctctgcagcccagcgaagaggccggatcgggaggaaccataataaggagggagatcagtacatttatatgggccagcccctaaacaatgacgaggatcacgctcactggacagaagccaaaatgctgttggacaacatcaatactccagagggtatcattcccgcgttatttgaacctgagcgcgaaaagtccgcagccatagatggggagtacagactgaggggcgaggctcggaagacgttcgtagaactcatgcgtcgcggagacctgccagtgtggcttagctataaagttgcctcagagggctttcaatacagtgatcgaagatggtgcttcgacggggaaaggaacaatcaggtcctggaggaaaacatggatgtggagatctggaccaaggagggagaacggaaaaagctccgccccagatggttggacgctaggacatattctgaccctctggcactacgggagtttaaagagttcgccgctggtcgaagatccgtgagcggcgatctgattctcgagatcgggaaacttccgcagcatctgactcagcgcgcccaaaatgcattagacaacttggtcatgctgcacaattcagaacagggaggcagggcgtaccggcatgccatggaggagctcccagataccattgaaacactgatgcttctggctctcatcgccgttttgaccggtggggtgactctgtttttcttaagtggccgtggactaggcaaaacgagcatagggctgctctgtgtaatggcatcctctgtgcttctgtggatggctagcgtcgagccccactggatcgccgcatccattatcttggaatttttcctgatggtgctcctgattcctgagcccgacagacagaggaccccacaggataaccaacttgcctatgttgtgatcggactcctgtttatgatattgacagtcgctgcgaatgagatgggtctgttagaaactaccaagaaggacctaggcattgggcacgtagccgtggagaaccatcaccatgcagctatgctggatgttgacctccaccctgcctcagcctggacactttacgcagtggctaccactatcattacacccatgatgcgccatacgatcgaaaacaccactgccaatatatctctgacagcgatcgctaaccaggccgcaattttgatgggactggataaaggctggccaatcagtaagatggacattggtgtccctctcctggcccttgggtgctacagccaggtgaatccgttaaccctgaccgctgcagtcctcatgttggtggcccactatgcgatcataggccccggactgcaagctaaagccacacgggaggcacagaagcgaactgccgctggcattatgaaaaacccaacggttgatgggatcgtggccatcgacctagatcctgtagtgtacgacgcaaagttcgaaaagcagctgggacagattatgctccttatcctgtgtaccagccaaatattgctgatgagaacaacttgggctctctgcgagtccattaccctggccacaggccccttaaccactctttgggagggttctccagggaaattttggaatacgacaatcgcggtctcaatggccaacattttcaggggaagctatctggcaggcgctggtctcgccttctccctaatgaagagtctgggcgggggacgccggggcaccggggcacagggagaaactttgggcgagaaatggaagagacagctgaatcagctctctaaaagcgaatttaacacctacaagcgttcaggtatcatggaggttgacaggtccgaagctaaggaggggcttaaacggggagagacaactaagcacgccgtgagtcgcggcaccgccaaactgcgatggttcgtcgaaagaaatttggtgaagcctgagggtaaagtaatagatctgggctgtgggaggggaggctggagctattactgcgcggggctcaagaaggtgacagaagttaaaggatatacgaagggcggtcccgggcatgaggaaccgatcccaatggctacctacggatggaacttagtgaaactgcactctggcaaggacgtctttttcattcctcccgagaaatgtgatactcttctgtgcgacatcggcgagtcctcaccaaatcccacaattgaagaggggcggaccctacgcgtgctcaagatggtcgaaccttggctgagaggaaaccaattttgtatcaaaattttgaatccgtacatgcccagcgtggttgagactctggagcagatgcagaggaagcatggtggcatgctcgtacgaaacccactttcgagaaattctacacacgaaatgtattgggtgagttgcgggaccggaaacatcgtctccgcagtgaatatgacgagccgtatgctgttaaacagattcaccatggcccaccgcaagcctacatacgagagggatgttgacctgggcgctggtactcggcatgtggccgtcgaacccgaggtggcaaacttggatataattgggcagagaatcgaaaatatcaaacacgagcataagtcaacctggcactatgacgaggataacccttacaaaacatgggcctatcatggatcctacgaagtaaagccatctggcagcgctagttccatggtgaatggcgttgtcaaactcctgactaagccctgggacgtgattcctatggtgacccaaatagcgatgacagataccactccatttgggcagcagcgcgtcttcaaggagaaagttgacacgaggacacccaaggccaaacgaggaaccgcacaaatcatggaagtgactgctaagtggctatggggttttcttagccggaacaaaaagccgagaatttgtaccagggaggagttcacacgcaaggtacgttctaatgccgcaatcggcgccgtgtttgtcgacgagaaccagtggaactcagctaaagaggccgtggaagatgagcggttctgggacctggttcacagagaaagggagctccacaagcaggggaaatgcgcgacgtgcgtgtataacatgatgggaaagcgcgagaagaagctgggcgagtttggtaaggcaaaagggagtcgagccatttggtacatgtggttgggagctcggttcctggagttcgaagccctcggctttatgaatgaggatcattggttctccagagaaaacagcctttctggcgtcgagggggagggactgcacaagttaggttacatcctgagggacatatcgaaaatccctggcgggaatatgtatgcagatgacaccgctggatgggatactcgcattacagaagacgatttgcagaacgaggccagaatcaccgacattatggaaccagagcatgctctcctggccaagtcaatctttaaactaacttaccaaaataaggtggtacgggttcagaggcccgccaagaatggcacagtgatggatgtcataagccgtcgagaccagcgcggttccggacaggtgggaacctatggccttaatacattcactaacatggaagcgcaactgattagacagatggagagtgagggcatcttttctcctagcgaactcgagaccccaaacctggccgaacgggtgttggattggttagagaagtacggggtcgaaaggctgaagcgcatggctatctccggagacgactgtgttgtgaaacccattgatgacagattcgccacggcactcaccgctcttaatgatatgggtaaggtacggaaagacataccgcagtgggagccttcaaagggctggaacgattggcagcaagtgcccttttgcagtcaccacttccatcagctgatcatgaaagacgggagggagattgtcgtgccatgtcgaaatcaggatgagctagttggacgtgccagagtgtctcagggcgcaggttggagcctgcgcgagacagcctgcctcgggaagtcctatgcgcaaatgtggcagttgatgtactttcaccggagggacctgagacttgctgccaacgcaatctgttcagccgtccctgtggattggattcccactagccgcaccacatggtctatccatgctcaccatcagtggatgactaccgaagacatgctgtccgtatggaatcgggtttggatagaggaaaacccatggatggaggataagacgcacatcagtagctggggagacgtgccctatctcggcaaaagggaggaccaatggtgcggctcgttaattgggctgacagcccgagcaacctgggctactaatatccaggtcgccattaaccaggtgagacggttgatcggaaatgaaaactacctggattacatgacatccatgaagaggttcaaaaatgagtctgaccctgaaggtgcgctctggtga

SEQ ID NO: 13604 - RNA, 9879 nt, synthetic construct
  misc_feature 1..9879: note = derived and/or modified CDS sequence (opt3) from DENV-1__FJ182026__SS-prME
  source 1..9879: mol_type = other RNA
agcgtgaccatgctgctcatgcttatgcccacggccctggctttccacttgactacgagaggaggggaacctcatatgatcgtctccaagcaggaaagaggaaaatctttactgtttaagacctcagccggtgttaacatgtgcacactaattgccatggacctcggcgagctgtgtgaagatactatgacctacaaatgcccacggattacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccgggtcgttcaaactggagaaggaacttgccgagacgcagcacggtacagtcttggtgcagataaagtacgagggcaccgacgctccttgcaaaatcccattctcgactcaaaacgaaaagggggttacacagaatggacgcctgattaccgcgaaccccatcgtgactgataaagagaagcctgtaaatatagaagcagagccaccctttggcgagtcttatattgtcatcggtgccggggaaaaagctctcaagctgtcctggttcaagaaaggctcaagtatcggaaagatgtttgaggccaccgcaagaggcgccaggcggatggctattcttggggacacagcctgggatttcggaagcatcggtggcgtgtttacgtccgttgggaaactggtgcatcagattttcggaaccgcatacggcgtcttgttttctggtgtgagctggactatgaagatagggatcggcgtactcctgacatggttaggactgaactcacgaagtacctccctaagcatgacatgtattgcggtgggcctcgttactctgtaccttggggtcatggtgcaggctgactctggatgcgtgatcaattggaaaggccgcgaattgaagtgtggttcagggatcttcgtcaccaacgaggttcacacgtggacagaacaatataagtttcaggccgatagtccgaaaagactgagcgcagccattggaaaggcttgggaggagggcgtgtgcggtataaggtccgccacccggctcgaaaacatcatgtggaaacagatttctaatgagctgaaccatatcttactggaaaatgacatgaagttcactgtggtagtcggcgacgtggcagggattcttgctcagggcaagaagatgatccgccctcaacccatggagtacaaatattcgtggaaaagctggggcaaggccaagataatcggggcggatgttcagaacaccacatttattatcgacggaccaaatactcctgaatgtcccgatgaccagagagcctggaacatttgggaggtggaggattacggcttcggtatctttaccacaaatatatggttgaagctcagggactcctatacgcaggtctgcgatcaccgtctgatgtcagctgcaattaaagacagtaaggccgtgcacgctgatatggggtactggatcgaatctgagaaaaacgaaacctggaagctagcccgggcatccttcattgaggttaagacttgtatctggccaaaatcccatacactgtggtcaaatggagtgctcgaaagcgagatgataatccccaagatttatggcggtcctatctctcaacacaactaccgaccaggctacttcacccagactgcggggccgtggcatctgggaaaacttgagttggactttgatctgtgcgaaggcacaaccgtagtcgtggacgagcactgcgggaatagaggaccctccttaaggacgactaccgtgacaggcaagattatccacgaatggtgttgccgcagttgtaccctccctccactgcggttcagaggtgaggatgggtgctggtatggaatggagataaggcccgtcaaagaaaaggaggaaaaccttgttaagagcatggtgtctgccggctccggtgaggtagactcatttagtctgggcttgctctgtattagcatcatgatcgaagaggtgatgcgctcgcgatggtcccggaaaatgctgatgactgggacactagctgtcttctttctgctcattatgggacagctgacctggaatgaccttatccgtttgtgcattatggtgggcgccaacgcatctgatagaatggggatgggaacaacttacctggctttaatggccaccttcaagatgaggcctatgtttgcagttggcctcctgttccgccggcttacgagcagagaggtgctgctactcacaataggtctgtcattggtcgccagtgtggaactgccaaattccttagaggaactcggggacggactggctatgggcatcatgattcttaaactgttgaccgattttcaatctcatcagctctgggcgactctgctaagcctgaccttcatcaagacaactttttcccttcactatgcctggaaaaccatggcaatggttctctcaattgtgagcctgttccccttgtgtctgagtacgacatctcagaagaccacttggttaccggtcctcctgggctcccttgggtgcaagcctctgacaatgtttttgatcgctgagaacaaaatatggggaaggcgaagctggccactcaacgaaggtatcatggccgtaggcattgtgtcgatcctgctatcatctctgcttaagaatgacgttcccctcgccgggcctctgattgctggaggcatgttgatcgcatgttacgtgataagtggttccagcgccgatttatctctggagaaagcggctgaggtcagctgggaagaggaagccgagcattccggggcatcacacaacattctcgtggaagtacaggacgatggaaccatgaagatcaaagacgaggagcgcgatgacactctgacaatccttctgaaggccaccttgctagctgtgagtggcgtctatcccctgagcattccagcaacactcttcgtttggtacttctggcagaagaagaagcagcggtctggcgtgctgtgggatactccttcacccccagaagtggagagagccgtccttgacgatgggatatataggatcatgcagcgtggattactgggtcgcagccaggtgggcgttggggtatttcaagaaaatgtgttccataccatgtggcacgtcacacggggagcggtgctcatgtaccagggcaaaagattggagccgagttgggctagcgttaagaaagacctgatttcctacggtgggggatggaggctccagggctcttggaacgccggcgaggaagtgcaggtcatcgcagtggagcctgggaagaatcccaaaaacgtacaaaccgccccaggaacatttaagactcccgaaggtgaggtcggcgctattgccctggacttcaagcctgggacctcgggaagcccaatcgtgaatcgagaaggcaaaatagttggtctttatgggaacggagtggtcacgacatcaggcacttacgtgtccgcaatcgctcaggccaaggcgagtcaggagggccccctgcctgagattgaagatgaggtttttcggaaacgcaatttgaccatcatggacctacacccggggtctggaaagacaagaaggtatctgccagccattgtgcgggaagcaatcaaacgaaagctcagaaccttaatactggctcccactcgcgtcgtggccagcgagatggctgaagcacttaagggtatgcctattaggtaccaaaccacagccgtaaaatccgagcatacgggcaaggagatcgtggatctgatgtgccacgccactttcaccatgcgtctcttgtcaccagttcgggtccccaactataatatgatcattatggacgaagctcattttacagatccttctagcatcgcggcaagagggtacataagtaccagggtgggaatgggcgaggccgctgccattttcatgactgcaacaccgcccggttccgtggaagcctttccacagagcaacgctgtcatccaggacgaggaacgcgatattcctgagcgatcttggaactcagggtatgagtggatcaccgacttccccggaaaaacggtatggtttgtgccatccataaagagtggcaacgatattgcgaattgtctgaggaaaaatggcaagcgggttatccagctcagcaggaagactttcgacacagaataccagaaaaccaagaacaatgattgggactacgtggtcaccactgacatctcggagatgggggccaacttccgcgcagatcgtgtgattgaccctagacggtgcctgaaacccgttatccttaaggatggaccagaaagggtgattctagctggtccgatgcctgtcacagtggcctctgcagcccagcgccgaggcagaatagggcggaatcacaacaaagagggagaccagtatatctacatgggccagcccctgaataacgatgaggaccatgctcactggaccgaagccaagatgttgttagataatattaacacaccagagggtatcatccccgcgctgtttgaacctgagagggaaaagtccgcagccattgacggggagtatcgcctcagaggcgaggctaggaaaactttcgtagaactgatgcggcgtggagatcttccagtgtggctgagctacaaggttgcctcagagggctttcaatatagtgaccgccgatggtgcttcgatggggaaagaaataaccaggtcctcgaggaaaatatggacgtggagatatggacgaaagagggagaaaggaagaaattgcggccccgctggctggatgctagaacctactctgaccctctagcactgagggagtttaaggagttcgccgctggtcggcgatccgtgagcggcgacctcatccttgagattgggaaactgccgcagcacttaacacagagagcccaaaacgcattggataatctggtcatgctccataactcagaacagggaggccgcgcgtataggcacgccatggaggagctgccagacactatcgaaacccttatgctgctcgctttgattgccgttctgacaggtggggtgaccttatttttcctaagtggccggggactgggcaagactagcatcgggctcctttgtgtaatggcatcctctgtgctgttgtggatggctagcgtcgagccccattggatagccgcatccatcattctggaatttttcctcatggtgctgcttatccctgagcccgatcgtcagagaacgccacaggacaatcaactcgcctacgttgtgattggactgttgtttatgatcctgaccgtcgctgcgaacgagatgggtttactagaaacaactaagaaagatctgggcatagggcacgtagccgtggagaaccaccatcacgcagctatgctcgacgttgatcttcatcctgcctcagcctggaccctgtacgcagtggctacaaccattatcactcccatgatgaggcacacaattgaaaatacgaccgccaacatctctttgactgcgatagctaatcaggccgcaatcctgatgggactcgacaagggctggccaattagtaaaatggatatcggtgtccctctgcttgccttagggtgctatagccaggtgaacccgctgacactcaccgctgcagtcttgatgctggtggcccattacgcgattatcggccccggactacaagctaaggccacccgcgaggcacagaaacggacagccgctggcataatgaagaatccaactgttgacgggattgtggccatcgatctggaccctgtagtgtatgatgcaaagttcgaaaaacagctcggacagatcatgcttctgattttgtgtacgagccaaatcctgctcatgcgaaccacatgggctctgtgcgagtccataactttagccaccggcccccttacaaccctgtgggagggttctccagggaagttttggaacactacgattgcggtctcaatggccaatatcttcagaggaagctacctcgcaggcgctggtctagccttctccctgatgaaaagtttgggcgggggaaggcgcggcacaggggcacagggagaaaccctgggcgagaagtggaaacggcagctcaaccagctttctaagagcgaatttaatacttataagagatcaggtattatggaggttgaccgttccgaagctaaagaggggctgaagaggggagagaccacaaaacacgccgtgagtcggggcactgccaagttgcgctggttcgtcgaacgaaacctggtgaaacctgagggtaaggtaatcgacctcggctgtgggagaggaggctggagctactattgcgcggggttaaagaaagtgaccgaagttaagggatacacaaaaggcggtcccgggcacgaggaaccgataccaatggctacgtacggatggaatctggtgaaacttcattctggcaaagatgtctttttcatccctcccgagaagtgtgacaccctgctatgcgatattggcgagtcctcaccaaaccccactatcgaagaggggaggacactccgggtgctgaaaatggtcgaaccttggttgcgcggaaatcaattttgtattaagatcctgaacccgtatatgcccagcgtggttgagaccctcgagcagatgcagagaaagcacggtggcatgcttgtaaggaatccactgtcgcgaaactctactcatgaaatgtactgggtgagttgcgggacaggaaatattgtctccgcagtgaacatgaccagccggatgttactgaaccgtttcacgatggcccacagaaaacctacctatgagcgcgacgttgatttgggcgctggtacaaggcacgtggccgtcgaacccgaggtggcaaatctcgacatcatagggcagcggattgaaaacatcaagcatgagcacaaatcaacttggcattacgatgaggacaatccttataagacctgggcctaccacggatcctatgaagtaaaaccatctggcagcgctagttccatggtgaacggcgttgtcaagctgctaacaaagccctgggatgtgatccctatggtgactcaaattgcgatgaccgacacaaccccatttgggcagcagagagtcttcaaagagaaggttgatactcgcacgcccaaagccaagaggggaacagcacaaataatggaagtgaccgctaaatggctttggggttttctgagccgaaataagaagccgcggatctgtactagagaggagttcaccaggaaagtacgctctaacgccgcaattggcgccgtgtttgtcgacgagaatcagtggaactcagctaaggaggccgtggaagacgagcgtttctgggatctcgttcatcgggaaagagagctgcacaaacaggggaagtgcgcgacatgcgtgtacaatatgatgggaaaaagggaaaagaagttgggcgagtttggtaaagcaaaggggagtcgcgccatctggtacatgtggctgggagctcgattcctcgagttcgaagcccttggctttatgaacgaggaccactggttctcccgggaaaatagcctgtctggcgtcgagggggagggattacataaactgggttatattttgagagatatctcgaagatacctggcgggaacatgtacgcagacgatacggctggatgggacaccaggatcactgaagatgacctccagaatgaggcccgcattacagatatcatggaaccagagcacgctctgctagccaaatcaatttttaaacttacctatcaaaacaaagtggtaagagttcagcggcccgcaaagaatggcactgtgatggacgtcatcagcaggcgtgatcagcgaggttccggacaggtgggaacatacggcctgaacaccttcacaaacatggaagcgcaactcatacgccagatggagagtgagggcatattttctcctagcgaactggagactccaaatttggccgaaagagtgttagactggctggagaagtatggggtcgaacggctcaaaaggatggctatctccggagatgactgtgttgtgaagcccatcgacgatcgcttcgccaccgcacttacggctctgaacgacatgggtaaagtaagaaaggatattccgcagtgggagccttcaaaaggctggaatgactggcagcaagtgcccttttgcagtcatcacttccaccagctaataatgaaggatgggcgggagatcgtcgtgccatgtaggaaccaggacgaactggttggacgagcccgtgtgtctcagggcgcaggttggagcctcagagagaccgcctgcttggggaagtcctacgcgcaaatgtggcagctgatgtattttcatcgccgggatcttaggctggctgccaatgcaatttgttcagccgtccctgtggactggatccccacaagcagaactacctggtctattcacgctcatcaccagtggatgacaactgaagatatgctctccgtatggaaccgcgtttggatcgaggaaaatccatggatggaggacaaaacccatataagtagctggggagatgtgccctacttaggcaagcgggaggaccaatggtgcggctcgctgatcgggttgacggccagggcaacatgggctaccaacattcaggtcgccatcaatcaggtgcgaagactgattggaaacgaaaattacctcgactatatgacttccatgaaacggttcaagaacgagtctgatcctgaaggtgcgctttggtga

SEQ ID NO: 13605 - RNA, 9879 nt, synthetic construct
  misc_feature 1..9879: note = derived and/or modified CDS sequence (opt3) from DENV-1__FJ182027__SS-prME
  source 1..9879: mol_type = other RNA
agcgtgaccatgctgctcatgcttatgcccaccgccctggctttccacttgactacgcggggcggggaacctcatatgatcgtctccaagcaggaaaggggaaagtctttactgtttaagacctcagccggtgttaatatgtgcacgctaattgccatggacctcggcgaactgtgtgaagatactataacctacaaatgcccacggatcacagaaaccgaaccggacgatgtggactgttggtgcaatgcgactgatacatgggtgacctatgggacgtgtagtcaaactggagagcaccgccgagacaagcgtagcgtggctcttgcaccccatgtcggcctgggtttggagaccagaacagaaacttggatgtcctctgagggggcatggaaacagattcagagggtggaaacctgggccctccggcaccctggattcacagttatcgctctgtttctggcacatgccattggcacctcgatcacgcagaagggcataatcttcattctcttaatgctggtgactccatcaatggctatgcgctgcgtcgggatcggaagcagagattttgtggagggtcttagtggcgccacatgggtagacgttgtgttggagcacgggtcctgtgtcaccactatggcgaaggataaacccacactggacattgaactactcaagaccgaggtgacgaaccctgcagtgctgaggaaactttgcatcgaagccaagatatctaataccacaactgatagccggtgtccaacccaaggagaggctacactggtcgaagaacaggacgccaacttcgtttgccgccgaacttttgtggatagaggctggggtaatgggtgtggattgttcggcaaaggctccctcattacctgcgcaaagtttaagtgcgtaacaaaactggaggggaagatcgtgcagtacgaaaacttaaaatattcagtcattgtgaccgttcacactggagaccagcatcaagtgggtaatgagagtacggaacacggcacaaccgctactatcacaccccaggcccctacaaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaattcagacatctggaactaccacaatatttgcaggccatttaaaatgccgtctgaagatggataaactaactctccgcgggatgtcctatgtgatgtgtaccgggagcttcaagctggagaaagaagtcgccgagacgcagcacggtacagtgcttgttcagatcaagtacgagggcaccgacgctccttgcaagattccattctcgactcaagatgaaaaaggggtgacacagaacggaagattgatcaccgcgaatcccatagtaactgacaaggagaaacctgtcaacattgaagcagagccaccctttggcgagtcttatatcgtgatcggtgccggggaaaaggctctgaaactctcctggttcaagaagggctcaagtattggaaaaatgtttgaggccaccgcaaggggcgcccggcgaatggctatcctgggggatacagcctgggacttcggaagcattggtggcgtttttacgtccgtggggaaacttgtccatcagatattcggaaccgcatacggcgtgctgttttctggtgtaagctggactatgaaaatcgggattggcgtgttgctcacatggctgggattaaattcacgcagtacctccctgagcatgacatgtatcgcggttggcctagtcactctctacctgggggtgatggtgcaggctgattctggatgcgtcatcaactggaagggcagagaacttaaatgtggttcagggattttcgttaccaatgaggtgcacacgtggacagaacaatataagtttcaggccgacagtccgaagaggttgagcgcagccataggaaaggcttgggaggagggcgtgtgcggtatccggtccgccacccgcctggaaaacattatgtggaagcagatctctaacgagctcaatcatattctgttagaaaacgacatgaaattcactgtagtcgtgggcgatgttgcagggatcctggctcagggaaagaaaatgataagacctcaacccatggagcacaagtactcgtggaaaagctggggcaaggccaagatcattggggcggacgtgcagaataccacatttatcattgatggaccaaacactcctgaatgtcccgacgatcagagggcctggaatatctgggaggtcgaggactatggcttcggtatatttaccacaaacatttggcttaaattgcgtgattcctacacacaggtgtgcgaccaccggctcatgtcagctgcaatcaaggatagtaaagccgttcatgctgacatggggtattggattgaatctgagaagaatgaaacctggaaactggcccgagcatccttcatcgaggtgaagacttgtatatggccaaagtcccacacactatggtcaaacggagtactggaaagcgagatgatcattcccaaaatctacggcggtcctatttctcaacataattatagaccaggctacttcacccagactgcggggccgtggcacctcggaaagctggagcttgattttgacttgtgcgaaggcacaaccgtcgtggtggatgagcactgcgggaacaggggaccctccctgcgcacgactaccgtcacaggcaaaatcatacatgaatggtgttgccggagttgtaccttacctccactcagattcaggggtgaggacgggtgctggtacggaatggagattcgccccgttaaggaaaaagaggaaaatctggtaaagagcatggtatctgccggctccggtgaggtggactcatttagtcttggcctgttgtgtatcagcatcatgattgaagaggtcatgcgatcgcggtggtcccgtaagatgctcatgactgggacactggctgtgttctttctactgatcatgggacagctcacctggaacgatctgattagactttgcataatggttggcgccaatgcatctgacaggatggggatgggaacaacttatttggctctgatggccaccttcaaaatgcgccctatgtttgcagtgggcttactcttccggagactgacgagcagggaggtccttctgctaacaatcggtctctcactggtggccagtgttgaattgccaaactccctggaggaattaggggatggactcgctatgggcattatgatcctgaaacttctgaccgactttcaatctcaccagttgtgggcgactctcctgagcctaaccttcattaaaacaactttttccctgcattacgcctggaagaccatggcaatggtgctttcaatcgtcagcctcttccccctgtgtttgagtacgacatctcagaaaaccacttggctgccggtattactcggctccctggggtgcaagcctcttacaatgtttctgatagctgagaataagatctggggacgacgcagctggccattgaacgaaggtattatggccgtgggcatcgtttcgattctcctgtcatctctactgaaaaacgatgtgccccttgccgggcctctcatcgctggaggcatgctgatagcatgttatgtcattagtggttccagcgccgacttgtctttagagaaggcggctgaggtgagctgggaagaggaagccgagcactccggggcatcacataatatcctggtagaagtgcaggatgacggaaccatgaaaatcaaggatgaggagcgggacgatactctcacaattctgcttaaagccaccctgttggctgtcagtggcgtttaccccctaagcataccagcaacgctgttcgtgtggtatttctggcaaaagaaaaagcagagatctggcgtgctctgggacactccttcacccccagaagtcgagagggccgtgctggatgacgggatctaccgtattatgcagcgcggacttttaggtcggagccaggttggcgtaggggtgtttcaagaaaacgtcttccacaccatgtggcacgtgacaagaggagcggttctgatgtatcagggcaagaggctcgagccgagttgggctagcgtgaaaaaggacttgatctcctacggtgggggatggcgactgcagggctcttggaataccggcgaggaagtccaggtgattgccgtagagcctgggaaaaaccccaagaatgtccaaacagcaccaggaacttttaaaacccccgaaggtgaggtgggcgccatcgctctcgatttcaagcctgggacgtcgggaagcccaatagttaaccgggaaggcaagatcgtgggtctgtacgggaatggagtcgtgacaacttcaggcacctatgtttccgccattgcacaggctaaagccagtcaggagggcccccttcctgagatcgaagacgaggtgtttcgcaagagaaacctgacaattatggatttgcatccggggtctggaaaaaccaggcggtacctaccagcgatcgtccgagaagccataaagagaaaactgcgcactctcattttagcacccaccagggtggtagctagcgagatggccgaagctctgaagggtatgcctatccgttatcaaacaacggcagtgaagtccgagcacactggcaaagagatcgttgaccttatgtgccatgccaccttcacaatgcggctgctctcaccagtcagagtgcccaattacaacatgattatcatggatgaagcccactttaccgacccttctagcatagctgcgagggggtatattagtactcgcgtgggaatgggcgaggcagccgctatcttcatgacagccaccccgcccggttccgtcgaagcatttccacagagcaatgccgtaattcaggatgaggaacgagacatccctgagagatcttggaactcagggtacgagtggataacggatttccccggaaagactgtgtggtttgttccatccattaaaagtggcaatgacatcgctaactgtttgcggaagaatggcaaaagggtgatccagctgagccgcaagacattcgataccgaatatcaaaagaccaaaaacaacgactgggactacgtcgtgactacagatatttcggagatgggggcgaatttccgtgccgacagagttatcgatcctcggaggtgcctcaagcccgtgattctgaaagacggaccagaacgcgtcatacttgcaggtccgatgcctgtgaccgtagcttctgccgcacagcgaagaggccggatcgggaggaaccataataaggagggagatcagtacatttatatgggccagcccctaaacaatgacgaggatcacgcccactggacagaagctaaaatgctgttggacaacatcaatactccagagggtatcattcccgccttatttgaacctgagcgcgaaaagtccgcggcaatagatggggagtacagactgaggggcgaggcccggaagacgttcgtggaactcatgcgtcgcggagacctgccagtttggcttagctataaagtcgcttcagagggctttcaatacagtgatcgaagatggtgcttcgacggggaaaggaacaatcaggtgctggaggaaaacatggatgtggagatctggaccaaggagggagaacggaaaaagctccgccccagatggttggacgccaggacatattctgaccctctggctctacgggagtttaaagagttcgcagccggtcgaagatccgtcagcggcgatctgattctcgagatcgggaaacttccgcagcatctgactcagcgcgctcaaaatgccttagacaacttggttatgctgcacaattcagaacagggaggcagggcataccggcatgcgatggaggagctcccagataccattgaaacactgatgcttctggccctcatcgctgtgttgaccggtggggtaactctgtttttcttaagtggccgtggactaggcaaaacgagcatagggctgctctgtgtgatggcctcctctgtccttctgtggatggcaagcgtggagccccactggatcgctgcctccattatcttggaatttttcctgatggttctcctgattcctgagcccgacagacagaggaccccacaggataaccaacttgcatatgtggtcatcggactcctgtttatgatattgacagtagccgctaatgagatgggtctgttagaaactaccaagaaggacctaggcattgggcacgtggcggttgagaaccatcaccatgccgcaatgctggatgtggacctccaccctgcttcagcctggacactttacgccgtcgcaaccactatcattacacccatgatgcgccatacgatcgaaaacaccactgctaatatatctctgacagccatcgcgaaccaggctgccattttgatgggactggataaaggctggccaatcagtaagatggacattggtgtgcctctcctggcacttgggtgctactcgcaggtcaatccgttaaccctgaccgccgctgtgctcatgttggttgcacactatgccatcataggccccggactgcaagcgaaagctacacgggaggcccagaagcgaactgcagccggcattatgaaaaacccaacggtggatgggatcgtagctatcgacctagatcctgtggtctacgacgccaagttcgaaaagcagctgggacagattatgctccttatcctgtgtaccagccaaatattgctgatgagaacaacttgggcactctgcgagtccattaccctggctacaggccccttaaccactctttgggagggttctccagggaaattttggaatacgacaatcgccgtttcaatggcgaacattttcaggggaagctatctggccggcgcaggtctcgctttctccctaatgaagagtctgggcgggggacgccggggcaccggggcccagggagaaactttgggcgagaaatggaagagacagctgaatcagctctctaaaagcgaatttaacacctacaagcgttcaggtatcatggaggtggacaggtccgaagcaaaggaggggcttaaacggggagagacaactaagcacgctgtcagtcgcggcaccgccaaactgcgatggttcgtggaaagaaatttggtaaagcctgagggtaaagtgatagatctgggctgtgggaggggaggctggagctattactgcgccgggctcaagaaggttacagaagtgaaaggatatacgaagggcggtcccgggcatgaggaaccgatcccaatggcgacctacggatggaacttagtcaaactgcactctggcaaggacgtgtttttcattcctcccgagaaatgtgatactcttctgtgcgacatcggcgagtcctcaccaaatcccacaattgaagaggggcggaccctacgcgtcctcaagatggtggaaccttggctgagaggaaaccaattttgtatcaaaattttgaatccgtacatgcccagcgttgtagagactctggagcagatgcagaggaagcatggtggcatgctcgtgcgaaacccactttcgagaaattctacacacgaaatgtattgggtcagttgcgggaccggaaacatcgtgtccgctgttaatatgacgagccgtatgctgttaaacagattcaccatggcacaccgcaagcctacatacgagagggatgtggacctgggcgccggtactcggcatgtcgctgtggaacccgaggtagccaacttggatataattgggcagagaatcgaaaatatcaaacacgagcataagtcaacctggcactatgacgaggataacccttacaaaacatgggcatatcatggatcctacgaagtgaagccatctggcagcgccagttccatggttaatggcgtcgtgaaactcctgactaagccctgggacgtgattcctatggtcacccaaatagctatgacagataccactccatttgggcagcagcgcgttttcaaggagaaagtggacacgaggacacccaaggcgaaacgaggaaccgcccaaatcatggaagtaactgcaaagtggctatggggttttcttagccggaacaaaaagccgagaatttgtaccagggaggagttcacacgcaaggtgcgttctaatgctgccatcggcgcagtctttgtggacgagaaccagtggaactcagccaaagaggctgttgaagatgagcggttctgggacctggtgcacagagaaagggagctccacaagcaggggaaatgcgccacgtgcgtctataacatgatgggaaagcgcgagaagaagctgggcgagtttggtaaggcgaaagggagtcgagcaatttggtacatgtggttgggagcccggttcctggagttcgaagctctcggctttatgaatgaggatcattggttctccagagaaaacagcctttctggcgtggagggggagggactgcacaagttaggttacatcctgagggacatatcgaaaatccctggcgggaatatgtatgccgatgacaccgcaggatgggatactcgcattacagaagacgatttgcagaacgaggctagaatcaccgacattatggaaccagagcatgccctcctggctaagtcaatctttaaactaacttaccaaaataaggtagttcgggtgcagaggcccgccaaaaacggcacagtcatggatgtgataagccgtcgagaccagcgcggttccggacaggtgggaacctatggccttaatacattcactaacatggaagcacaactgattagacagatggagagtgagggcatcttttctcctagcgaactcgagaccccaaacctggcggaacgggtcttggattggttagagaagtacggggttgaaaggctgaagcgcatggccatctccggagacgactgtgtggtaaaacccattgatgacagattcgctacggccctcaccgcacttaatgatatgggtaaggtgcggaaagacataccgcagtgggagccttcaaagggctggaacgattggcagcaagtccccttttgcagtcaccacttccatcagctgatcatgaaagacgggagggagattgtggttccatgtcgaaatcaggatgagctagtgggacgtgctagagtctctcagggcgccggttggagcctgcgcgagacagcatgcctcgggaagtcctatgcccaaatgtggcagttgatgtactttcaccggagggacctgagacttgcggctaacgccatctgttcagcagtgcctgtagattggattcccactagccgcaccacatggtctatccatgcccaccatcagtggatgactaccgaagacatgctgtccgtttggaatcgggtgtggatagaggaaaacccatggatggaggataagacgcacatcagtagctggggagacgtcccctatctcggcaaaagggaggaccaatggtgcggctcgttaattgggctgacagctcgagccacctgggcaactaatatccaggtggctattaaccaggttagacggttgatcggaaatgaaaactacctggattacatgacatccatgaagaggttcaaaaatgagtctgaccctgaaggtgccctctggtga

SEQ ID NO: 13606 - RNA, 9879 nt, synthetic construct
  misc_feature 1..9879: note = derived and/or modified CDS sequence (opt3) from DENV-1__FJ024449__SS-prME
  source 1..9879: mol_type = other RNA
agcgtgaccatgctgctcatgcttatgcccacagccctggctttccacttgactacgagaggaggggagcctcatatgatcgtctccaagcaggaaagaggaaaatctttactgtttaagacctcagccggtgttaatatgtgcacactaattgccatggacctcggcgagctgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccgggtcgttcaaactggagaaggaagtcgccgagacgcagcacggtacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattatcatcggtgccggggaaaaagctctgaagctctcctggttcaagaaaggctcaagtattggaaagatgtttgaggccaccgcaagaggcgccaggcggatggctatcctgggggatacagcctgggacttcggaagcattggtggcgtgtttacgtccgttgggaaacttgtgcatcagatattcggaaccgcatacggcgtcctgttttctggtgtgagctggactatgaagatcgggattggcgtattgctcacatggctgggattaaattcacgaagtacctccctgagcatgacatgtatcgcggtgggcctagttactctctacctgggggtcatggtgcaggctgattctggatgcgtgatcaactggaaaggccgcgaacttaagtgtggttcagggattttcgtcaccaatgaggttcacacgtggacagaacaatataagtttcaggccgacagtccgaaaagattgagcgcagccataggaaaggcttgggaggagggcgtgtgcggtatcaggtccgccacccggctggaaaacattatgtggaaacagatctctaacgagctcaatcatattctgttagaaaacgacatgaagttcactgtggtagtcggcgatgtggcagggatcctggctcagggcaaaaagatgatacgccctcaacccatggagtacaaatattcgtggaaaagctggggcaaggccaagatcattggggcggacgttcagaataccacatttatcattgatggaccaaacactcctgaatgtcccgacgatcagagagcctggaatatctgggaggtggaggactacggcttcggtatatttaccacaaacatttggcttaagttgagggattcccacacgcaggtctgcgaccaccgtctcatgtcagctgcaatcaaagatagtaaggccgtgcatgctgacatggggtattggattgaatctgagaaaaatgaaacctggaagctggcccgggcatccttcatcgaggttaagacttgtatatggccaaaatcccacacactatggtcaaacggagtgctggaaagcgagatgatcattcccaagatctacggcggtcctatttctcaacataattatcgaccaggctacttcacccagactgcggggccgtggcacctcggaaaactggagcttgattttgacttgtgcgaaggcacaaccgtagtcgtggatgagcactgcgggaacagaggaccctccctgaggacgactaccgtgacaggcaagatcatacatgaatggtgttgccgcagttgtaccttacctccactccggttcagaggtgaggacgggtgctggtacggaatggagattaggcccgtcaaagaaaaggaggaaaatctggttaagagcatggtgtctgccggctccggtgaggtagactcatttagtcttggcctgttgtgtatcagcatcatgattgaagaggtgatgcgctcgcgatggtcccggaaaatgctcatgactgggacactggctgtcttctttctactgatcatgggacagctcacctggaacgatctgattcgtctttgcataatggtgggcgccaatgcatctgacagaatggggatgggaacaacttatttggctctgatggccaccttcaagatgaggcctatgtttgcagttggcttactcttccgccggctgacgagcagagaggtgcttctgctaacaatcggtctctcactggtcgccagtgtggaattgccaaactccctggaggaattaggggatggactcgctatgggcattatgatcctgaaacttctgaccgactttcaatctcaccagttgtgggcgactctcctgagcctaaccttcattaagacaactttttccctgcattacgcctggaaaaccatggcaatggttctttcaatcgtgagcctcttccccctgtgtttgagtacgacatctcagaagaccacttggctgccggtcttactcggctccctggggtgcaagcctcttacaatgtttctgatagctgagaataaaatctggggaaggcgaagctggccattgaacgaaggtattatggccgtaggcatcgtgtcgattctcctgtcatctctactgaagaacgatgttccccttgccgggcctctcatcgctggaggcatgctgatagcatgttatgtgattagtggttccagcgccgacttgtctttagagaaagcggctgaggtcagctgggaagaggaagccgagcactccggggcatcacataatatcctggtggaagtacaggatgacggaaccatgaagatcaaagatgaggagcgcgacgatactctcacaattctgcttaaggccaccctgttggctgtgagtggcgtctaccccctaagcataccagcaacgctgttcgtttggtatttctggcagaaaaagaagcagcggtctggcgtgctctgggacactccttcacccccagaagtggagagagccgtcctggatgacgggatctacaggattatgcagcgtggacttttaggtcgcagccaggtgggcgttggggtatttcaagaaaacgtgttccacaccatgtggcacgtcacacggggagcggtgctgatgtatcagggcaaaagactcgagccgagttgggctagcgttaagaaagacttgatctcctacggtgggggatggaggctgcagggctcttggaataccggcgaggaagtgcaggtcattgccgtggagcctgggaagaaccccaaaaatgtacaaacagcaccaggaacttttaagacccccgaaggtgaggtcggcgccatcgctctcgatttcaagcctgggacgtcgggaagcccaatagtgaaccgagaaggcaaaatcgttggtctgtacgggaatggagtggtcacaacttcaggcacctatgtgtccgccattgcacaggctaaggccagtcaggagggcccccttcctgagatcgaagacgaggtttttcggaaacgcaacctgacaattatggatttgcatccggggtctggaaagaccagaaggtacctaccagcgatcgtgcgggaagccataaaacgaaagctgagaactctcattttagcacccacccgcgtcgtggctagcgagatggccgaagctctgaagggtatgcctatcaggtatcaaacaacggcagtaaaatccgagcacactggcaaggagatcgtggaccttatgtgccatgccaccttcacaatgcgtctgctctcaccagttcgggtccccaattacaacatgattatcatggatgaagcccactttaccgacccttctagcatagctgcgagagggtatattagtactagggtgggaatgggcgaggcagccgctatcttcatgacagccaccccgcccggttccgtggaagcatttccacagagcaatgccgtcattcaggatgaggaacgcgacatccctgagcgatcttggaactcagggtacgagtggataacggatttccccggaaaaactgtatggtttgtgccatccattaagagtggcaatgacatcgctaactgtttgaggaaaaatggcaagcgggttatccagctgagcaggaagacattcgataccgaatatcagaaaaccaagaacaacgactgggactacgtggtcactacagatatttcggagatgggggcgaatttccgcgccgaccgtgtgatcgatcctagacggtgcctcaaacccgttattctgaaggacggaccagaaagggtgatacttgcaggtccgatgcctgtcaccgtggcttctgccgcacagcgccgaggcagaatcgggcggaaccataataaagagggagatcagtacatttatatgggccagcccctaaacaatgacgaggatcacgcccactggacagaagctaagatgctgttggacaacatcaatactccagagggtatcattcccgccttatttgaacctgagagggaaaagtccgcggcaatagatggggagtaccgcctgagaggcgaggccaggaaaacgttcgtagaactcatgcggcgtggagacctgccagtgtggcttagctataaggttgcttcagagggctttcaatacagtgatcgccgatggtgcttcgacggggaaagaaacaatcaggtcctggaggaaaacatggatgtggagatctggaccaaagagggagaaaggaagaaactccggccccgctggttggacgccagaacatattctgaccctctggctctaagggagtttaaggagttcgcagccggtcggcgatccgtgagcggcgatctgattctcgagatcgggaaacttccgcagcatctgactcagagagctcaaaatgccttagacaacttggtcatgctgcacaattcagaacagggaggccgcgcatacaggcatgcgatggaggagctcccagataccattgaaacactgatgcttctggccctcatcgctgttttgaccggtggggtgactctgtttttcttaagtggccggggactaggcaagacgagcatagggctgctctgtgtaatggcctcctctgtgcttctgtggatggcaagcgtcgagccccactggatcgctgcctccattatcttggaatttttcctgatggtgctcctgattcctgagcccgaccgtcagagaaccccacaggataaccaacttgcatatgttgtgatcggactcctgtttatgatattgacagtcgccgctaatgagatgggtctgttagaaactaccaagaaagacctaggcattgggcacgtagcggtggagaaccatcaccatgccgcaatgctggatgttgacctccaccctgcttcagcctggacactttacgccgtggcaaccactatcattacacccatgatgaggcatacgatcgaaaacaccactgctaatatatctctgacagccatcgcgaaccaggctgccattttgatgggactggataagggctggccaatcagtaaaatggacattggtgtccctctcctggcacttgggtgctacagccaggtgaatccgttaaccctgaccgccgctgtcctcatgttggtggcacactatgccatcataggccccggactgcaagcgaaggctacacgcgaggcccagaaacggactgcagccggcattatgaagaacccaacggttgatgggatcgtggctatcgacctagatcctgtagtgtacgacgccaagttcgaaaaacagctgggacagattatgctccttatcctgtgtaccagccaaatattgctgatgcgaacaacttgggcactctgcgagtccattaccctggctacaggccccttaaccactctttgggagggttctccagggaagttttggaatacgacaatcgccgtctcaatggcgaacattttcagaggaagctatctggccggcgcaggtctcgctttctccctaatgaaaagtctgggcgggggaaggcgcggcaccggggcccagggagaaactttgggcgagaagtggaaacggcagctgaatcagctctctaagagcgaatttaacacctacaagagatcaggtatcatggaggttgaccgttccgaagcaaaagaggggcttaagaggggagagacaactaaacacgctgtgagtcggggcaccgccaagctgcgctggttcgtcgaacgaaatttggtgaaacctgagggtaaggtaatagatctgggctgtgggagaggaggctggagctattactgcgccgggctcaagaaagtgacagaagttaagggatatacgaaaggcggtcccgggcatgaggaaccgatcccaatggcgacctacggatggaacttagtgaagctgcactctggcaaagacgtctttttcattcctcccgagaagtgtgatactcttctgtgcgacatcggcgagtcctcaccaaatcccacaattgaagaggggaggaccctacgggtgctcaaaatggtcgaaccttggctgcgcggaaaccaattttgtatcaagattttgaatccgtacatgcccagcgtggttgagactctggagcagatgcagagaaagcatggtggcatgctcgtaaggaacccactttcgcgaaattctacacacgaaatgtattgggtgagttgcgggaccggaaacatcgtctccgctgtgaatatgacgagccggatgctgttaaaccgtttcaccatggcacacagaaaacctacatacgagcgcgatgttgacctgggcgccggtactaggcatgtggctgtcgaacccgaggtggccaacttggatataattgggcagcggatcgaaaatatcaagcacgagcataaatcaacctggcactatgacgaggataacccttacaagacatgggcatatcatggatcctacgacgtaaaaccatctggcagcgccagttccatggtgaatggcgttgtcaagctcctgactaagccctgggatgtgattcctatggtgacccaaatagctatgacagacaccactccatttgggcagcagagagtcttcaaagaaaaggttgacacgcgcacacccaaagcgaagaggggaaccgcccaaatcatggaggtgactgcaaaatggctatggggttttcttagccgaaacaagaagccgcggatttgtaccagagaagagttcacaaggaaagtacgctctaatgctgccatcggcgcagtgtttgtcgatgaaaaccagtggaactcagccaaggaggctgtggaggacgaacgtttctgggatctggttcaccgggagagagaactccacaaacaggggaagtgcgccacgtgcgtgtataacatgatgggaaaaagggagaagaagctgggcgaatttggtaaagcgaaggggagtcgcgcaatttggtacatgtggttgggagcccgattcctggagttcgaggctctcggctttatgaatgaagaccattggttctcccgggagaacagcctttctggcgtcgaaggggagggactgcacaaattaggttacatcctgagagatatatcgaagatccctggcgggaatatgtatgccgacgataccgcaggatgggacactaggattacagaggatgacttgcagaacgaagctcgcatcaccgatattatggagccagaacatgccctcctggctaaatcaatctttaagctaacttaccaaaataaagtggtaagagttcagcggcccgccaagaacggcacagtgatggacgtcataagcaggcgtgatcagcgaggttccggacaggtgggaacctatggccttaatacattcactaacatggaggcacaactgattcgccagatggaaagtgagggcatcttttctcctagcgagctcgaaaccccaaacctggcggagagagtgttggactggttaaagaaatacggggtcgaacggctgaagaggatggccatctccggagacgattgtgttgtgaaacccattgacgatcgcttcgctacggccctcaccgcacttaatgacatgggtaaggtaagaaaagatataccgcagtgggagccttcaaagggctggaacgactggcagcaagtgcccttttgcagtcaccacttccatcagctgatcatgaaggatgggcgggaaattgtcgtgccatgtaggaatcaggacgagctagttggacgagctcgtgtgtctcagggcgccggttggagcctgagagagacagcatgcctcgggaaatcctatgcccaaatgtggcagttgatgtactttcaccgccgggatctgaggcttgcggctaacgccatctgttcagcagtccctgtggactggattcccactagcagaaccacatggtctatccatgcccaccatcagtggatgactaccgaagatatgctgtccgtatggaatcgcgtttggatagaggaaaacccatggatggaggacaagacgcacatcagtagctggggagacgtgccctatctcggcaaacgggaagatcaatggtgcggctcgttaattgggctgacagctagggccacctgggcaactaatatccaggtcgctattaaccaggtgcgaagattgatcggaaatgagaactacctggactacatgacatccatgaagcggttcaaaaatgagggtgatcctgaaggcgccctctggtga

SEQ ID NO: 13607 - RNA, 9879 nt, synthetic construct
  misc_feature 1..9879: note = derived and/or modified CDS sequence (opt3) from DENV-1__FJ390383__SS-prME
  source 1..9879: mol_type = other RNA
agcgtgaccatgctgctcatgcttatgcccacggccctggctttccacttgactacgagaggaggggagcctcatatgatcgtctccaagcaggaaagagggaaatctttactgtttaagacctcagccggtgttaatatgtgcacactaattgccatggacctcggagagctgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccggcagcttcaaactggagaaggaagtcgccgagacgcagcacggtacagtgcttgttcagataaagtacgagggcaccgacgctccttgcaaaatcccattcttgactcaagatgaaaagggggtgacacagaacggacgcctgattaccgcgaatcccatcgtaactgacaaagagaagcctgtcaacatagaagcagagccaccctttggcgagtcgtatattatcatcggtgccggggaaaaagctctcaagctgtcttggttcaagaaaggctcctcaattggaaagatgtttgaggccaccgcaagaggcgccaggcggatggctatccttggggatacagcctgggacttcggaagtattggtggcgtgtttacgagcgttgggaaactggtgcatcagatattcggaaccgcatacggcgtcttgttttccggtgtgtcttggactatgaagatcgggattggcgtactcctgacatggttaggactgaatagccgatcaaccagtctatccatgacatgtatcgcggtgggcctcgttactctgtaccttggggtcatggtgcaggctgatagcggatgcgtgatcaactggaaaggccgcgaattgaagtgtggttctgggattttcgtcaccaatgaggttcacacgtggacagaacaatataagtttcaggccgactcaccgaaaagactgagtgcagccataggaaaggcttgggaggagggcgtgtgcggtatcaggagcgccacccggctcgaaaacattatgtggaaacagatctccaacgagctgaatcatattttactggaaaacgacatgaagttcactgtggtagtcggcgatgtggcagggatccttgctcagggcaagaagatgatacgccctcaacccatggagtacaaatattcttggaagtcgtggggcaaggccaaaatcattggggcggacgttcagaataccacatttatcattgatggaccaaacactcctgaatgtcccgacgatcagagagcctggaatatctgggaggtggaggactacggcttcggtatatttaccacaaacatttggttgaagctcagggatagctatacgcaggtctgcgaccaccgtctgatgtccgctgcaatcaaagattcaaaggccgtgcacgctgacatggggtactggattgaaagtgagaaaaatgaaacctggaagctagcccgggcatctttcatcgaggttaagacttgtatatggccaaaaagccatacactgtggtccaacggagtgctcgaatcagagatgatcattcccaagatctatggcggtcctattagccaacacaattaccgaccaggctacttcacccagactgcggggccgtggcatctgggaaaacttgagttggattttgacctgtgcgaaggcacaaccgtagtcgtggatgagcactgcgggaacagaggaccctctttaaggacgactaccgtgacaggcaagatcatacacgaatggtgttgccgctcctgtaccctccctccactgcggttcagaggtgaggacgggtgctggtatggaatggagattaggcccgtcaaagaaaaggaggaaaatcttgttaagagtatggtgagcgccggctctggtgaggtagactccttttcactgggcttgctctgtatcagtatcattatcgaagaggtgatgcgcagccgatggtcgcggaaaatgctgatgactgggacactagctgtcttctttctgctcattatgggacagctgacctggaacgatcttatacgtttgtgcatcatggtgggcgccaatgcatccgacagaatggggatgggaacaacttacctggctttaatggccaccttcaagatgaggcctatgtttgcagttggcctcctgttccgccggcttacgtctagagaggtgctgctactcacaattggtctgagcttggtcgcctcagtggaactgccaaacagtttagaggaactcggggatggactggctatgggcatcatgattcttaaactgttgaccgactttcaatcccatcagctctgggcgactctgctatctctgaccttcatcaagacaacttttagccttcactatgcctggaaaaccatggcaatggttctctccatagtgtcactgttccccttgtgtctgagcacgacaagtcagaagaccacttggttaccggtcctcctgggctctcttgggtgcaagcctctgacaatgtttttgatcgctgagaataaaatttggggaaggcgatcctggccactcaacgaaggtatcatggccgtaggcattgtgagcatcctgctatcgtcactgcttaagaacgatgagcccctcgccgggcctctgatagctggaggcatgttgattgcatgttacgttatctctggtagttccgccgacttaagcctggagaaagcggctgaagtgtcttgggaggaagaggccgaacatagcggggcatcccacaatatcctcgtcgaggtgcaggatgacggaaccatgaagattaaagatgaggaacgcgacgatactctgacaatacttctgaaggccaccttgctagctgtatcaggcgtgtatcccctgagtatcccagcaacactcttcgtctggtacttctggcagaagaagaagcagcggagcggcgttctgtgggacactccttctcccccagaggtggaaagagccgtgcttgatgacgggatttataggatcatgcagcgtggattactgggtcgctcccaggtcggcgtgggggtttttcaagagaacgtattccataccatgtggcacgtgacacggggagcggtcctcatgtaccagggcaaaagattggagccgtcatgggctagtgtgaagaaagacctgattagctacggtgggggatggaggctccagggctcctggaataccggcgaagaggttcaggtgatcgccgtcgaacctgggaagaaccccaaaaatgtgcaaacagcaccaggaacttttaagacccccgagggtgaagtaggcgccatagctctggatttcaagcctgggacgtctggatcgccaatcgtcaaccgagagggcaaaattgtgggtctttatgggaatggagttgtgacaactagcggcacctacgtctcagccatcgcacaggctaaggcctcccaggagggccccctgcctgaaattgaggacgaagtgtttcggaaacgcaacttgacaatcatggatctacacccggggagtggaaagaccagaaggtatctgccagcgatagttcgggaggccattaaacgaaagctcagaactttaatcctggcacccacccgcgtggtcgcttctgaaatggccgaggctcttaagggtatgcctatcaggtaccaaacaacggcagtgaaaagcgagcatactggcaaggaaattgtagacctgatgtgccacgccaccttcacaatgcgtctcttgtccccagtgcgggttcccaattataacatgatcataatggatgaggcccattttaccgacccttcatctattgctgcgagagggtacatcagcactagggtcggaatgggcgaagcagccgctattttcatgacagccaccccgcccggtagtgtggaggcatttccacagtccaatgccgtgatccaggatgaggaacgcgacatacctgagcgaagctggaactctgggtatgaatggattacggatttccccggaaaaactgtctggtttgtaccatcaatcaagtccggcaatgacatcgctaactgtctgaggaaaaatggcaagcgggtgattcagctcagtaggaagacattcgataccgagtaccagaaaaccaagaacaacgactgggactacgttgtgactacagatatcagcgaaatgggggcgaatttccgcgccgaccgtgtcattgatcctagacggtgcctgaaacccgtgatacttaaggacggaccagagagggttatcctagcaggtccgatgcctgtgaccgtcgcttcggccgcacagcgccgaggcagaattgggcggaaccacaataaagagggagatcagtatatctacatgggccagcccctgaacaatgacgaagatcatgcccactggacagaggctaagatgttgttagacaacatcaatactccagaaggtattatacccgccctgtttgagcctgaaagggagaagtctgcggcaatcgatggggagtatcgcctcagaggcgaagccaggaaaacgttcgtggagctgatgcggcgtggagaccttccagtatggctgtcctacaaggtggctagcgaaggctttcaatattcagatcgccgatggtgcttcgacggggagagaaacaatcaggttctcgaagagaacatggatgtcgagatttggaccaaagaaggagagaggaagaaattgcggccccgctggctggacgccagaacatacagtgaccctctagctctgagggaatttaaggagttcgcagccggtcggcgatctgtgtccggcgatctcatccttgaaattgggaaactgccgcagcacttaactcagagagctcaaaatgccttggacaacctggtgatgctccataatagcgagcagggaggccgcgcatataggcacgcgatggaggaactgccagataccatcgagacacttatgctgctcgccttgatagctgtcctgaccggtggggttactttatttttcctatcaggccggggactgggcaagacgagtatcgggctcctttgtgtgatggccagctccgtactgttgtggatggcatctgtggaaccccattggattgctgccagcatcattctggagtttttcctcatggtcctgcttatccctgagcccgaccgtcagagaaccccacaggataaccaactcgcatacgtggttataggactgttgtttatgattctgacagtggccgctaatgaaatgggtttactagagactaccaagaaagacctgggcatcgggcacgtcgcggtagaaaaccaccatcacgccgcaatgctcgatgtggaccttcatcctgcttccgcctggacactgtacgccgttgcaaccactattatcacacccatgatgaggcacacgatagagaacaccactgctaatatctcattgacagccattgcgaaccaggctgccatcctgatgggactcgataagggctggccaatttctaaaatggacatcggtgtgcctctgcttgcattagggtgctatagtcaggtcaatccgctgaccctcaccgccgctgtgttgatgctggtcgcacattacgccataattggccccggactacaagcgaaggctacacgcgaagcccagaaacggactgcagccggcatcatgaagaacccaacggtggatgggatcgttgctattgacctggatcctgtggtatatgacgccaagttcgagaaacagctcggacagatcatgcttctgatattgtgtacctcgcaaattctgctcatgcgaacaacttgggcactgtgcgagagcatcaccttagctacaggcccccttaccactctgtgggaaggttccccagggaagttttggaatacgacaattgccgtgtctatggcgaacatcttcagaggatcatacctcgccggcgcaggtctagctttcagcctgatgaaatccttgggcgggggaaggcgcggcaccggggcccagggagagactctgggcgaaaagtggaaacggcagctcaatcagcttagtaagtctgagtttaacacctataagagaagcggtataatggaagtcgaccgttcagaggcaaaagaggggctgaagaggggagaaacaactaaacacgctgtttcccggggcaccgccaagttgcgctggttcgtggagcgaaatctggtcaaacctgaaggtaaggtgatcgatctcggctgtgggagaggaggctggagttactattgcgccgggttaaagaaagtaacagaggtgaagggatacacgaaaggcggtcccgggcacgaggaaccgattccaatggcgacctacggatggaacctggttaaacttcatagcggcaaagacgtgtttttcatccctcccgagaagtgtgatactctgctatgcgacattggcgaatcttccccaaatcccacaatcgaggaagggaggaccctccgggtcctgaaaatggtggagccttggttgcgcggaaaccaattttgtattaagatcctgaatccgtatatgccctcagtcgtggagactctcgaacagatgcagagaaagcacggtggcatgcttgttaggaacccactgagccgaaattcgacacatgagatgtactgggtatcttgcgggaccggaaacatagtgagtgctgtcaatatgacgtcccggatgttactgaaccgtttcaccatggcacacagaaaacctacatatgaacgcgatgtggacttgggcgccggtactaggcacgttgctgtggagcccgaagtcgccaacctcgatattatcgggcagcggatcgagaatattaagcatgagcacaaaagcacctggcattacgacgaagataacccttataagacatgggcataccacggatcatatgaggtgaaaccatccggctctgccagcagtatggtaaatggcgtggttaagctgctaactaagccctgggacgtcatacctatggtgacccaaatcgctatgacagataccactccatttgggcagcagagagtgttcaaagaaaaggtcgacacgcgcacacccaaagcgaagaggggaaccgcccaaattatggaggttactgcaaaatggctttggggttttctgtcccgaaacaagaagccgcggatctgtaccagagaagagttcacaaggaaagtgcgcagcaatgctgccattggcgcagtatttgtggacgagaaccagtggaactctgccaaggaagctgtcgaggatgaacgtttctgggacctcgtgcatcgggagagagaactgcacaaacaggggaagtgcgccacgtgcgtttacaacatgatgggaaaaagggagaagaagttgggcgagtttggtaaagcgaaggggtcacgcgcaatctggtacatgtggctgggagcccgattcctcgagttcgaggctcttggctttatgaatgaagatcactggttcagtcgggagaactccctgagcggcgtggagggggaaggattacataaactgggttatatattgagagacatctctaagattcctggcgggaatatgtacgccgatgacaccgcaggatgggatactaggatcacagaggacgatctccagaacgaagctcgcattaccgacatcatggagccagaacacgccctgctagctaaatcgatatttaaacttacttatcaaaataaagtcgtgagagtacagcggcccgccaagaacggcacagttatggatgtgatttcaaggcgtgaccagcgaggtagcgggcaggtcggaacctacggcctgaatacattcactaacatggaggcacaactcatccgccagatggagtccgaaggcatctttagtccttctgagctggaaattccaaacttggcggagagagtgttagattggctggaaaagtatggggtggagcggctcaaaaggatggccataagcggagacgactgtgtcgttaagcccatcgatgaccgcttcgctaccgcccttacggcactgaatgatatgggtaaagtgagaaaggacattccgcagtgggagccttccaaaggctggaacgattggcagcaagtacccttttgctcacatcacttccaccagctaatcatgaaggacgggcgggaaattgtggtcccatgtaggaatcaggatgagctggtgggacgagctcgtgttagtcagggcgccggttggtctctcagagaaaccgcatgcttgggaaagagctacgcccaaatgtggcagctgatgtattttcatcgccgggaccttaggctggcggctaacgccatctgttccgcagtgcctgtcgattggatacccacatcaagaactacctggagcatccacgcccatcaccagtggatgacaactgaggacatgctctctgtgtggaatcgcgtatggattgaagagaacccatggatggaggataaaacccatatctccagttggggagacgttccctacttaggcaagcgggaagaccaatggtgcggcagcctgattgggttgacggctagggccacatgggcaaccaatatccaggtggctattaaccaggtccgaagactgataggaaatgagaactacctcgattatatgacttcgatgaaacggttcaagaatgaaggtgaccctgagggcgccctttggtga

SEQ ID NO: 13608 - RNA, 9879 nt, synthetic construct
  misc_feature 1..9879: note = derived and/or modified CDS sequence (opt3) from DENV-1__FJ182033__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagctgtgtgaagatactatgacctacaaatgcccacggataacagaggtggaaccggacgatgtagactgttggtgcaataccactgatacatgggtgacctatgggacgtgtagtcaaactggagagcaccgccgagacaagcgtagcgtcgcgcttgctccccatgtgggcctgggtttggagaccagagccgaaacatggatgtcctctgagggggcatggaaacagatccagaaggttgaaacttgggccctcaggcaccctggattcaccgtgattgctctgtttctggcacatgccatcggcacatcgattacccagaagggcatcatattcatcctcttaatgctggtcacgccatcaatggctatgcggtgcgtggggattggaagccgcgattttgtagagggtcttagtggcgccacttgggttgacgtggtcttggagcacgggtcctgtgtgacaaccatggcgaaagataagcccactctggacatcgaactactcaaaacagaggtgaccaaccctgcagtcctgagaaagctttgcattgaagccaaaatctctaatacgaccacagatagcaggtgtccaactcaaggagaggctaccctggttgaagagcaggacgccaacttcgtgtgccggcgcacatttgtagatcgaggctggggtaatgggtgtggattgttcggcaagggctccctcataacttgcgcaaagtttaaatgcgtgaccaagctggaggggaaaattgtccagtacgaaaacttaaagtattcagtgatcgttacagtgcacaccggagaccagcatcaagtcggtaatgagagtactgaacacggcacgacagctaccattactccccaggcccctaccagcgagatccagctgacagactacggggcgctcacccttgattgttctccaagaactggactggacttcaacgaaatggtgttgctaacaatgaaagagaagtcctggctggtacataaacagtggtttctcgatctgccgcttccctggacgtcaggcgccagcaccagtcaagagacttggaataggcaggacctgttggttacattcaagaccgcacacgctaagaaacaggaagtggtcgtgctcggttctcaagagggggccatgcacacagctctgactggcgccaccgaaatccagacgtccggaaccacaactatttttgcaggccatttaaagtgccggctgaaaatggataagctaaccctcaaagggatgagctatgtcatgtgtacaggatcgttcaagctggagaaggaagtggccgagactcagcacggtaccgttcttgtgcagataaaatacgagggcacggacgctccttgcaagatcccattctctacacaagatgaaaaaggggtaacccagaacggacgtttgattactgcgaatcccatcgtcacagacaaggagaaacctgtgaacatagaagcagagccaccctttggcgagtcctatattgttatcggtgccggggaaaaggctctgaagctctcatggttcaaaaagggcagtagcatcggaaaaatgtttgaggccaccgcacgcggcgccagaaggatggctattctgggggatactgcctgggacttcggatccatcggtggcgtgtttacctctattgggaagcttgtccatcagatattcggaacagcatacggcgtgctgtttagcggtgtatcatggacgatgaaaatcgggattggcgtgttgctcacctggctgggattaaatagtcggtccactagcctgtctatgacatgtatcgcggttggcctagtcaccctctacctgggggtgatggtgcaggctgattcaggatgcgtcatcaactggaagggccgagaacttaagtgtggtagtgggattttcgttacaaatgaggtgcacacttggaccgaacaatataaatttcaggccgacagcccgaagcgcttgtccgcagccataggaaaagcttgggaggagggcgtgtgcggtatcagatctgccacgaggctggaaaacattatgtggcggcagatctcgaacgagctcaatcatattctgttagaaaacgacatgaagttcacagtagtcgtgggcgatgttgtggggatcctggcacagggaaaaaagatgatacgccctcaacccatggagcacaaatacagctggaagtcctggggcaaggctaaaatcattggggccgacgtccagaataccacttttatcattgatggaccaaacacccctgaatgtcccgacgatcagagagcgtggaatatctgggaggtggaggactatggcttcggtatatttacaactaacatttggcttaagttgagggattcatacacccaggtttgcgaccaccgtctcatgagtgccgctatcaaagattctaaggcagtgcatgccgacatggggtattggattgaaagcgagaaaaatgaaacatggaagctggctcgggcctccttcatcgaggtaaagacgtgtatatggccaaaatcacacaccctatggagcaacggagtcctggaatctgagatgatcattcccaagatctacggcggtcctatttcccaacataattatcgaccaggctacttcactcagacagcagggccgtggcacctcggaaaactggagcttgattttgacttgtgcgaaggcaccactgtggtggtcgatgagcactgcgggaacagaggacccagtctgaggacaaccacggttactggcaagatcatacatgaatggtgttgccgcagctgtaccttacctccactccggttcaaaggtgaggacgggtgctggtacggaatggagattagacccgtgaaggaaaaggaggaaaatctggtaaaatctatggtgtccgcgggctcaggtgaggtcgacagttttagccttggcctgttgtgtatctcgatcatgattgaagaggtgatgaggtcccgctggtctcgaaagatgctcatgacagggaccctggccgttttctttctactgatcatgggacagctcacttggaacgatctgattcggagctgcataatggtgggcgctaatgcctcagaccgtatggggatgggaacaacctatcttgcattgatggctacattcaaaatgagacctatgtttgccgtcggcctgttattcaggcgcctcactagtcgggaggtgctgcttctgaccatcggtctatccctcgttgcatctgtggaactgccaaacagcttggaggaactgggggatggattagccatgggcattatgatcctcaagctgcttacggactttcaatcctaccagctgtgggctacattgctctcactgaccttcattaaaactacctttagcctacactatgcgtggaagacaatggccatggtcctgagtatcgtatctcttctccccctgtgtttgtccactaccagccagaagacgacatggctgccggtgttactcggctcgctggggtgcaaacctcttaccatgttcctgatagcagagaataagatctggggaagaaaatcatggccattgaacgaaggtattatggctgttggcatcgtgtctattctcctgagttccctactgaagaacgatgtcccccttgccgggcctctcatcgccggaggcatgctgatagcttgttacgtgattagcggttctagcgcagacttgtccttagagaaagccgcggaggtatcatgggaagaggaagctgagcatagtggggccagccacaatatcctggtggaagtccaggatgacggaactatgaagatcaaagatgaggagagggacgatacactcaccattctgcttaaggcaactctgttggccgtttctggcgtgtatcccctatccataccagctacactgtttgtgtggtacttctggcaaaagaaaaagcagcgatcaggcgtcctctgggacacccctagtcccccagaagtggagcgcgcagttctggatgacgggatctatcggattatgcagagaggacttttaggtaggagccaggtaggcgtgggggtcttccaagaaaacgtgtttcatacgatgtggcacgttactcgtggagccgtgctgatgtaccagggcaaacgcctcgagccgtcctgggcgtctgtcaagaaagacttgatctcgtacggtgggggatggcggctgcagggcagctggaataccggcgaggaagtgcaggtaattgctgtcgagcctgggaagaaccccaagaatgtgcaaacagccccaggaaccttcaaaacacccgaaggtgaggttggcgcaatcgccctcgattttaagcctgggacttcaggatccccaatagtgaacagagaaggcaaaatcgtcggtctgtatgggaatggagtggttaccacgagtggcacatacgtgtctgctattgcccaggcaaaggctagccaggagggcccccttcctgagatcgaagacgaggtcttcaggaaacgaaacctgactattatggatttgcacccggggtccggaaagacccggcgctatctaccagccatcgtgagagaagcgataaagaggaaactgcggacactcattttagcccccacccgagtagtggcatcagagatggctgaagccctgaagggtatgcctatcagataccaaactaccgctgttaaatctgagcatacaggccgcgagatcgtcgaccttatgtgccacgcaacgtttactatgaggctgctcagcccagtgcgtgtgcccaattataacatgattatcatggatgaagcccatttcaccgaccctagttccatagccgctcgggggtacattagcacaagagtcggaatgggcgaggcggcagccatctttatgaccgctactccgcccggttctgtagaagccttcccacagtcaaatgcagtgattcaggatgaggaaagggacatccctgagcgctcctggaacagtgggtatgagtggataacagattttcccggaaagaccgtttggttcgtgccaagcattaaatcgggcaatgacatcgccaactgtttgcgaaagaatggcaagagagtcatccagctgtctcggaaaacgtttgatactgaataccaaaagacaaaaaacaacgactgggactacgtggttaccaccgatatttccgagatgggggctaatttcagggcggaccgcgtgatcgatcctcgtagatgcctcaagcccgtcattctgaaagacggaccagaacgggtgatacttgccggtccgatgcctgtaactgtggcaagcgctgcccagaggcgcggccgaatcgggagaaaccacaataaggagggagatcagtatatttacatgggccagcccctaaacaatgacgaggatcatgcacactggacagaagccaagatgctgttggacaacatcaataccccagagggtatcattcccgctttattcgaacctgagcgggaaaaatcagccgcgatagatggggagtataggctgcgcggcgaggcaagaaagacatttgttgaactcatgaggcggggagacctgccagtctggcttagttacaaagtggcctctgagggcttccaatattccgatcgtcgctggtgctttgacggggaacgaaacaatcaggtgctggaggaaaacatggatgtcgagatctggactaaggagggagaaagaaaaaagctcaggccccggtggttggacgctcgcacgtacagcgaccctctggccctaagagagttcaaagaatttgctgcaggtaggcggtcagttagtggcgatctgattctcgagatcgggaagcttccgcagcacctgacccagcgagcccaaaatgctttagacaacttggtgatgctgcataatagcgaacagggaggcagagcctatcgccacgcaatggaggagctcccagatacaattgaaactctgatgcttctggcgctcatcgccgtattgaccggtggggtgacactgttctttttatccggcaggggactaggcaagacctctatagggctgctctgtgtcatggctagctccgcccttctgtggatggcatcagtggagccccattggatcgctgcctctattatcttggaattctttctgatggttctcctgattcctgagcccgaccggcagcgtactccacaggataaccaacttgcatacgtggtcatcggactcctgttcatgatattgacggtagccgctaatgagatgggtctgttagaaaccacaaaaaaggacctaggcattgggcacgtggcggttgagaaccaccatcacgccactatgctggatgtggacctccatcctgcaagtgcttggaccctttacgccgtcgccacaaccatcattactcccatgatgagacacacaatcgaaaacacgaccgcaaatatatcgctgactgctatcgccaaccaggcggctattttgatgggactggataaaggctggccaatcagcaagatggacattggtgtgcctctcctggcccttgggtgctattcccaggtcaatccgttaacactgaccgcagccgtgctcatgttggttgctcattacgcaatcataggccccggactgcaagccaaagcgaccagggaggctcagaagcgcacagccgcaggcattatgaagaacccaactgtggatgggatcgtagccatcgacctagatcctgtggtctatgacgctaaatttgaaaagcagctgggacagattatgctccttatcctgtgtacgtctcaaatattgctgatgcggaccacatgggccctctgcgagtcaattactctggcaaccggccccttaacaaccctttgggagggtagcccagggaaattctggaatactacgatcgctgtttccatggccaacatttttcgaggaagttacctggcgggcgccggtctcgcattctctctaatgaagagcctgggcgggggaagaaggggcacaggggctcagggagaaaccttgggcgagaaatggaagcgccagctgaatcagctctcaaagtccgaattcaacacttataaacggagtggtatcatggaggtggacagaagcgaagccaaggaggggcttcgtaggggagagaccacaaaacacgcagtctctcggggcactgctaagctgcgctggtttgtggaacgaaatttggtaaaacctgagggtaaggtgatagatctgggctgtgggagaggaggctggtcctactattgcgccgggctcaagaaagttaccgaagtgaagggatacacaaaaggcggtttagggcacgaggaacccatcccgatggccacgtacggatggaacctggtcaagcttcattcaggcaaagacgtgttctttattccacctgagaagtgtgataccctgctatgcgacatcggcgagagctcgcccaatccaactattgaagaggggaggacactccgggtcctgaaaatggtggaaccctggttgcgcggaaaccaattctgtatcaagattctgaatccttatatgccgtctgttgtagagaccctcgagcagatgcagagaaagcacggtggcatgcttgtgaggaaccccctgagtcgaaattccactcatgaaatgtactgggtcagctgcgggacaggaaacatcgtgtcagcggttaatatgacctcccggatgttactgaaccgttttacgatggctcacagaaaaccaacctatgagcgcgatgtggacttgggcgcaggtacaaggcacgtcgccgtggaacctgaggtagctaacctcgatataattgggcagcggatcgaaaatatcaagcatgagcacaaatctacttggcattacgacgaggataacccctataagacctgggcctaccacggaagctatgaagtgaaacctagtggctccgcaagctctatggttaatggcgtcgtgaagctgctaacaaagccatgggacgtgattcccatggtcactcaaatagccatgaccgatacaacccctttcgggcagcagagagtttttaaagagaaggtggacactcgcacgccaaaagctaagaggggaacagcgcaaatcatggaagtaaccgcccgatggctttggggtttcctgtcacggaacaaaaagcccagaatttgtactagggaggaatttacccgcaaggtgcgtagtaatgcagctatcggcgccgtcttcgtggacgagaaccagtggaattccgcaaaagaggccgttgaagatgagcggttttgggacctcgtgcatagagaaagggagctgcacaagcaggggaaatgcgctacatgcgtctacaacatgatgggaaagcgcgaaaaaaagttgggcgagttcggtaaggccaaagggagccgagcgatttggtacatgtggctgggagcacggtttctcgagttcgaagcccttggcttcatgaatgaggatcactggttttctagagaaaactcgctgtcaggcgtggagggggagggattacataagctgggttatatcttgagggacataagcaaaatcccgggcgggaatatgtacgctgatgacacggccggatgggatacccgcattactgaagacgatctccagaacgaggcaaagatcacagacattatggaacctgagcacgctctgctagccacctccatcttcaaacttacttatcaaaataaggtagttagagtgcagcggccagctaggaacggcacagtcatggatgtgataagtcgtcgagaccagcgcggttctgggcaggtgggaacctacggcctgaatacatttactaacatggaagcccaactcattagacagatggagagcgagggcatcttcctgccctccgaattggagacccctaacttagcagaacgggtcctggattggctcgagaaacatggggttgaaaggcttaagcgcatggcgatctcaggagacgactgtgtggtaaagccaattgatgacagatttgccacggctctgaccgccctaaatgatatgggtaaagtgcggaaggacataccccagtgggagccgagtaaaggctggaacgattggcagcaagtccctttctgctctcaccactttcatcagctgatcatgaaggacgggagggagattgtggttccctgtcgaaatcaggatgaactcgtgggacgtgcaagagtcagccagggcgctggttggtccttgcgcgagacagcctgcctggggaaatcatatgcacaaatgtggcagcttatgtacttccaccggagggacctgagactcgccgcgaacgctatctgtagcgccgtgccagtagattgggttcctacttctcgcaccacatggtccattcatgcacaccatcagtggatgactaccgaagacatgttaagtgtgtggaatcgggtctggatcgaggaaaacccctggatggaggataagacgcacataagctcgtggggagacgtgccatatctgggcaagagggaggaccaatggtgcggctccttgatcgggctgacagcccgagctacctgggccactaatattcaggttgcaatcaaccaggtgagacggctcattggaaatgaaaactaccttgattacatgacatctatgaaaaggtttaagaatgagtcagaccccgaaggtgctctgtggtga

SEQ ID NO: 13609 - RNA, 9879 nt, synthetic construct
  misc_feature 1..9879: note = derived and/or modified CDS sequence (opt3) from DENV-1__FJ182034__SS-prME
  source 1..9879: mol_type = other RNA
agcgtgaccatgctgctcatgcttatgcccaccgcactggctttccacttgactacgagaggaggggaacctcatatgatcgtctccaagcaggaaagggggaaatctttactgtttaagacctcagccggtgttaatatgtgcacactaattgccatggacctcggcgaactgtgtgaagatactatgacctacaaatgcccacggattacagaagcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccgtgctgaggaaactttgcattgaagctaagatctctaatacgaccacagatagccggtgtccaactcaaggagaggccaccctggtcgaagaacaagacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctagcaccgagatccagctgacagactacggggccctcacccttgattgttctccaaggactggactggacttcaacgaaatggtcttgctaacaatgaaggagaaatcctggctggtgcataagcagtggtttctcgatctgccgcttccctggacgtcaggcgcaagcaccagtcaagagacttggaatcggcaggacctgttggtaacattcaaaaccgctcacgccaagaagcaggaagttgtggtcctcggttctcaagagggggctatgcacacagccctgactggcgcaaccgaaatccagacgtccggaaccacaactatttttgccggccatttaaaatgccgtctgaagatggataaactaaccctcaaggggatgagctatgtgatgtgtacaggatcgttcaaactggagaaggaagtcgctgagactcagcacggtaccgtgcttgttcagataaagtacgagggcacggacgcgccttgcaaaatcccattctctacacaagatgaaaagggggtgacccagaacggacgcttgattactgcaaatcccatcgtaacagacaaagagaagcctgtcaacatagaagccgagccaccctttggcgagtcctatattgtgatcggtgctggggaaaaagccctgaagctctcatggttcaagaaaggcagtagcatcggaaagatgtttgaggcaaccgccagaggcgctaggcggatggccattctgggggatactgcatgggacttcggatccatcggtggcgtttttacctctgtggggaaacttgtccatcagattttcggaacagcgtacggcgtgctgtttagcggtgtatcatggacgatgaagatagggatcggcgtgttgctcacctggctgggattaaatagtcgatccactagcctgtctatgacatgtattgctgttggcctagtcaccctctacctgggggtgatggtgcaggccgattcaggatgcgtcatcaactggaaaggccgcgaacttaagtgtggtagtgggatcttcgttacaaatgaggtgcacacttggaccgaacaatataagtttcaggcagacagcccgaaaagattgtccgccgctattggaaaggcctgggaggagggcgtgtgcggtataaggtctgcaacgcggctggaaaacatcatgtggaaacagatttcgaacgagctcaatcatatcctgttagaaaacgacatgaagttcacagtagtcgtgggcgatgttgctgggattctggcccagggcaagaaaatgatccgccctcaacccatggagtacaaatatagctggaagtcctggggcaaggcgaaaataatcggggccgacgtgcagaataccacttttattatcgatggaccaaacacccctgaatgtcccgacgatcagagagcttggaatatttgggaggtcgaggactacggcttcggtatctttacaactaacatatggcttaagttgagggattcatatacccaggtgtgcgaccaccgtctcatgagtgcagccattaaagattctaaggctgttcacgccgacatggggtactggatcgaaagcgagaaaaatgaaacatggaagctggcacgggcgtccttcattgaggtgaagacgtgtatctggccaaaatcacataccctatggagcaacggagtactggaatctgagatgataatccccaagatttatggcggtcctatctcccaacacaattaccgaccaggctacttcactcagacagccgggccgtggcatctcggaaaactggagcttgattttaacttgtgcgaaggcaccactgtcgtggtggacgagcactgcgggaatagaggacccagtctgaggacaaccacggtcactggcaagattatccacgaatggtgttgccgcagctgtaccttacctccactccggttcaaaggtgaggatgggtgctggtatggaatggagataagacccgttaaggaaaaggaggaaaacctggtgaaatctatggtatccgctggctcaggtgaggtggacagttttagccttggcctgttgtgtatttcgatcatgatcgaagaggtcatgaggtcccgctggtctcgaaagatgctcatgacagggaccctggccgtgttctttctactgattatgggacagctcacttggaatgacctgatccggctttgcattatggttggcgcaaacgctagcgatcgtatggggatgggaatgacatacttggccctgatggcaaccttcaaaatgagacctatgttagccgtgggcctcctgtttaggcgccttacatcacgggaggtcctgctactcactataggtctgagtttggtggcttccgttgaactgccaaattctttagaggaactcggggacggactggcgatgggcatcatgattcttaagctgttgaccgatttccaaagccatcagctctgggccacgctgctatccctgacatttatcaaaaccacttattcacttcactacgcatggaagaccatggctatggtgctcagcattgtcagtctgttccccttgtgtctgtctacaacttcccagaagaccacgtggttaccggtactcctgggcagccttgggtgcaaacctctgacaatgtttttgatcgccgagaacaagatatggggaagaaaatcgtggccactcaacgaaggtatcatggccgtgggcattgtttcaatcctgctatctagtctgcttaagaatgacgtgcccctcgctgggcctctgattgcaggaggcatgttgatcgcctgttatgtcatatccggtagctctgcggatttaagcctggagaaagctgccgaggtgtcctgggaagaggaagcagagcattcaggggccagtcacaacattctcgtagaagtgcaggacgatggaaccatgaagatcaaagacgaggagagggatgacactctgacaatccttctgaaggctaccttgctagcagtcagcggcgtttaccccctgtctattccagccactctcttcgtgtggtatttttggcaaaagaaaaagcagcgatccggcgtgctgtgggatacaccttcacccccagaagtcgagcgcgcggtgcttgacgatgggatataccggatcatgcagagaggattactgggtaggagtcaggttggcgtaggggtgttccaagaaaatgtcttccataccatgtggcacgtgacgcgtggagctgttctcatgtaccagggcaaacgcttggagccgagctgggcctccgtgaagaaagacctgatttcttatggtgggggatggcggctccagggctcgtggaacactggcgaggaagtccaggtgatcgcagtagagcctgggaagaatcccaagaacgtccaaaccgccccaggaacatttaaaaccagcgaaggtgaggtgggcgctattgccctggacttcaagcccgggacatcaggatcccctatcgttaatagagaaggcaaaatagtgggtctttacgggaacggagtcgtgactaccagtggcacgtatgtttctgcaatcgctcaggccaaggcgagccaggagggcccactgcccgagattgaaaatgaggtgtttaggaaacgaaacttgacaatcatggatctacaccctgggtccggaaagactcggcgctacctgccggccattgtcagagaagcaatcaagaggaaactccggaccttaatactggctccaacacgagtggtagcctcagagatggctgaagcacttaagggtatgcccattagatatcaaaccactgccgtgaaatctgagcataccggcaaggagatcgttgacctgatgtgccacgccacattcacgatgcgcctcttgagccctgtcagggtgccaaattacaacatgatcattatggatgaagctcattttactgaccccagttccatcgcggcacgtgggtatataagcacccgggtgggaatgggcgaggccgctgccattttcatgacagcaacccctccgggttctgtcgaagcctttccccagtcaaatgctgtaatccaggatgaggaaagagacattccagagaggtcctggaacagtgggtacgagtggatcactgatttccctggaaaaacagtgtggtttgttcccagcataaagtcgggcaatgacattgcgaactgtctgcgcaagaacggcaaacgagtgatccagctctctagaaagaccttcgatacggaataccagaagactaagaataacgactgggattatgtcgtgacaaccgacatctccgagatgggggccaattttcgggcagacagggttattgatccacgccgttgcctgaaacctgtgatccttaaggacggacccgaaagagtcattctagctggtccaatgccggtgaccgtagccagcgcagcccagcggaggggccgcatagggcgaaaccacaataaggagggagatcagtacatctatatgggccagcctctgaacaatgacgaggatcatgctcactggactgaagccaaaatgttgttagacaacattaatacacccgagggtatcatcccagcgctgttcgaacccgagagagaaaagtcagcagccattgatggggagtaccggctcaggggcgaggctcgcaaaaccttcgtggaactgatgagaaggggagaccttcctgtttggctgagttataaggtcgcctctgagggctttcaatactccgatcggcgttggtgcttcgacggggaacgcaacaatcaggtgctcgaggaaaacatggatgtggagatatggacaaaagagggagaacgaaagaaattgagaccaaggtggctggacgctcggacttatagcgatcccctagcactgcgcgagtttaaggagttcgccgctggtagaaggtcagtcagtggcgacctcatccttgagattgggaagctgcctcagcacttaacgcagcgggcccaaaatgcattggacaacctggttatgctccataatagcgaacagggaggccgagcgtacagacacgccatggaggagctgccggataccatcgaaacacttatgctgctcgctttgattgccgtgctgactggtggggtaaccttatttttcctatccggccgcggactgggcaaaacatctatcgggctcctttgtgtgatggcaagctccgtcctgttgtggatggcttcagtggagccacattggatagccgcatctatcattctggaatttttcctcatggttctgcttatccccgagcctgacaggcagcggacaccccaggataaccaactcgcctacgtggtcattggactgttgtttatgatcctgactgtagctgcgaacgagatgggtttactagaaacgaccaagaaagacctgggcatagggcacgtggccgttgagaatcaccatcacgcagctatgctcgatgtggaccttcatccagccagtgcctggacactgtatgcagtcgctactaccattatcacacctatgatgcgtcacaccattgaaaacactacagccaatatctcgttgacggcgatagctaaccaggccgcaatcctgatgggactcgataagggctggcccattagcaaaatggacatcggtgtgccactgcttgccttagggtgctactcccaggtcaatcctctgaccctcactgctgcagtgttgatgctggttgcccattatgcgattatcggcccgggactacaagctaaggccacaagagaggcacagaagaggaccgccgctggcataatgaaaaaccccaccgtggatgggattgtagccatcgacctggatccagtggtctacgacgcaaagttcgaaaaacagctcggacagatcatgcttctgattttgtgtacatctcaaatcctgctcatgcgcactacgtgggctctgtgcgagtcaataaccttagccacaggccctcttactaccctgtgggagggtagccccgggaagttttggaatacaaccattgcggtttccatggccaacatcttccggggaagttatctcgcaggcgctggtctagccttttctctgatgaagtcattgggcgggggacgaagaggcactggggcacagggagaaacgctgggcgagaagtggaagaggcagctcaatcagcttagcaaatccgagttcaacacatacaagcgcagtggtattatggaggtggatcggagcgaagctaaagaggggctgaagagaggagagaccactaaacacgccgtctctcgtggcaccgccaagttgaggtggttcgtggaacggaatctggtaaagccagagggtaaagtgatcgacctcggctgtgggcgcggaggctggtcctattactgcgcggggttaaagaaagttacagaagtgaagggatacactaaaggcggtcctgggcacgaggaacccataccgatggctacctatggatggaacctggtcaaacttcattcaggcaaagacgtgtttttcatcccacctgagaagtgtgatacactgctatgcgacattggcgagagctcgcccaatccaacgatcgaagaggggcgaaccctcagagtcctgaagatggtggaaccctggttgaggggaaaccaattttgtattaaaatcctgaatccttacatgccgtctgttgtagagactctcgagcagatgcagcggaagcacggtggcatgcttgtgcgcaaccccctgagtagaaattccacacatgaaatgtattgggtcagctgcgggaccggaaacattgtgtcagcagttaacatgacttccaggatgttactgaatcgattcacaatggcccaccggaaaccaacctacgagcgtgatgtggacttgggcgctggtacgagacacgtcgccgtggaacctgaggtagcaaacctcgatatcatagggcagcgcattgaaaatatcaagcatgagcacaaatctacctggcattatgacgaggataacccctacaagacatgggcctatcacggaagctacgaagtgaagcctagtggctccgctagctctatggttaatggcgtcgtgaaactgctaactaagccatgggacgtgatccccatggtcacccaaattgcgatgacagatactaccccttttgggcagcagagggttttcaaagagaaggtggacacacggaccccaaaagccaagagaggaactgcacaaataatggaagtaacggctaagtggctttggggttttctgtcacgcaacaaaaagcccaggatctgtacacgagaggagttcacccggaaagtgagaagtaatgccgcaattggcgccgtctttgtggatgagaaccagtggaactccgctaaggaggccgttgaagacgagaggttctgggacctcgtgcatcgcgaacgtgagctgcacaaacaggggaagtgcgcgacttgcgtctacaacatgatgggaaagcgggagaaaaagttgggcgagtttggtaaagcaaaggggagcagagccatctggtatatgtggctgggagctaggttcctcgagtttgaagcccttggcttcatgaatgaggatcactggttctctcgcgaaaactcgctgtcaggcgtggagggggagggattacataaactgggttacattttgcgagacatcagcaagataccgggcgggaatatgtatgcagatgacaccgctggatgggatacacggatcacggaagacgatctccagaacgaggccaaaattaccgacatcatggaacctgagcacgctctgctagccaagtccatttttaaacttacttaccaaaataaagtagttagagtgcagaggccagcaaagaacggcacagtcatggatgtgatcagtcgcagagaccagcggggttctggacaggtgggaacctatggcctgaacactttcacaaatatggaagcgcaactcataaggcagatggagagcgagggcatattttccccctcagaactggagacccctaacttggccgggcgtgtcttagattggctggaaaaacatggagttgagcgactcaagcgcatggctatcagtggtgacgattgtgtggtaaaaccaatcgacgacagattcgccacagcacttactgctctgaatgatatgggcaaggtgcggaaggacattccccagtgggaaccgtctaaagggtggaacgattggcagcaagtccctttttgcagccaccacttccatcagctaataatgaaggacggaagggagatcgtggttccctgtcgcaatcaggatgagctggtgggcagagcccgggtctcccagggtgcagggtggtcactcagggaaaccgcctgcttgggaaaaagctacgcgcaaatgtggcagctgatgtattttcaccgacgtgaccttagactggctgccaacgcaatttgttctgccgtgccagtagattgggttcctacgtcccgcaccacatggagtatccatgctcaccatcagtggatgactaccgaggacatgctcagcgtgtggaatcgggtctggattgaagagaacccctggatggaagataagacacacatctcgtcctggggcgacgtgccatacttaggcaaaagggaggatcaatggtgcgggtctctgataggattgactgccagagcaacctgggctacgaatatccaggttgccattaaccaggtgcgccggctgatcggtaatgagaactacctcgactatatgacatcaatgaagaggttcaagaatgaaagcgaccccgagggcgcgctttggtga

SEQ ID NO: 13610 - RNA, 9879 nt, synthetic construct
  misc_feature 1..9879: note = derived and/or modified CDS sequence (opt3) from DENV-1__FJ182036__SS-prME
  source 1..9879: mol_type = other RNA
tccgtgaccatgctgctcatgcttatgcccacggccctggctttccacttgactacgagaggaggggaacctcatatgatcgtctccaagcaggaaagaggaaaatctttactgtttaagacctcagccggtgttaatatgtgcacgctgattgccatggacctcggcgagctgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggctactccatcaatggccatgcgctgcgtggggattggaagcagagattttgtcgagggtcttagtggcgcgacatgggtggacgtagttttggagcacgggtcctgtgtgaccactatggcaaaggataaacccacactggacatcgaactactcaagaccgaggtcacgaaccctgccgtgctgaggaaactttgcattgaagctaagatctctaataccacaactgatagccggtgtccaacccaaggagaggccacactggtggaagaacaagacgcaaacttcgtctgccgccgaacttttgttgatagaggctggggtaatgggtgtggattgttcggcaaaggctccctcataacctgcgctaagtttaagtgcgtgacaaaactggaggggaagattgtacagtacgaaaacttaaaatattcagtgatcgtcaccgtgcacactggagaccagcatcaagttggtaatgagagtacggaacacggcacaaccgccactattacaccccaagcgcctaccaccgagatccagctgactgactacggggccctcacacttgattgtagcccaaggacgggactggacttcaacgaaatggtgttgctaaccatgaaggagaaatcttggctggtccataagcagtggtttctcgatctgccgcttccctggacttccggcgcatcaacaagccaagagacctggaatcggcaggacctgttggtgacattcaaaactgctcacgccaagaagcaggaagtagttgtgctcggtagtcaagagggggctatgcacaccgccctgacgggcgcaaccgaaatccagacatctggaactaccacaatttttgccggccatttaaaatgccgtctgaagatggataaactaactctcaaggggatgtcctatgtcatgtgtaccggtagcttcaaactggagaaggaacttgctgagacgcagcacggaacagtgttggtccagataaagtacgagggcaccgacgcgccttgcaaaatcccattctcgactcaagatgaaaagggggtgacacagaacggacgcctgattaccgcaaatcccatcgttactgacaaagagaagcctgtgaacatagaagccgagccaccctttggcgagtcttatattgtaatcggtgctggggaaaaagccctcaagctgtcctggttcaagaaaggctcaagtatcggaaagatgtttgaggcaaccgccagaggcgctaggcggatggccattcttggggatacagcatgggacttcggaagcatcggtggcgtctttacgtccgtggggaaactggttcatcagattttcggaaccgcgtacggcgtgttgttttctggtgtcagctggactatgaagatagggatcggcgtgctcctgacatggttaggactaaattcacgaagtacctccctaagcatgacatgtattgctgtaggcctcgtgactctgtaccttggggttatggtccaggccgattctggatgcgtgatcaactggaaaggccgcgaattgaagtgtggttcagggatcttcgtgaccaatgaggtccacacgtggacagaacaatataagtttcaggcagacagtccgaaaagactgagcgccgctattggaaaggcctgggaggagggcgtttgcggtataaggtccgcaacccggctcgaaaacatcatgtggaaacagatttctaacgagctgaatcatatcttactggaaaacgacatgaagttcactgtggtggtaggcgatgtcgctgggattcttgcccagggcaagaagatgatccgccctcaacccatggagtacaaatattcgtggaaaagctggggcaaggcgaagataatcggggccgacgtgcagaataccacatttattatcgatggaccaaacactcctgaatgtcccgacgatcagagagcttggaatatttgggaggttgaggactacggcttcggtatctttaccacaaacatatggttgaagctcagggattcctatacacaggtgtgcgaccaccgtctgatgtcagcagccattaaagatagtaaggctgtccacgccgacatggggtactggatcgaatctgagaaaaatgaaacctggaagctagcacgggcgagcttcattgaggtgaagacttgtatctggccaaaatcccatacactgtggtcaaacggagttctcgaaagcgagatgataatccccaagatttatggcggtcctatgtctcaacacaattaccgaccaggctacttcacccagactgccgggccgtggcatctgggaaaacttgagttggattttgacctgtgcgaaggcacaaccgtggtagtcgatgagcactgcgggaacagaggaccctccttaaggacgactaccgtgacaggcaagatcattcacgaatggtgttgccgcagttgtaccctccctccactgcggttcagaggtgaggacgggtgctggtatggaatggagatcaggcccgtgaaagaaaaggaggaaaatcttgtcaagagcatggtttctgctggctccggtgaggtggactcatttagtctgggcttgctctgtataagcattatgatcgaagaggtaatgcgctcgcgatggtcccggaaaatgctgatgactgggacactagccgtgttctttctgctcatcatgggacagctgacctggaacgatcttattcgtttgtgcatcatggtcggcgcaaatgcttctgacagaatggggatgggaacaacttacctggccttaatggcaaccttcaagatgaggcctatgtttgccgtgggcctcctgttccgccggcttacgagcagagaggttctgctactcacaattggtctgtcattggtggctagtgtcgaactgccaaactccttagaggaactcggggatggactggcgatgggcataatgatccttaaactgttgaccgactttcaatctcatcagctctgggccactctgctaagcctgaccttcattaagacaactttttcccttcactatgcatggaaaaccatggctatggtgctctcaatcgttagcctgttccccttgtgtctgagtacgacatctcagaagaccacttggttaccggtgctcctgggctcccttgggtgcaagcctctgacaatgtttttgattgccgagaataaaatctggggaaggcgaagctggccactcaacgaaggtataatggccgtcggcatcgtatcgattctgctatcatctctgcttaagaacgatgtgcccctcgctgggcctctgatcgcaggaggcatgttgattgcctgttacgttatcagtggttccagcgcggacttatctctggagaaagctgccgaggtgagctgggaagaggaagcagagcattccggggcctcacacaatatactcgtcgaagtgcaggatgacggaaccatgaagattaaagatgaggagcgcgacgatactctgacaatccttctgaaggctaccttgctagcagtaagtggcgtgtatcccctgagcatcccagccacactcttcgtctggtacttctggcagaagaagaagcagcggtctggcgttctgtgggacactccttcacccccagaagtggagagagcggtgcttgatgacgggatttataggataatgcagcgtggattactgggtcgcagccaggtcggcgtgggggtttttcaagaaaacgtattccataccatgtggcacgtgacacggggagctgtcctcatgtaccagggcaaaagattggagccgagttgggccagcgtgaagaaagacctgatctcctacggtgggggatggaggctccagggctcttggaataccggcgaggaagttcaggtgattgcagtcgagcctgggaagaaccccaaaaatgtgcaaacagccccaggaacttttaagacccccgaaggtgaggtaggcgctatcgccctggatttcaagcctgggacgtcgggaagcccaattgtcaaccgagaaggcaaaatcgtgggtctttatgggaatggagttgtgacaacttcaggcacctacgtctccgcaatagctcaggccaaggcgagtcaggagggccccctgcctgagatcgaagacgaggtgtttcggaaacgcaacttgacaattatggatctacacccggggtctggaaagaccagaaggtatctgccagccatcgttcgggaagcaattaaacgaaagctcagaactttaatcctggctcccacccgcgtggtcgccagcgagatggctgaagcacttaagggtatgcctataaggtaccaaacaacggccgtgaaatccgagcatactggcaaggagattgtagacctgatgtgccacgccaccttcacaatgcgtctcttgtcaccagtgcgggttcccaattataacatgatcatcatggatgaagctcattttaccgacccttctagcattgcggcaagagggtacatcagtactagggtcggaatgggcgaggccgctgccatattcatgacagcaaccccgcccggttccgtggaagcctttccacagagcaatgctgtgattcaggatgaggaacgcgacatccctgagcgatcttggaactcagggtatgagtggattacggatttccccggaaaaactgtctggtttgtaccatccatcaagagtggcaatgacatagcgaactgtctgaggaaaaatggcaagcgggtgattcagctcagcaggaagacattcgataccgaataccagaaaaccaagaacaacgactgggactacgttgtgactacagatatctcggagatgggggccaatttccgcgcagaccgtgtcatcgatcctagacggtgcctgaaacccgtgattcttaaggacggaccagaaagggttatcctagctggtccgatgcctgtgaccgtcgcctctgcagcccagcgccgaggcagaattgggcggaaccacaataaagagggagatcagtatatatacatgggccagcccctgaacaatgacgaggatcatgctcactggacagaagccaagatgttgttagacaacatcaatactccagagggtattatccccgcgctgtttgaacctgagagggaaaagtccgcagccatcgatggggagtatcgcctcagaggcgaggctaggaaaacgttcgtggaactgatgcggcgtggagaccttccagtatggctgagctacaaggtggcctcagagggctttcaatatagtgatcgccgatggtgcttcgacggggaaagaaacaatcaggttctcgaggaaaacatggatgtcgagatttggaccaaagagggagaaaggaagaaattgcggccccgctggctggacgctagaacatactctgaccctctagcactgagggagtttaaggagttcgccgctggtcggcgatccgtgagcggcgatctcatacttgagatcgggaaactgccgcagcacttaactcagagagcccaaaatgcattggacaacctggtgatgctccataattcagaacagggaggccgcgcgtataggcacgccatggaggagctgccagataccattgaaacacttatgctgctcgctttgatcgccgtcctgaccggtggggttactttatttttcctaagtggccggggactgggcaagacgagcattgggctcctttgtgtgatggcatcctctgtactgttgtggatggctagcgtggagccccattggatcgccgcatccataatcctggaatttttcctcatggtcctgcttattcctgagcccgaccgtcagagaaccccacaggataaccaactcgcctacgtggttatcggactgttgtttatgattctgacagtggctgcgaatgagatgggtttactagaaactaccaagaaagacctgggcatcgggcacgtcgccgtagagaaccaccatcacgcagctatgctcgatgtggaccttcatcctgcctcagcctggacactgtacgcagttgctaccactataattacacccatgatgaggcacacgatcgaaaacaccactgccaatatttctttgacagcgatcgctaaccaggccgcaatactgatgggactcgataagggctggccaatcagtaaaatggacattggtgtgcctctgcttgccttagggtgctattcgcaggtcaatccgctgaccctcaccgctgcagtgttgatgctggtcgcccattacgcgatcattggccccggactacaagctaaggccacacgcgaggcacagaaacggactgccgctggcatcatgaagaacccaacggtggatgggatagttgccattgacctggatcctgtggtatatgacgcaaagttcgaaaaacagctcggacagatcatgcttctgatcttgtgtaccagccaaattctgctcatgcgaacaacttgggctctgtgcgagtccatcaccttagccacaggcccccttaccactctgtgggagggttctccagggaagttttggaatacgacaatagcggtgtcaatggccaacattttcagaggaagctacctcgcaggcgctggtctagccttctccctgatgaaaagtttgggcgggggaaggcgcggcaccggggcacagggagaaactctgggcgagaagtggaaacggcagctcaatcagctttctaagagcgaatttaacacctataagagatcaggtatcatggaggtcgaccgttccgaagctaaagaggggctgaagaggggagagacaactaaacacgccgttagtcggggcaccgccaagttgcgctggttcgtggaacgaaatctggtcaaacctgagggtaaggtgattgatctcggctgtgggagaggaggctggagctactattgcgcggggttaaagaaagtaacagaagtgaagggatacacgaaaggcggtcccgggcacgaggaaccgatcccaatggctacctacggatggaacctggttaaacttcattctggcaaagacgtgtttttcatacctcccgagaagtgtgatactctgctatgcgacatcggcgagtcctcaccaaatcccacaattgaagaggggaggaccctccgggtcctgaaaatggtggaaccttggttgcgcggaaaccaattttgtatcaagattctgaatccgtatatgcccagcgtcgtggagactctcgagcagatgcagagaaagcacggtggcatgcttgttaggaacccactgtcgcgaaattctacacatgaaatgtactgggtaagttgcgggaccggaaacatcgtgtccgcagtcaatatgacgagccggatgttactgaaccgtttcaccatggcccacagaaaacctacatatgagcgcgatgtggacttgggcgctggtactaggcacgttgccgtggaacccgaggtcgcaaacctcgatattatcgggcagcggatagaaaatattaagcatgagcacaaatcaacctggcattacgacgaggataacccttataagacatgggcctaccacggatcctatgaagtgaaaccatctggcagcgctagttccatggtaaatggcgtggttaagctgctaactaagccctgggacgtcatccctatggtgacccaaatcgcgatgacagataccactccatttgggcagcagagagtgttcaaagagaaggtcgacacgcgcacacccaaagccaagaggggaaccgcacaaattatggaagttactgctaaatggctttggggttttctgagccgaaacaagaagccgcggatatgtaccagagaggagttcacaaggaaagtgcgctctaatgccgcaatcggcgccgtatttgtggacgagaaccagtggaactcagctaaggaggccgtcgaagatgagcgtttctgggacctcgtgcatcgggaaagagagctgcacaaacaggggaagtgcgcgacgtgcgtttacaacatgatgggaaaaagggaaaagaagttgggcgagtttggtaaagcaaaggggagtcgcgccatttggtacatgtggctgggagctcgattcctcgagttcgaagcccttggctttatgaatgaggatcactggttctcccgggaaaacagcctgtctggcgtggagggggagggattacataaactgggttatatcttgagagacatttcgaagatccctggcgggaatatgtacgcagatgacaccgctggatgggatactaggataacagaagacgatctccagaacgaggcccgcatcaccgacattatggaaccagagcacgctctgctagccaaatcaatctttaaacttacttatcaaaataaagtcgtgagagtacagcggcccgcaaagaacggcacagttatggatgtgattagcaggcgtgaccagcgaggttccgggcaggtcggaacctacggcctgaatacattcactaacatggaagcgcaactcatccgccagatggagagtgagggcatattttctcctagcgaactggagaccccaaacttggccaagagagtgttagattggctggaaaaatatggggtggagcggctcaagaggatggctatttccggagacgactgtgtcgttaaacccatcgatgaccgcttcgccacggcacttaccgctctgaatgatatgggtaaggtgagaaaagacatcccgcagtgggaaccttcaaagggctggaacgattggcagcaagtacccttttgcagtcatcacttccaccagctaattatgaaggacgggcgggagatagtggtcccatgtaggaatcaggatgagctggtgggacgagcccgtgtttctcagggcgcaggttggagcctcagagaaacagcctgcttggggaaatcctacgcgcaaatgtggcagctgatgtattttcatcgccgggaccttaggctggctgccaacgcaatctgttcagccgtgcctgtcgattggattcccactagcagaaccacatggtctatccacgctcatcaccagtggatgactaccgaggacatgctctccgtgtggaatcgcgtatggattgaagagaacccatggatggaagataagacgcatatcagtagctggggagacgttccctacttaggcaaacgggaggaccaatggtgcggctcgctgatagggttgacagccagggcaacctgggctactaatatccaggtggccattaaccaggtccgaagactgatcggaaatgagaactacctcgattatatgacatccatgaagcggttcaaaaatgaatctgaccctgagggtgcgctttggtga

SEQ ID NO: 13611 - RNA, 9879 nt, synthetic construct
  misc_feature 1..9879: note = derived and/or modified CDS sequence (opt3) from DENV-1__FJ205876__SS-prME
  source 1..9879: mol_type = other RNA
agcgtgaccatgctgctcatgcttatgcccacggccctggctttccacttgactacgagaggaggggaacctcatatgatcgtctccaagcaggaaagagggaaatctttactgtttaagacctcagccggtgttaatatgtgcacactaattgccatggacctcggcgaactgtgtgaagatactatgacctacaaatgcccacggataacagagaccgaaccggacgatgtggactgttggtgcaatgcgactgatacatgggtgacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccgggagcttcaaactggagaaggaagtcgccgagacgcagcacggtacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattgtgatcggtgccggggaaaaagctctgaagctctcctggttcaagaaaggctcaagtatcggaaagatgtttgaggccaccgcaagaggcgccaggcggatggctattctgggggatacagcctgggacttcggaagcatcggtggcgtttttacgtccgtggggaaacttgtccatcagattttcggaaccgcatacggcgtgctgttttctggtgtaagctggactatgaagatagggatcggcgtgttgctcacatggctgggattaaattcacgaagtacctccctgagcatgacatgtattgcggttggcctagtcactctctacctgggggtgatggtgcaggctgattctggatgcgtcatcaactggaaaggccgcgaacttaagtgtggttcagggatcttcgttaccaatgaggtgcacacgtggacagaacaatataagtttcaggccgacagtccgaaaagattgagcgcagccattggaaaggcttgggaggagggcgtgtgcggtataaggtccgccacccggctggaaaacatcatgtggaaacagatttctaacgagctcaatcatatcctgttagaaaacgacatgaagttcactgtagtcgtgggcgatgttgcagggattctggctcagggcaaaaagatgatccgccctcaacccatggagtacaaatattcgtggaaaagctggggcaaggccaagataatcggggcggacgtgcagaataccacatttattatcgatggaccaaacactcctgaatgtcccgacgatcagagagcctggaatatttgggaggtcgaggactacggcttcggtatctttaccacaaacatatggcttaagttgagggattcctatacacaggtgtgcgaccaccgtctcatgtcagctgcaattaaagatagtaaggccgttcacgctgacatggggtactggatcgaatctgagaaaaatgaaacctggaagctggcccgggcatccttcattgaggtgaagacttgtatctggccaaaatcccatacactatggtcaaacggagtactggaaagcgagatgataatccccaagatttatggcggtcctatctctcaacacaattaccgaccaggctacttcacccagactgcggggccgtggcatctcggaaaactggagcttgattttgacttgtgcgaaggcacaaccgtcgtggtggatgagcactgcgggaacagaggaccctccctgaggacgactaccgtcacaggcaagattatccacgaatggtgttgccgcagttgtaccttacctccactccggttcagaggtgaggacgggtgctggtatggaatggagataaggcccgttaaagaaaaggaggaaaatctggtaaagagcatggtatctgccggctccggtgaggtggactcatttagtcttggcctgttgtgtattagcatcatgatcgaagaggtcatgcgctcgcgatggtcccggaaaatgctcatgactgggacactggctgtgttctttctactgattatgggacagctcacctggaacgatctgatccgtctttgcattatggttggcgccaatgcatctgacagaatggggatgggaacaacttacttggctctgatggccaccttcaagatgaggcctatgtttgcagtgggcttactcttccgccggctgacgagcagagaggtccttctgctaacaataggtctctcactggtggccagtgttgaattgccaaactccctggaggaattaggggatggactcgctatgggcatcatgattctgaaacttctgaccgactttcaatctcatcagttgtgggcgactctcctgagcctaaccttcatcaagacaactttttccctgcactatgcctggaaaaccatggcaatggtgctttcaattgtcagcctcttccccctgtgtttgagtacgacatctcagaagaccacttggctgccggtattactcggctccctggggtgcaagcctcttacaatgtttctgatcgctgagaataaaatatggggaaggcgaagctggccattgaacgaaggtatcatggccgtgggcattgtttcgatcctcctgtcatctctactgaagaacgatgtgccccttgccgggcctctcattgctggaggcatgctgatcgcatgttacgtcataagtggttccagcgccgacttgtctttagagaaagcggctgaggtgagctgggaagaggaagccgagcattccggggcatcacacaatattctggtagaagtgcaggatgacggaaccatgaagatcaaagatgaggagcgcgacgatactctcacaatcctgcttaaggccaccctgttggctgtcagtggcgtttatcccctaagcattccagcaacgctgttcgtgtggtacttctggcagaaaaagaagcagcggtctggcgtgctctgggacactccttcacccccagaagtcgagagagccgtgctggatgacgggatatataggatcatgcagcgtggacttttaggtcgcagccaggttggcgtaggggtgtttcaagaaaacgtcttccataccatgtggcacgtgacacggggagcggttctgatgtaccagggcaaaagactcgagccgagttgggctagcgtgaagaaagacttgatttcctacggtgggggatggaggctgcagggctcttggaataccggcgaggaagtccaggtgatcgccgtagagcctgggaagaaccccaaaaatgtccaaacagcaccaggaacttttaagacccccgaaggtgaggtgggcgccattgctctcgatttcaagcctgggacgtcgggaagcccaatcgttaaccgagaaggcaaaatagtgggtctgtatgggaatggagtcgtgacaacttcaggcacctacgtttccgccatcgcacaggctaaggccagtcaggagggcccccttcctgagattgaagacgaggtgtttcggaaacgcaacctgacaatcatggatttgcacccggggtctggaaagaccagaaggtatctaccagcgattgtccgggaagccatcaaacgaaagctgagaactctcatattagcacccacccgcgtggtagctagcgagatggccgaagctctgaagggtatgcctattaggtaccaaacaacggcagtgaaatccgagcatactggcaaggagatcgttgaccttatgtgccacgccaccttcacaatgcgtctgctctcaccagtccgggtgcccaattataacatgatcattatggatgaagcccattttaccgacccttctagcatcgctgcgagagggtacataagtactagggtgggaatgggcgaggcagccgctattttcatgacagccaccccgcccggttccgtcgaagcatttccacagagcaatgccgtaatccaggatgaggaacgcgacattcctgagcgatcttggaactcagggtatgagtggatcacggatttccccggaaaaactgtgtggtttgttccatccataaagagtggcaatgacattgctaactgtttgaggaaaaatggcaagcgggtgatccagctgagcaggaagacattcgataccgaataccagaaaaccaagaacaacgactgggactacgtcgtgactacagatatctcggagatgggggcgaatttccgcgccgaccgtgttattgatcctagacggtgcctcaaacccgtgatcctgaaggacggaccagaaagggtcattcttgcaggtccgatgcctgtgaccgtagcttctgccgcacagcgccgaggcagaatagggcggaaccacaataaagagggagatcagtatatctacatgggccagcccctaaacaatgacgaggatcatgcccactggacagaagctaagatgctgttggacaacattaatactccagagggtatcatccccgccttatttgaacctgagagggaaaagtccgcggcaattgatggggagtatcgcctgagaggcgaggccaggaaaacgttcgtggaactcatgcggcgtggagacctgccagtttggcttagctacaaggtcgcttcagagggctttcaatatagtgatcgccgatggtgcttcgacggggaaagaaacaatcaggtgctggaggaaaacatggatgtggagatatggaccaaagagggagaaaggaagaaactccggccccgctggttggacgccagaacatactctgaccctctggctctaagggagtttaaggagttcgcagccggtcggcgatccgtcagcggcgatctgatcctcgagattgggaaacttccgcagcacctgactcagagagctcaaaatgccttagacaacttggttatgctgcataattcagaacagggaggccgcgcatataggcacgcgatggaggagctcccagataccatcgaaacactgatgcttctggccctcattgctgtgttgaccggtggggtaactctgtttttcttaagtggccggggactaggcaagacgagcatcgggctgctctgtgtgatggcctcctctgtccttctgtggatggcaagcgtggagccccattggatagctgcctccatcattttggaatttttcctgatggttctcctgatccctgagcccgaccgtcagagaaccccacaggataaccaacttgcatacgtggtcattggactcctgtttatgatcttgacagtagccgctaatgagatgggtctgttagaaactaccaagaaagacctaggcatagggcacgtggcggttgagaaccaccatcacgccgcaatgctggatgtggacctccatcctgcttcagcctggacactttacgccgtcgcaaccactattatcacacccatgatgaggcacacgattgaaaacaccactgctaatatctctctgacagccatagcgaaccaggctgccatcttgatgggactggataagggctggccaattagtaaaatggacatcggtgtgcctctcctggcacttgggtgctattcgcaggtcaatccgttaaccctgaccgccgctgtgctcatgttggttgcacattacgccattatcggccccggactgcaagcgaaggctacacgcgaggcccagaaacggactgcagccggcataatgaagaacccaacggtggatgggattgtagctatcgacctagatcctgtggtctatgacgccaagttcgaaaaacagctgggacagatcatgctccttattctgtgtaccagccaaatcttgctgatgcgaacaacttgggcactctgcgagtccataaccctggctacaggccccttaaccactctttgggagggttctccagggaagttttggaatacgacaattgccgtttcaatggcgaacatcttcagaggaagctacctggccggcgcaggtctcgctttctccctaatgaaaagtctgggcgggggaaggcgcggcaccggggcccagggagaaactttgggcgagaagtggaaacggcagctgaatcagctctctaagagcgaatttaacacctataagagatcaggtattatggaggtggaccgttccgaagcaaaagaggggcttaagaggggagagacaactaaacacgctgtcagtcggggcaccgccaagctgcgctggttcgtggaacgaaatttggtaaaacctgagggtaaggtgatcgatctgggctgtgggagaggaggctggagctactattgcgccgggctcaagaaagttacagaagtgaagggatacacgaaaggcggtcccgggcacgaggaaccgataccaatggcgacctacggatggaacttagtcaagctgcattctggcaaagacgtgtttttcatccctcccgagaagtgtgatactcttctgtgcgacattggcgagtcctcaccaaatcccacaatcgaagaggggaggaccctacgggtcctcaaaatggtggaaccttggctgcgcggaaaccaattttgtattaagatcttgaatccgtatatgcccagcgttgtagagactctggagcagatgcagagaaagcacggtggcatgctcgtgaggaacccactttcgcgaaattctacacatgaaatgtactgggtcagttgcgggaccggaaacattgtgtccgctgttaatatgacgagccggatgctgttaaaccgtttcaccatggcacacagaaaacctacatatgagcgcgatgtggacctgggcgccggtactaggcacgtcgctgtggaacccgaggtagccaacttggatatcatagggcagcggattgaaaatatcaagcatgagcacaaatcaacctggcattacgacgaggataacccttataagacatgggcataccacggatcctatgaagtgaaaccatctggcagcgccagttccatggttaatggcgtcgtgaagctcctgactaagccctgggacgtgatccctatggtcacccaaattgctatgacagataccactccatttgggcagcagagagttttcaaagagaaggtggacacgcgcacacccaaagcgaagaggggaaccgcccaaataatggaagtaactgcaaaatggctatggggttttcttagccgaaacaagaagccgcggatctgtaccagagaggagttcacaaggaaagtgcgctctaatgctgccattggcgcagtctttgtggacgagaaccagtggaactcagccaaggaggctgttgaagatgagcgtttctgggacctggtgcatcgggaaagagagctccacaaacaggggaagtgcgccacgtgcgtctacaacatgatgggaaaaagggaaaagaagctgggcgagtttggtaaagcgaaggggagtcgcgcaatctggtacatgtggttgggagcccgattcctggagttcgaagctctcggctttatgaatgaggatcactggttcaaccgggaaaattcccttagcggcgtggagggggagggactgcataaattaggttatattctgagagacatctctaagatacctggcgggaacatgtacgccgatgacaccgcaggatgggatactaggatcacagaagacgatttgcagaatgaggctcgcattaccgacatcatggaaccagagcacgccctcctggctagatcgatttttaaactaacttatcaaaacaaggtagttcgggtgcagaggcccgccaaaaatggcacagtcatggatgtgatctcacgtcgagaccagcgcggtagcggacaggtgggaacctacggccttaacacattcactaacatggaagcacaactgataagacagatggagtccgagggcatttttagtccttctgaactcgagaccccaaatctggcggaacgggtcttggattggttagagaagtatggggttgaaaggctgaagcgcatggccatcagcggagacgactgtgtggtaaaacccatcgatgacagattcgctacggccctcaccgcacttaacgatatgggtaaggtgcggaaagacattccgcagtgggagccttccaagggctggaatgattggcagcaagtccccttttgctcacatcacttccaccagctgataatgaaagacgggagggagatcgtggttccatgtcgaaaccaggatgagctagtgggacgtgctagagtcagtcagggcgccggttggtctctgcgcgagacagcatgcctcggaaagagctacgcccaaatgtggcagttgatgtattttcatcggagggacctgagacttgcggctaatgccatttgttccgcagtgcctgtagattggatccccacttcacgcaccacatggagcattcacgcccatcaccagtggatgactaccgaagacatgctgtctgtttggaaccgggtgtggatcgaggaaaatccatggatggaggataagacgcatatatccagttggggagacgtcccctacctcggcaaaagggaggaccaatggtgcggcagcttaatcgggctgacagctcgagccacctgggcaactaacattcaggtggctatcaatcaggttagacggttgattggaaacgaaaattacctggattatatgacatcgatgaagaggttcaaaaacgagtccgaccctgaaggtgccctctggtga

SEQ ID NO: 13612 - RNA, 9879 nt, synthetic construct
  misc_feature 1..9879: note = derived and/or modified CDS sequence (opt3) from DENV-1__FJ024455__SS-prME
  source 1..9879: mol_type = other RNA
agcgtgaccatgctgctcatgcttatgcccacggccctggctttccacttgactacgagaggcggggaacctcatatgatcgtctccaagcaggaaagaggaaaatctttactgtttaagacctcagttggtgtgaatatgtgcaccctaattgcaatggacctcggcgaactgtgtgaagatactatgacctacaaatgcccacggatcacggagaccgaaccggacgatgtagactgttggtgcaatgccactgatacatgggtgacctatgggacgtgtagtcaaactggagagcaccgccgagacaagcgtagcgtcgcgcttgctccccatgtgggcctgggtttggagaccagaacagaaacttggatgtcctctgagggggcctggaaacagatccagagggttgaaacctgggcactccggcaccctggattcacagtgattgccctgtttctggctcatgcaatcggcacctcgattacgcagaagggcatcattttcatcctcttaatgctggtcactccatcaatggccatgcgctgcgtggggattggaagcagagattttgtagagggtcttagtggcgctacatgggttgacgtggtcttggagcacgggtcctgtgtgaccactatggccaaggataaacccacactggacatcgaactactcaagaccgaggtgacgaaccctgcggtcctgaggaaactttgcattgaagcaaagatctctaataccacaactgatagccggtgtccaacccaaggagaggccacactggttgaagaacaagacgctaacttcgtgtgccgccgaacttttgtagatagaggctggggtaatgggtgtggattgttcggcaaaggctccctcataacctgcgccaagtttaagtgcgtgacaaaactggaggggaagattgtccagtacgaaaacttaaaatattcagtgatcgttaccgtgcacactggagaccagcatcaagtcggtaatgagagtacggaacacggcacaaccgcaactattacaccccaagctcctaccaccgagatccagctgactgactacggggccctcacacttgattgtagcccaaggacgggactggacttcaacgaaatggtgttgctaaccatgaaggagaaatcttggctggtacataagcagtggtttctcgatctgccgcttccctggacttccggcgcgtcaacaagccaagagacctggaatcggcaggacctgttggttacattcaaaactgcccacgcaaagaagcaggaagtggtcgtgctcggtagtcaagagggggctatgcacaccgccctgacgggcgctaccgaaatccagacatctggaactaccacaatttttgccggccatttaaaatgccgtctgaagatggataaactaactctcaaggggatgtcctatgtcatgtgtaccgggagcttcaaactggagaaggaacttgcagagacgcagcacggtacagtgttggttcagataaagtacgagggcaccgacgccccttgcaaaatcccattctcgactcaagatgaaaagggggtgacacagaacggacgcctgattaccgctaatcccatcgtaactgacaaagagaagcctgtcaacatagaagcggagccaccctttggcgagtcttatattgtgatcggtgcaggggaaaaagccctcaagctgtcctggttcaagaaaggctcaagtatcggaaagatgtttgaggctaccgccagaggcgcaaggcggatggccattcttggggatacagcttgggacttcggaagcatcggtggcgtttttacgtccgtggggaaactggtccatcagattttcggaaccgcctacggcgtgttgttttctggtgtaagctggactatgaagatagggatcggcgtgctcctgacatggttaggactaaattcacgaagtacctccctaagcatgacatgtattgcagttggcctcgtcactctgtaccttggggtgatggtgcaggcggattctggatgcgtcatcaactggaaaggccgcgaattgaagtgtggttcagggatcttcgttaccaatgaggtgcacacgtggacagaacaatataagtttcaggctgacagtccgaaaagactgagcgccgcaattggaaaggcctgggaggagggcgtgtgcggtataaggtccgctacccggctcgaaaacatcatgtggaaacagatttctaacgagctgaatcatatcttactggaaaacgacatgaagttcactgtagtcgtgggcgatgttgccgggattcttgcacagggcaaaaagatgatccgccctcaacccatggagtacaaatattcgtggaaaagctggggcaaggctaagataatcggggccgacgtgcagaataccacatttattatcgatggaccaaacactcctgaatgtcccgacgatcagagagcgtggaatatttgggaggtcgaggactacggcttcggtatctttaccacaaacatatggttgaagctcagggattcctatacacaggtgtgcgaccaccgtctgatgtcagccgctattaaagatagtaaggcagttcacgccgacatggggtactggatcgaatctgagaaaaatgaaacctggaagctagctcgggccagcttcattgaggtgaagacttgtatctggccaaaatcccatacactgtggtcaaacggagtactcgaaagcgagatgataatccccaagatttatggcggtcctatctctcaacacaattaccgaccaggctacttcacccagactgcagggccgtggcatctgggaaaacttgagttggattttgacctgtgcgaaggcacaaccgtcgtggtggatgagcactgcgggaacagaggaccctccttaaggacgactaccgtcacaggcaagattatccacgaatggtgttgccgcagttgtaccctccctccactgcggttcagaggtgaggacgggtgctggtatggaatggagataaggcccgttaaagaaaaggaggaaaatcttgtgaagtccatggtatctgcgggctccggtgaggtggactcatttagtctgggcttgctctgtattagcatcatgatcgaagaggtcatgcgctcgcgatggtcccggaaaatgctgatgactgggacactagccgtgttctttctgctcattatgggacagctgacctggaacgatcttatccgtttgtgcattatggttggcgctaatgcctctgacagaatggggatgggaacaacttacctggcattaatggctaccttcaagatgaggcctatgtttgccgtgggcctcctgttccgccggcttacgagcagagaggtcctgctactcacaataggtctgtcattggtggcaagtgttgaactgccaaactccttagaggaactcggggatggactggccatgggcatcatgattcttaaactgttgaccgactttcaatctcatcagctctgggctactctgctaagcctgaccttcatcaagacaactttttcccttcactatgcgtggaaaaccatggccatggtgctctcaattgtcagcctgttccccttgtgtctgagtacgacatctcagaagaccacttggttaccggtactcctgggctcccttgggtgcaagcctctgacaatgtttttgatcgcagagaataaaatatggggaaggcgaagctggccactcaacgaaggtatcatggctgtgggcattgtttcgatcctgctatcatctctgcttaagaacgatgtgcccctcgccgggcctctgattgccggaggcatgttgatcgcttgttacgtcataagtggttccagcgcagacttatctctggagaaagccgcggaggtgagctgggaagaggaagctgagcattccggggcctcacacaatattctcgtagaagtgcaggatgacggaaccatgaagatcaaagatgaggagcgcgacgatactctgacaatccttctgaaggcaaccttgctagccgtcagtggcgtttatcccctgagcattccagctacactcttcgtgtggtacttctggcagaaaaagaagcagcggtctggcgtgctgtgggacactccttcacccccagaagtcgagagagcagtgcttgatgacgggatatataggatcatgcagcgtggattactgggtcgcagccaggttggcgtaggggtgtttcaagaaaacgtcttccataccatgtggcacgtgacacggggagccgttctcatgtaccagggcaaaagattggagccgagttgggcgagcgtgaagaaagacctgatttcctacggtgggggatggaggctccagggctcttggaataccggcgaggaagtccaggtgatcgctgtagagcctgggaagaaccccaaaaatgtccaaacagccccaggaacttttaagacccccgaaggtgaggtgggcgcaattgccctggatttcaagcctgggacgtcgggaagcccaatcgttaaccgagaaggcaaaatagtgggtctttatgggaatggagtcgtgacaacttcaggcacctacgtttccgctatcgcccaggcaaaggctagtcaggagggaccccctccggagattgaagacgaggtgtttcggaaacgcaacctgacaatcatggatttgcacccagggtctggaaagaccagaaggtatctacccgccattgtccgggaagcgatcaaacgaaagctgagaactctcatattagcccctacccgcgtggtagcaagcgagatggctgaagccctgaagggtatgccaattaggtaccaaacaacggctgtgaaatccgagcatactggcaaggagatcgttgaccttatgtgccacgcaaccttcacaatgcgtctgctctcacccgtccgggtgcctaattataacatgatcattatggatgaagcccattttaccgacccgtctagcatcgccgctagagggtacataagtactagggtgggaatgggcgaggcggcagccattttcatgacagctacacccccaggttccgtcgaagcctttcctcagagcaatgcagtaatccaggatgaggaacgcgacattcccgagcgatcttggaactcagggtatgagtggatcacggatttcccaggaaaaactgtgtggtttgttccttccataaagagtggcaatgacattgccaactgtttgaggaaaaatggcaagcgggtgatccagctgagcaggaagacattcgataccgaataccagaaaaccaagaacaacgactgggactacgtcgtgactacagatatctcggagatgggggctaatttccgcgcggaccgtgttattgatcccagacggtgcctcaaaccagtgatcctgaaggacggaccggaaagggtcattcttgccggtcctatgcccgtgaccgtagcatctgctgcccagcgccgaggcagaatagggcggaaccacaataaagagggagatcagtatatctacatgggccagccactaaacaatgacgaggatcatgcacactggacagaagccaagatgctgttggacaacattaatactcccgagggtatcatccctgctttatttgaaccagagagggaaaagtccgccgcgattgatggggagtatcgcctgagaggcgaggcaaggaaaacgttcgtggaactcatgcggcgtggagacctgcccgtttggcttagctacaaggtcgcctcagagggctttcaatatagtgatcgccgatggtgcttcgacggggaaagaaacaatcaggtgctggaggaaaacatggatgtggagatatggaccaaagagggagaaaggaagaaactccggcctcgctggttggacgctagaacatactctgacccgctggccctaagggagtttaaggagttcgctgcaggtcggcgatccgtcagcggcgatctgatcctcgagattgggaaacttccacagcacctgactcagagagcccaaaatgctttagacaacttggttatgctgcataattcagaacagggaggccgcgcctataggcacgcaatggaggagctccccgataccatcgaaacactgatgcttctggcgctcattgccgtgttgaccggtggggtaactctgtttttcttaagtggccggggactaggcaagacgagcatcgggctgctctgtgtgatggcttcctctgtccttctgtggatggccagcgtggagcctcattggatagcagcttccatcattttggaatttttcctgatggttctcctgatccccgagccagaccgtcagagaacccctcaggataaccaacttgcctacgtggtcattggactcctgtttatgatcttgacagtagcagccaatgagatgggtctgttagaaactaccaagaaagacctaggcatagggcacgtggctgttgagaaccaccatcacgcggccatgctggatgtggacctccatcccgcatcagcttggacactttacgccgtcgccaccactattatcacaccaatgatgaggcacacgattgaaaacaccactgcaaatatctctctgacagctatagccaaccaggcggctatcttgatgggactggataagggctggcctattagtaaaatggacatcggtgtgccgctcctggcccttgggtgctattcgcaggtcaatcccttaaccctgaccgcagccgtgctcatgttggttgctcattacgcaattatcggcccaggactgcaagccaaggcgacacgcgaggctcagaaacggactgccgcaggcataatgaagaaccctacggtggatgggattgtagccatcgacctagatcccgtggtctatgacgctaagttcgaaaaacagctgggacagatcatgctccttattctgtgtaccagccaaatcttgctgatgcgaacaacttgggccctctgcgagtccataaccctggcaacaggcccattaaccactctttgggagggttctcctgggaagttttggaatacgacaattgctgtttcaatggccaacatcttcagaggaagctacctggcgggcgccggtctcgcattctccctaatgaaaagtctgggcgggggaaggcgcggcaccggggctcagggagaaactttgggcgagaagtggaaacggcagctgaatcagctctctaagagcgaatttaacacctataagagatcaggtattatggaggtggaccgttccgaagccaaagaggggcttaagaggggagagacaactaaacacgcagtcagtcggggcaccgctaagctgcgctggttcgtggaacgaaatttggtaaaacccgagggtaaggtgatcgatctgggctgtgggagaggaggctggagctactattgcgccgggctcaagaaagttacagaagtgaagggatacacgaaaggcggtccggggcacgaggaaccaatacctatggccacctacggatggaacttagtcaagctgcattctggcaaagacgtgtttttcatacccccagagaagtgtgatactcttctgtgcgacattggcgagtcctcacccaatcctacaatcgaagaggggaggaccctacgggtcctcaaaatggtggaaccgtggctgcgcggaaaccaattttgtattaagatcttgaatccctatatgccaagcgttgtagagactctggagcagatgcagagaaagcacggtggcatgctcgtgaggaaccctctttcgcgaaattctacacatgaaatgtactgggtcagttgcgggaccggaaacattgtgtccgcggttaatatgacgagccggatgctgttaaaccgtttcaccatggctcacagaaaacccacatatgagcgcgatgtggacctgggcgcaggtactaggcacgtcgccgtggaacctgaggtagctaacttggatatcatagggcagcggattgaaaatatcaagcatgagcacaaatcaacctggcattacgacgaggataacccatataagacatgggcctaccacggatcctatgaagtgaaaccctctggcagcgcaagttccatggttaatggcgtcgtgaagctcctgactaagccttgggacgtgatcccaatggtcacccaaattgccatgacagataccactccctttgggcagcagagagttttcaaagagaaggtggacacgcgcacaccgaaagctaagaggggaaccgcgcaaataatggaagtaactgccaaatggctatggggttttcttagccgaaacaagaagcctcggatctgtaccagagaggagttcacaaggaaagtgcgctctaatgcagctattggcgccgtctttgtggacgagaaccagtggaactcagcaaaggaggccgttgaagatgagcgtttctgggacctggtgcatcgggaaagagagctccacaaacaggggaagtgcgctacgtgcgtctacaacatgatgggaaaaagggaaaagaagctgggcgagtttggtaaagccaaggggagtcgcgcgatctggtacatgtggttgggagcacgattcctggagttcgaagccctcggctttatgaatgaggatcactggttctcccgggaaaacagcctttctggcgtggagggggagggactgcataaattaggttatattctgagagacatctcgaagataccaggcgggaatatgtacgctgatgacaccgccggatgggatactaggatcacagaagacgatttgcagaacgaggcacgcattaccgacatcatggaacccgagcacgctctcctggccaaatcaatttttaagctaacttatcaaaataaagtagttagagtgcagcggcctgctaagaacggcacagtcatggatgtgatcagcaggcgtgaccagcgaggttccggacaggtgggaacctacggccttaatacattcactaacatggaagcccaactgatacgccagatggagagtgagggcatattttctccaagcgaactcgagacccccaacctggcagaaagagtcttggattggttagagaagtatggggttgaacggctgaaaaggatggcgatctccggagacgactgtgtggtaaagccgatcgatgaccgcttcgccacggctctcaccgcccttaatgatatgggtaaagtgagaaaggacattcctcagtgggagccctcaaaaggctggaacgattggcagcaagtcccattttgcagtcatcacttccaccagctgataatgaaggacgggcgggagatcgtggttccttgtaggaatcaggatgagctggtgggacgagcacgtgtctctcagggcgctggttggagcctgagagagacagcctgcctcgggaagtcctacgcacaaatgtggcagttgatgtattttcatcgccgggacctgaggcttgccgcgaacgctatttgttcagccgtgcccgtagattggatcccaactagcagaaccacatggtctattcacgcacatcaccagtggatgactaccgaagacatgctgtccgtttggaatcgcgtgtggatcgaggaaaacccctggatggaggataaaacgcatataagtagctggggagacgtcccttacctcggcaagcgggaggaccaatggtgcggctcgttaatcgggctgacagccagggctacctgggccactaatattcaggtggcaatcaaccaggttcgaagattgattggaaatgaaaactacctggattatatgacatccatgaaacggttcaagaatgagtctgacccagaaggtgctctctggtga

SEQ ID NO: 13613 - RNA, 9879 nt, synthetic construct
  misc_feature 1..9879: note = derived and/or modified CDS sequence (opt3) from DENV-1__FJ024456__SS-prME
  source 1..9879: mol_type = other RNA
agcgtgaccatgctgctcatgcttatgcccacagcactggctttccacttgactacgagaggaggggaacctcatatgatcgtaaccaagcaggaaaggggaaaatccttactgtttaagacatctgccggtgttaacatgtgcattctaatagccatggacctcggcgaactgtgtgaagatactatgacctacaaatgcccacggatcacagaggcggaaccggacgatgtggactgttggtgcaatgctaccgatacttgggtaacatatgggacctgttcacaaacgggagagcaccgccgagacaagcgtagtgtggcccttgcaccccatgtcggcctgggtttggagactagaaccgaaacatggatgagctccgagggggcctggaaacagattcagagggtggaaacttgggctctccggcaccctggattcaccgttatcgcactgtttctggcccatgctattggcacatctatcacccagaagggcattatcttcattctcttaatgctggtgacgccatcgatggccatgcgctgcgtcgggatcggatcaagagattttgtggagggtcttagcggcgcgacttgggtagacgttgtgttggagcacgggagttgtgtcacaaccatggcaaaggataaacccactctggacattgaactactcaagacagaggtgaccaaccctgccgtgctgaggaaactttgcatcgaagctaagatatccaatacgaccacagattctcggtgtccaactcaaggagaggccaccctgatggaagaacaagacgcaaacttcgtctgccgccgaacatttgttgatagaggctggggtaatgggtgtggattgttcggcaaaggcagcctcattacttgcgctaagtttaagtgcgtgaccaaactggaggggaagatcgtacagtacgaaaacttaaaatattccgtgattgtcacagtgcacaccggagaccagcatcaagttggtaatgagtcaactgaacacggcacgacagccaccatcactccccaggcgcctaccagtgagatccagctgacagactacggggccctcacccttgattgtagcccaaggactggactggacttcaacgaaatggtgttgctaacaatgaaggagaaatcttggctggtccataagcagtggtttctcgatctgccgcttccctggacgtccggcgcatcaaccagccaagagacttggaatcggcaggacctgttggtgacattcaaaaccgctcacgccaagaagcaggaagtagttgtgctcggtagtcaagagggggctatgcacacagccctgactggcgcaaccgaaattcagacgtctggaaccacaactatatttgccggccatttaaaatgccgtctgaagatggataaactaaccctcaaggggatgtcctatgtcatgtgtacaggtagcttcaaactggagaaggaagtggctgagactcagcacggaaccgtccttgtgcagatcaagtacgagggcacggacgcgccttgcaaaattccattctcgacacaagatgaaaagggggttatccagaacggacgcttgataaccgcaaatcccattgtgactgacaaagagaagcctgtaaacatcgaagccgagccaccctttggcgagtcttatatcgtcattggtgtgggggaaaaagctctgaagctctcctggttcaagaaaggctcaagtatcggaaagatgtttgaggccacagcaagaggcgccaggcggatggctattctgggggataccgcctgggacttcggaagcataggtggcgtttttacttccgtggggaaacttgtccatcagatcttcggaaccgcatacggcgtgctgttttctggtgtaagctggacaatgaagattgggatcggcgtgttgctcacgtggctgggattaaattcacgaagtacctccctgagcatgacttgtatcgcggttggcctagtcacactctacctgggggtgatggtgcaggctgattctggatgcgtcattaactggaaaggccgcgaacttaagtgtggttcagggatattcgttaccaatgaggtgcacacatggactgaacaatataagtttcaggccgacagtccgaaaagattgagcgcagccatcggaaaggcttgggaggagggcgtgtgcggtattaggtccgccacccggctggaaaacatcatgtggaaacagatttctaacgagctcaatcatatcctgttagaaaacgacatgaagttcacggtagtcgtgggcgatgttgtggggatactggcacagggcaaaaagatgatccgccctcaacccatggagcacaaatactcgtggaaaagctggggcaaggctaagattatcggggccgacgtccagaatacaacctttattatcgatggaccaaacactcctgaatgtcccgacgatcagagagcgtggaatatatgggaggtggaggactatggcttcggtatttttaccacaaacatctggcttaagttgagggattcctacactcaggcctgcgaccaccgtctcatgtcagctgcaattaaagatagtaaggccgttcatgctgacatggggtattggatcgaatctgagaaaaatgaaacctggaagctggcccgggcatccttcatagaggtgaagacatgtatctggccaaaatcccacacgctatggtcaaacggagtactggaaagcgagatggtcattcccaagatctacggcggtcctatttctcaacataattatcgaccaggctacttcacccagactgcggggccgtggcacctcggaaaactggagcttgattttgacttgtgcgaaggcacaaccgtggtggtcgatgagcactgcgggaacagaggaccctccctgaggactacaaccgttacgggcaagatcatacatgaatggtgttgccgcagttgtactttacctccactccggttcaaaggtgaggacgggtgctggtacggaatggagattagacccgtgaaggaaaaggaggaaaatctggtaaaaagcatggtgtctgccggctccggtgaggtcgactcatttagtcttggcctgttgtgtatcagcatcatgattgaagaggtgatgaggtcgcgctggtcccgaaagatgctcatgaccgggacactggctgttttcctactgctcatcatgggacagctgacctggaacgatcttattcggttgtgcataatggtgggcgccaatgcatctgaccgtatggggatgggaactacatatctggctttaatggccacctttaaaatgagacctatgttcgcagtcggcctcctgtttaggcgccttacaagccgggaggtgctgctactcactatcggtctgtcattggttgccagtgtggaactgccaaactccttagaggaactcggggatggactggctatgggcattatgatccttaagctgttgaccgacttccaatctcaccagctctgggcgacgctgctaagcctgacatttattaaaaccactctttccctccattacgcctggaagaccatggcaatggtcctgtcaatcgtcagcttgttccccctgtgtttaagtacaacttctcagaagaccacgtggctcccggtgctgcttggctccctggggtgcaaacctttgacaatgtttctcatagctgagaataagatctggggaagaaaaagctggccactgaacgaaggtattatggccgttggcgtggtctcgatcctactgtcatctcttctcaagaacgatgtgcccctggccgggcctttgattgctggaggcatgttaatcgcatgttatgtaataagtggttccagcgccgacctgtctctcgagaaagcggctgaggtgagctgggaagaggaagccgagcactccggggcatcacataatattctggtcgaagttcaggatgacggaaccatgaagatcaaagatgaggagagggacgatactcttacaatcctgttgaaggccaccctactggctgtgagtggcgtgtaccccctcagcattccagcaactctgttcgtctggtatttttggcaaaagaaaaagcagcgatctggcgtgctttgggacacaccttcacccccagaagttgagcgcgccgtattagatgacgggatataccggatcatgcagagaggactgctcggtaggagccaggtgggcgtcggggtgttccaagaaaacgttttccacaccatgtggcacgtgacgcgtggagcggtcttgatgtatcagggcaaacgcctggagccgagttgggctagcgtgaagaaagacctcatttcctacggtgggggatggcggctgcagggctcttggaatactggcgaggaagtacaggtcatcgccgtggagcctgggaagaaccccaagaatgttcaaaccgcaccaggaacatttaaaacccccgaaggtgaggtgggcgccattgctcttgatttcaagcctgggacatcgggaagcccaatcgtcaacagagaaggcaaaatagtgggtctgtacgggaatggagttgtgactacctcaggcacgtatgtctccgccatcgcacaggctaaggccagtcaggagggccccttgcctgagattgaagacgaggtgtttaggaaacgaaacctaacaatcatggatctgcatccggggtctggaaagactcggcgctacctcccagcgattgtaagagaagccatcaagaggaaattacggaccctgatacttgcacccacacgagtggttgctagcgagatggccgaagctctgaagggtatgcctattagatatcaaaccactgcagtcaaatccgagcacaccggcaaggagatcgtggacctcatgtgccatgccacattcacgatgcgcttgctgtcaccagtgagggtccccaattacaacatgatcattatggatgaagcccactttactgacccttctagcatcgctgcgcgtgggtatataagtacccgggtaggaatgggcgaggcagccgctattttcatgacagccaccccgcccggttccgtggaagcatttccacagagcaatgccgttatccaggatgaggaaagagacattcctgagaggtcttggaactcagggtacgagtggatcactgatttccccggaaaaacagtgtggtttgtcccatccataaagagtggcaatgacattgctaactgtctccgcaagaatggcaaacgagtgatccagctgagcagaaagaccttcgatacggaatatcagaaaactaagaacaacgactgggactacgttgtgacaaccgatatctcggagatgggggcgaattttcgggccgacagggtcattgatcctcgccgttgccttaaacccgtgatcctaaaggacggaccagaaagagtaattctggcaggtccgatgcctgtgaccgttgcttctgccgcacagcggaggggccgcatagggcgaaaccataataaggagggagatcagtacatctatatgggccagcccttgaacaatgacgaggatcacgcccactggactgaagctaaaatgttactggacaacattaatacaccagagggtatcatccccgccctcttcgaacctgagagagaaaagtccgcggcaattgatggggagtaccggctgaggggcgaggcccgcaaaaccttcgtcgaacttatgagaaggggagacctgccagtgtggctcagctataaggtggcttcagagggctttcaatacagtgatcggcgttggtgcttcgacggggaacgcaacaatcaggtcttggaggaaaacatggatgttgagatatggacaaaagagggagaacgaaagaaactgagacccaggtggctagacgcccggacttattctgaccctctggctctccgcgagtttaaggagttcgcagccggtagaaggtccgtgagcggcgatcttatcctggagattgggaagttaccgcagcatttgacgcagcgggctcaaaatgccctggacaacctcgtaatgctgcacaattcagaacagggaggccgagcatacagacatgcgatggaggagcttccagataccatcgaaacactgatgctcttggccctgattgctgtgttaactggtggggtcaccctatttttcctgagtggccgcggactcggcaaaacaagcatcgggcttctgtgtgtgatggcctcctctgttttgctgtggatggcaagcgtggagccccactggatagctgcctccatcattctcgaatttttcctgatggtccttctcatccctgagcccgacaggcagcggaccccacaggataaccaactggcatatgtagtgattggattgctgtttatgatcttaactgttgccgctaatgagatgggtctactggaaacgaccaagaaagacctcggcatagggcacgtggcggtcgagaaccatcaccatgccacaatgcttgatgtggacctgcaccctgcatcagcttggactttgtacgccgtcgccaccacaattatcacccccatgatgcgtcatactattgaaaacacaacggcaaatatctctctgaccgctatagccaaccaggcggctatcctcatgggactggataagggctggccaattagtaaaatggacatcggtgtgcctcttttagccctggggtgctactcgcaggttaatccgctcactttgacagcagccgtgctgatgctagtagctcactatgcaattatcggccccggactgcaagccaaggcgaccagagaggctcagaagaggaccgccgcaggcataatgaaaaacccaacagtggatgggattgtcgccatcgacctcgatcctgttgtgtacgacgctaagttcgaaaaacagcttggacagatcatgctgttgattctgtgtactagccaaatcctcctgatgcgcacgacctgggccttatgcgagtccataacacttgcaactggccccctgaccacactctgggagggttctccagggaagttttggaataccactattgctgtctcaatggccaacatcttccggggaagctatctagcgggcgccggtctggcattttccttgatgaaaagtctgggcgggggacgaagaggcacgggggctcagggagaaacactcggcgagaagtggaagaggcagcttaatcagctgtctaaaagcgagttcaacatttacaagcgctcaggtatcatggaggtggaccggtccgaagccaaagaggggttgaagagaggagagaccactcgtcacgcagtaagtaggggcaccgctaaactgcggtggttcgtggaacgcaatctcgttaagcctgagggtaaggtgatagatttaggctgtgggcgaggaggctggagctattactgcgccgggctgaaaaaggtcacagaagtgaaaggatatactaagggcggtcccgggatggaggaaccgatcccaatggccaccaacggatggaatcttgtcaaactgcattctggcaaggacgtgtttttcacacctcccgagaaatgtgatacgctactctgcgacattggcgagtcctcaccaaaccccaccatcgaagaggggagaactctgagggttttgaagatggtagaaccttggctgcggggaaatcaattttgtattaagatcctcaacccgtacatgcccagcgtggtcgagacacttgagcagatgcagcgcaaacacggtggcatgctggtgagaaatccattatcgaggaactctacccatgaaatgtactgggttagttgcgggactggaaatattgtgtccgcggtcaacatgacaagccgaatgctgttgaaccggttcaccatggctcaccgtaagcctacgtatgagagagatgtggacctcggcgcaggtacccgccacgtagccgtggaacccgaggttgctaatctggatatcatagggcagaggattgaaaacatcaaacatgagcacaagtcaacatggcattacgacgaggataatccttataaaacttgggcctaccacggatcctatgaagtcaagccatctggcagcgcaagttccatggtgaacggcgtggtcaagctacttaccaaaccctgggacgttatccctatggtgacacaaattgccatgactgataccacaccatttgggcagcagcgggtattcaaggagaaagtggacaccagaactcccaaggctaaacgcggaacggcgcaaataatggaagtcacagccaggtggctgtggggttttctcagccgaaataagaagccgcggatctgtaccagagaggagttcactaggaaagtgcgctctaacgcagctattggcgccgtttttgtggacgagaatcagtggaactcagcaaaggaggccgtcgaagatgagcgtttctgggacctggtgcagaaagaacgggagttgcataagcaggggaaatgcgctacctgcgtatacaatatgatgggaaagagagaaaagaaactgggcgagtttggtaaggccaaagggagtagggcgatctggtatatgtggctcggagcacgcttccttgagtttgaagccctgggcttcatgaacgaggatcactggttctcccgagaaaatagcttatctggcgttgagggggagggactgcacaagttgggttacattctccgggacatctcgaaaatacctggcgggaacatgtacgctgatgacacagccggatgggatacgagaatcaccgaagacgatctgcaaaatgaggcaaagattactgacatcatggaaccagagcatgctctacttgccacatcaatttttaaactgacctatcagaacaaggtggtcagggtgcagcgccccgctaagaatggcactgtgatggatgtcatcagcagacgggaccagaggggttccgggcaagttggaacatacggcctcaacaccttcacaaacatggaagcccagctgatacgtcagatggagagtgagggcatatttttgccttctgaattagagactccaaatctggcagaacgagtgctcgattggcttgagaaacacggggtagaacgcctgaagagaatggcgatcagcggagacgactgtgtggtcaaacccatcgatgaccggttcgccaccgctctaacggccctgaacgatatgggtaaggtgaggaaagacattccgcagtgggagccttccaagggctggaatgattggcaacaggttcccttttgctcacatcacttccaccagctcataatgaaggacgggcgcgagatcgtggtcccatgtagaaaccaggatgaattggtgggacgggcaagggtaagtcaaggcgctggttggtctctgcgagagaccgcctgccttgggaaaagctatgcacagatgtggcagctgatgtactttcatcgtagagacctccgcttagccgcgaatgctatttgttccgccgttcctgtggattgggtccccacatcacggactacctggagcatccacgcacatcaccaatggatgacaactgaagacatgctgtctgtgtggaacagggtttggattgaggaaaatccatggatggaggataagacccatgtgtccagttggggagacgtcccctatttgggcaaaagagaggaccagtggtgcggcagcctgatcgggctcacggcccgcgctacatgggcctcgaacatacaggtggcaatcaatcaggtacggaggcttattggaaacgaaaattacctggattatatgacctccatgaagcgattcaaaaacgagggtgaccctgaaggcgctctatggtga

SEQ ID NO: 13614 - RNA, 9879 nt, synthetic construct
  misc_feature 1..9879: note = derived and/or modified CDS sequence (opt3) from DENV-1__FJ024457__SS-prME
  source 1..9879: mol_type = other RNA
agcgtgaccatgctgctcatgcttatgcccacggccctggctttccacttgactacgagaggaggggaacctcatatgatcgtctccaagcaggaaagaggaaaatctttactgtttaagacctcagccggtgttaatatgtgcacactaattgccatggacctcggcgaactgtgtgaagatactatgacctacaaatgcccacggattacagagaccgaaccggacgatgtggactgttggtgcaatgcgactgatacatgggtgacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccgggagcttcaaactggagaaggaagtcgccgagacgcagcacggtacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattgtgatcggtgccggggaaaaagctctgaagctctcctggttcaagaaaggctcaagtatcggaaagatgtttgaggccaccgcaagaggcgccaggcggatggctattctgggggatacagcctgggacttcggaagcatcggtggcgtttttacgtccgtggggaaacttgtccatcagattttcggaaccgcatacggcgtgctgttttctggtgtaagctggactatgaagatagggatcggcgtgttgctcacatggctgggattaaattcacgaagtacctccctgagcatgacatgtattgcggttggcctagtcactctctacctgggggtgatggtgcaggctgattctggatgcgtcatcaactggaaaggccgcgaacttaagtgtggttcagggatcttcgttaccaatgaggtgcacacgtggacagaacaatataagtttcaggccgacagtccgaaaagattgagcgcagccattggaaaggcttgggaggagggcgtgtgcggtataaggtccgccacccggctggaaaacatcatgtggaaacagatttctaacgagctcaatcatatcctgttagaaaacgacatgaagttcactgtagtcgtgggcgatgttgcagggattctggctcagggcaaaaagatgatccgccctcaacccatggagtacaaatattcgtggaaaagctggggcaaggccaagataatcggggcggacgtgcagaataccacatttattatcgatggaccaaacactcctgaatgtcccgacgatcagagagcctggaatatttgggaggtcgaggactacggcttcggtatctttaccacaaacatatggcttaagttgagggattcctatacacaggtgtgcgaccaccgtctcatgtcagctgcaattaaagatagtaaggccgttcacgctgacatggggtactggatcgaatctgagaaaaatgaaacctggaagctggcccgggcatccttcattgaggtgaagacttgtatctggccaaaatcccatacactatggtcaaacggagtactggaaagcgagatgataatccccaagatttatggcggtcctatctctcaacacaattaccgaccaggctacttcacccagactgcggggccgtggcatctcggaaaactggagcttgattttgacttgtgcgaaggcacaaccgtcgtggtggatgagcactgcgggaacagaggaccctccctgaggacgactaccgtcacaggcaagattatccacgaatggtgttgccgcagttgtaccttacctccactccggttcagaggtgaggacgggtgctggtatggaatggagataaggcccgttaaagaaaaggaggaaaatctggtaaagagcatggtatctgccggctccggtgaggtggactcatttagtcttggcctgttgtgtattagcatcatgatcgaagaggtcatgcgctcgcgatggtcccggaaaatgctcatgactgggacactggctgtgttctttctactgattatgggacagctcacctggaacgatctgatccgtctttgcattatggttggcgccaatgcatctgacagaatggggatgggaacaacttacttggctctgatggccaccttcaagatgaggcctatgtttgcagtgggcttactcttccgccggctgacgagcagagaggtccttctgctaacaataggtctctcactggtggccagtgttgaattgccaaactccctggaggaattaggggatggactcgctatgggcatcatgattctgaaacttctgaccgactttcaatctcatcagttgtgggcgactctcctgagcctaaccttcatcaagacaactttttccctgcactatgcctggaaaaccatggcaatggtgctttcaattgtcagcctcttccccctgtgtttgagtacgacatctcagaagaccacttggctgccggtattactcggctccctggggtgcaagcctcttacaatgtttctgatcgctgagaataaaatatggggaaggcgaagctggccattgaacgaaggtatcatggccgtgggcattgtttcgatcctcctgtcatctctactgaagaacgatgtgccccttgccgggcctctcattgctggaggcatgctgatcgcatgttacgtcataagtggttccagcgccgacttgtctttagagaaagcggctgaggtgagctgggaagaggaagccgagcattccggggcatcacacaatattctggtagaagtgcaggatgacggaaccatgaagatcaaagatgaggagcgcgacgatactctcacaatcctgcttaaggccaccctgttggctgtcagtggcgtttatcccctaagcattccagcaacgctgttcgtgtggtacttctggcagaaaaagaagcagcggtctggcgtgctctgggacactccttcacccccagaagtcgagagagccgtgctggatgacgggatatataggatcatgcagcgtggacttttaggtcgcagccaggttggcgtaggggtgtttcaagaaaacgtcttccataccatgtggcacgtgacacggggagcggttctgatgtaccagggcaaaagactcgagccgagttgggctagcgtgaagaaagacttgatttcctacggtgggggatggaggctgcagggctcttggaataccggcgaggaagtccaggtgatcgccgtagagcctgggaagaaccccaaaaatgtccaaacagcaccaggaacttttaagacccccgaaggtgaggtgggcgccattgctctcgatttcaagcctgggacgtcgggaagcccaatcgttaaccgagaaggcaaaatagtgggtctgtatgggaatggagtcgtgacaacttcaggcacctacgtttccgccatcgcacaggctaaggccagtcaggagggcccccttcctgagattgaagacgaggtgtttcggaaacgcaacctgacaatcatggatttgcacccggggtctggaaagaccagaaggtatctaccagcgattgtccgggaagccatcaaacgaaagctgagaactctcatattagcacccacccgcgtggtagctagcgagatggccgaagctctgaagggtatgcctattaggtaccaaacaacggcagtgaaatccgagcatactggcaaggagatcgttgaccttatgtgccacgccaccttcacaatgcgtctgctctcaccagtccgggtgcccaattataacatgatcattatggatgaagcccattttaccgacccttctagcatcgctgcgagagggtacataagtactagggtgggaatgggcgaggcagccgctattttcatgacagccaccccgcccggttccgtcgaagcatttccacagagcaatgccgtaatccaggatgaggaacgcgacattcctgagcgatcttggaactcagggtatgagtggatcacggatttccccggaaaaactgtgtggtttgttccatccataaagagtggcaatgacattgctaactgtttgaggaaaaatggcaagcgggtgatccagctgagcaggaagacattcgataccgaataccagaaaaccaagaacaacgactgggactacgtcgtgactacagatatctcggagatgggggcgaatttccgcgccgaccgtgttattgatcctagacggtgcctcaaacccgtgatcctgaaggacggaccagaaagggtcattcttgcaggtccgatgcctgtgaccgtagcttctgccgcacagcgccgaggcagaatagggcggaaccacaataaagagggagatcagtatatctacatgggccagcccctaaacaatgacgaggatcatgcccactggacagaagctaagatgctgttggacaacattaatactccagagggtatcatccccgccttatttgaacctgagagggaaaagtccgcggcaattgatggggagtatcgcctgagaggcgaggccaggaaaacgttcgtggaactcatgcggcgtggagacctgccagtttggcttagctacaaggtcgcttcagagggctttcaatatagtgatcgccgatggtgcttcgacggggaaagaaacaatcaggtgctggaggaaaacatggatgtggagatatggaccaaagagggagaaaggaagaaactccggccccgctggttggacgccagaacatactctgaccctctggctctaagggagtttaaggagttcgcagccggtcggcgatccgtcagcggcgatctgatcctcgagattgggaaacttccgcagcacctgactcagagagctcaaaatgccttagacaacttggttatgctgcataattcagaacagggaggccgcgcatataggcacgcgatggaggagctcccagataccatcgaaacactgatgcttctggccctcattgctgtgttgaccggtggggtaactctgtttttcttaagtggccggggactaggcaagacgagcatcgggctgctctgtgtgatggcctcctctgtccttctgtggatggcaagcgtggagccccattggatagctgcctccatcattttggaatttttcctgatggttctcctgatccctgagcccgaccgtcagagaaccccacaggataaccaacttgcatacgtggtcattggactcctgtttatgatcttgacagtagccgctaatgagatgggtctgttagaaactaccaagaaagacctaggcatagggcacgtggcggttgagaaccaccatcacgccgcaatgctggatgtggacctccatcctgcttcagcctggacactttacgccgtcgcaaccactattatcacacccatgatgaggcacacgattgaaaacaccactgctaatatctctctgacagccatagcgaaccaggctgccatcttgatgggactggataagggctggccaattagtaaaatggacatcggtgtgcctctcctggcacttgggtgctattcgcaggtcaatccgttaaccctgaccgccgctgtgctcatgttggttgcacattacgccattatcggccccggactgcaagcgaaggctacacgcgaggcccagaaacggactgcagccggcataatgaagaacccaacggtggatgggattgtagctatcgacctagatcctgtggtctatgacgccaagttcgaaaaacagctgggacagatcatgctccttattctgtgtaccagccaaatcttgctgatgcgaacaacttgggcactctgcgagtccataaccctggctacaggccccttaaccactctttgggagggttctccagggaagttttggaatacgacaattgccgtttcaatggcgaacatcttcagaggaagctacctggccggcgcaggtctcgctttctccctaatgaaaagtctgggcgggggaaggcgcggcaccggggcccagggagaaactttgggcgagaagtggaaacggcagctgaatcagctctctaagagcgaatttaacacctataagagatcaggtattatggaggtggaccgttccgaagcaaaagaggggcttaagaggggagagacaactaaacacgctgtcagtcggggcaccgccaagctgcgctggttcgtggaacgaaatttggtaaaacctgagggtaaggtgatcgatctgggctgtgggagaggaggctggagctactattgcgccgggctcaagaaagttacagaagtgaagggatacacgaaaggcggtcccgggcacgaggaaccgataccaatggcgacctacggatggaacttagtcaagctgcattctggcaaagacgtgtttttcatccctcccgagaagtgtgatactcttctgtgcgacattggcgagtcctcaccaaatcccacaatcgaagaggggaggaccctacgggtcctcaaaatggtggaaccttggctgcgcggaaaccaattttgtattaagatcttgaatccgtatatgcccagcgttgtagagactctggagcagatgcagagaaagcacggtggcatgctcgtgaggaacccactttcgcgaaattctacacatgaaatgtactgggtcagttgcgggaccggaaacattgtgtccgctgttaatatgacgagccggatgctgttaaaccgtttcaccatggcacacagaaaacctacatatgagcgcgatgtggacctgggcgccggtactaggcacgtcgctgtggaacccgaggtagccaacttggatatcatagggcagcggattgaaaatatcaagcatgagcacaaatcaacctggcattacgacgaggataacccttataagacatgggcataccacggatcctatgaagtgaaaccatctggcagcgccagttccatggttaatggcgtcgtgaagctcctgactaagccctgggacgtgatccctatggtcacccaaattgctatgacagataccactccatttgggcagcagagagttttcaaagagaaggtggacacgcgcacacccaaagcgaagaggggaaccgcccaaataatggaagtaactgcaaaatggctatggggttttcttagccgaaacaagaagccgcggatctgtaccagagaggagttcacaaggaaagtgcgctctaatgctgccattggcgcagtctttgtggacgagaaccagtggaactcagccaaggaggctgttgaagatgagcgtttctgggacctggtgcatcgggaaagagagctccacaaacaggggaagtgcgccacgtgcgtctacaacatgatgggaaaaagggaaaagaagctgggcgagtttggtaaagcgaaggggagtcgcgcaatctggtacatgtggttgggagcccgattcctggagttcgaagctctcggctttatgaatgaggatcactggttctcccgggaaaacagcctttctggcgtggagggggagggactgcataaattaggttatattctgagagacatctcgaagatacctggcgggaatatgtacgccgatgacaccgcaggatgggatactaggatcacagaagacgatttgcagaacgaggctcgcattaccgacatcatggaaccagagcacgccctcctggctagatcaatttttaaactaacttatcaaaataaggtagttcgggtgcagaggcccgccaaaaacggcacagtcatggatgtgatcagccgtcgagaccagcgcggttccggacaggtgggaacctacggccttaatacattcactaacatggaagcacaactgataagacagatggagagtgagggcatattttctcctagcgaactcgagaccccaatcctggcggaacgggtcttggattggttagagaagtatggggttgaaaggctgaagcgcatggccatctccggagacgactgtgtggtaaaacccattgatgacagattcgctacggccctcaccgcacttaacgatatgggtaaggtgcggaaagacataccgcagtgggagccttcaaagggctggaatgattggcagcaagtccccttttgcagtcatcacttccaccagctgatcatgaaagacgggagggagattgtggttccatgtcgaaaccaggatgagctagtgggacgtgctagagtctctcagggcgccggttggagcctgcgcgagacagcatgcctcgggaagtcctacgcccaaatgtggcagttgatgtattttcatcggagggacctgagacttgcggctaatgccatctgttcagcagtgcctgtagattggattcccactagccgcaccacatggtctatccacgcccatcaccagtggatgactaccgaagacatgctgtccgtttggaaccgggtgtggatagaggaaaatccatggatggaggataagacgcatatcagtagctggggagacgtcccctacctcggcaaaagggaggaccaatggtgcggctcgttaattgggctgacagctcgagccacctgggcaactaacatccaggtggctattaatcaggttagacggttgatcggaaacgaaaattacctggattatatgacatccatgaagaggttcaaaaacgagtctgaccctgaaggtgccctctggtga

SEQ ID NO: 13615 - RNA, 9879 nt, synthetic construct
  misc_feature 1..9879: note = derived and/or modified CDS sequence (opt3) from DENV-1__FJ205881__SS-prME
  source 1..9879: mol_type = other RNA
agcgtgaccatgctgctccttctgatgcccacagccttggctttccacttaactacgagaggaggggaacctcatatgatcgtctccaagcaggaaagaggaaaatctctgctatttaagacctcagccggtgttaatatgtgcacactcattgccatggacctgggcgagctttgtgaagatactatgacctacaaatgcccacggattacagagaccgaaccggacgatgtggactgttggtgcaatgcgactgatacatgggtaacctatgggacgtgtagtcaaactggagagcaccgccgagacaagcgtagcgtggctctggcaccccatgtcggcttgggtctcgagaccagaacagaaacttggatgtcctctgagggggcatggaaacagatccagagggtggaaacctgggccctgcggcaccctggattcacagttattgctctgtttctcgcacatgccatcggcacctcgattacgcagaagggcatcatattcatcttactgatgcttgtgactccatcaatggctatgcgctgcgtcgggattggaagcagagattttgtggagggtttgagtggcgccacatgggtagacgttgtgctggagcacgggtcctgtgtcaccactatggcgaaggataaacccacactagacatcgaactcctgaagaccgaggtgacgaaccctgcagtgcttaggaaactgtgcattgaagccaagatctctaataccacaactgatagccggtgtccaacccaaggagaggctacattggtcgaagaacaagacgccaacttcgtttgccgccgaacttttgtggatagaggctggggtaatgggtgtggactcttcggcaaaggctccctgataacctgcgcaaagtttaagtgcgtaacaaaattagaggggaagattgtgcagtacgaaaacctgaaatattcagtcatcgtgaccgttcacactggagaccagcatcaagtgggtaatgagagtacggaacacggcacaaccgctactattacaccccaagcccctaccaccgagatccagctcactgactacggggcgcttacactggattgtagcccaaggacgggattggacttcaacgaaatggtcctactgaccatgaaggagaaatcttggctcgtgcataagcagtggtttctggatcttccgctgccctggacttccggcgcctcaacaagccaagagacctggaatcggcaggacttgctcgtaacattcaaaactgcacacgctaagaagcaggaagttgtggtcctgggtagtcaagagggggccatgcacaccgctttaacgggcgccaccgaaatccagacatctggaactaccacaatttttgcaggccatctgaaatgccgtctaaagatggataaactcactctgaaggggatgtcctatgtgatgtgtaccgggtcgttcaaacttgagaaggaattggccgagacgcagcacggtacagtcctggtgcagataaagtacgagggcaccgacgctccttgcaaaatcccattctcgactcaagatgaaaagggggttacacagaacggacgcctcattaccgcgaatcccatcgtgactgacaaagagaagcctgtaaacatagaagcagagccaccctttggcgagtcttatattgtcatcggtgccggggaaaaagctctgaaactttcctggttcaagaaaggctcaagtatcggaaagatgtttgaggccaccgcaagaggcgccaggcggatggctattctgggggatacagcctgggacttcggaagcatcggtggcgtgtttacgtccgttgggaaattggtgcatcagattttcggaaccgcatacggcgtcctcttttctggtgtgagctggactatgaagatagggatcggcgtactgttaacatggctgggactaaattcacgaagtacctccctcagcatgacatgtattgcggtgggcctggttactctttacttgggggtcatggtgcaggctgattctggatgcgtgatcaactggaaaggccgcgaactgaagtgtggttcagggatcttcgtcaccaatgaggttcacacgtggacagaacaatataagtttcaggccgacagtccgaaaagactcagcgcagccattggaaaggcttgggaggagggcgtgtgcggtataaggtccgccacccggctggaaaacatcatgtggaaacagatttctaacgagttaaatcatatcctgcttgaaaacgacatgaagttcactgtggtagtcggcgatgtggcagggattttggctcagggcaagaagatgatccgccctcaacccatggagtacaaatattcgtggaaaagctggggcaaggccaagataatcggggcggacgttcagaataccacatttattatcgatggaccaaacactcctgaatgtcccgacgatcagagagcctggaatatttgggaggtggaggactacggcttcggtatctttaccacaaacatatggctcaagctgagggattcctatacgcaggtctgcgaccaccgtctaatgtcagctgcaattaaagatagtaaggccgtgcacgctgacatggggtactggatcgaatctgagaaaaatgaaacctggaagctggcccgggcatccttcattgaggttaagacttgtatctggccaaaatcccatacactctggtcaaacggagtgctggaaagcgagatgataatccccaagatttatggcggtcctatctctcaacacaattaccgaccaggctacttcacccagactgcggggccgtggcatcttggaaaattggagctggattttgacttatgcgaaggcacaaccgtagtcgtggatgagcactgcgggaacagaggaccctccctcaggacgactaccgtgacaggcaagattatccacgaatggtgttgccgcagttgtaccctgcctccacttcggttcagaggtgaggacgggtgctggtatggaatggagataaggcccgtcaaagaaaaggaggaaaatctggttaagagcatggtgtctgccggctccggtgaggtagactcatttagtttgggcctcctgtgtattagcatcatgatcgaagaggtgatgcgctcgcgatggtcccggaaaatgctaatgactgggacactggctgtcttctttctcctgattatgggacagcttacctggaacgatttgatccgtctgtgcattatggtgggcgccaatgcatctgacagaatggggatgggaacaacttacttagctctcatggccaccttcaagatgaggcctatgtttgcagttggcctgcttttccgccggctgacgagcagagaggtgctactcctgacaataggtttgtcactggtcgccagtgtggaattaccaaactccctcgaggaactgggggatggacttgctatgggcatcatgattctgaaattgctcaccgactttcaatctcatcagctgtgggcgactctactgagccttaccttcatcaagacaactttttccctccactatgcctggaaaaccatggcaatggttctgtcaattgtgagcttgttccccctgtgtttaagtacgacatctcagaagaccacttggctcccggtcctgcttggctccctggggtgcaagcctttgacaatgtttctcatcgctgagaataaaatatggggaaggcgaagctggccactgaacgaaggtatcatggccgtaggcattgtgtcgatcctactgtcatctcttctcaagaacgatgttcccctggccgggcctttgattgctggaggcatgttaatcgcatgttacgtgataagtggttccagcgccgacctgtctctcgagaaagcggctgaggtcagctgggaagaggaagccgagcattccggggcatcacacaatattctggtggaagtacaggatgacggaaccatgaagatcaaagatgaggagcgcgacgatactcttacaatcctgttgaaggccaccctactggctgtgagtggcgtctatcccctcagcattccagcaacgctgttcgtttggtacttctggcagaaaaagaagcagcggtctggcgtgctttgggacactccttcacccccagaagtggagagagccgtcttagatgacgggatatataggatcatgcagcgtggactgctcggtcgcagccaggtgggcgttggggtatttcaagaaaacgtgttccataccatgtggcacgtcacacggggagcggtgttgatgtaccagggcaaaagactggagccgagttgggctagcgttaagaaagacctcatttcctacggtgggggatggaggctgcagggctcttggaataccggcgaggaagtgcaggtcatcgccgtggagcctgggaagaaccccaaaaatgtacaaacagcaccaggaacttttaagacccccgaaggtgaggtcggcgccattgctcttgatttcaagcctgggacgtcgggaagcccaatcgtgaaccgagaaggcaaaatagttggtctgtatgggaatggagtggtcacaacttcaggcacctacgtgtccgccatcgcacaggctaagacaagtcaggagggccccttgcctgagattgaagacgaggtttttcggaaacgcaacctaaccatcatggatctgcacccggggtctggaaagactagaaggtatctcccagccattgtgcgggaagcgatcaaacgaaagttaagaaccctgatacttgcccccacacgcgtcgtggcaagcgagatggctgaagccctgaagggtatgcctattaggtaccaaacgactgctgtaaaatccgagcataccggcaaggagatcgtggacctcatgtgccacgcaacattcaccatgcgtttgctgtcaccagttcgggtccccaattataacatgatcattatggatgaagcccattttactgacccttctagcatcgccgctagagggtacataagtacaagggtgggaatgggcgaggcggcagccattttcatgaccgctacgccgcccggttccgtggaagcctttccacagagcaatgcagtcatccaggatgaggaacgcgacattcctgagcgatcttggaactcagggtatgagtggatcactgatttccccggaaaaacagtatggtttgtgccatccataaagagtggcaatgacattgccaactgtctcaggaaaaatggcaagcgggttatccagctgagcaggaagaccttcgataccgaataccagaaaactaagaacaacgactgggactacgtggtcacaaccgatatctcggagatgggggctaatttccgcgcggaccgtgtgattgatcctagacggtgccttaaacccgttatcctaaaggacggaccagaaagggtgattctggccggtccgatgcctgtcacagtggcatctgctgcccagcgccgaggcagaatagggcggaaccacaataaagagggagatcagtatatctacatgggccagcccttgaacaatgacgaggatcatgcacactggactgaagccaagatgttactggacaacattaatacgccagagggtatcatccccgctctctttgaacctgagagggaaaagtccgccgcgattgatggggagtatcgcctgagaggcgaggcaaggaaaaccttcgtagaacttatgcggcgtggagacctgccagtgtggctcagctacaaggttgcctcagagggctttcaatatagtgatcgccgatggtgcttcgacggggaaagaaacaatcaggtcttggaggaaaacatggatgtggagatatggacaaaagagggagaaaggaagaaactgcggccccgctggctagacgctagaacttactctgaccctctggccctcagggagtttaaggagttcgctgcaggtcggcgatccgtgagcggcgatcttatcctggagattgggaaattaccgcagcacttgacccagagagcccaaaatgctctggacaacctcgtcatgctgcataattcagaacagggaggccgcgcctataggcacgcaatggaggagcttccagatacaatcgaaaccctgatgctcttggcgctgattgccgttttaactggtggggtgacgctatttttcctgagtggccggggactcggcaagaccagcatcgggcttctgtgtgtaatggcttcctctgtgttgctgtggatggccagcgtcgagccccattggatagcagcttccatcattctcgaatttttcctgatggtgcttctcatccctgagcccgaccgtcagagaacaccacaggataaccaactggcctacgttgtgattggattgctgtttatgatcttaactgtcgcagccaatgagatgggtctactggaaaccacaaagaaagacctcggcatagggcacgtagctgtggagaaccaccatcacgcggccatgcttgatgttgacctgcatcctgcatcagcttggaccttgtacgccgtggccactacaattatcacgcccatgatgaggcacaccattgaaaacactacagcaaatatctctctgaccgctatagccaaccaggcggctatcctcatgggactggataagggctggccaattagtaaaatggacatcggtgtccctcttttagccctggggtgctatagccaggtgaatccgctcaccttgacagcagccgtcctgatgctagtggctcattacgcaattatcggccccggactgcaagccaaggcgactcgcgaggctcagaaacggacggccgcaggcataatgaagaacccaaccgttgatgggattgtggccatcgacctcgatcctgtagtgtatgacgctaagttcgaaaaacagcttggacagatcatgctgttgattctgtgtacaagccaaatcctcctgatgcgaactacctgggccttatgcgagtccataacacttgcaaccggccccctgactacgctctgggagggttctccagggaagttttggaatacaaccattgctgtctcaatggccaacatcttcagaggaagctacctagcgggcgccggtctggcattctccttgatgaaaagtctgggcgggggaaggcgcggcactggggctcagggagaaaccctcggcgagaagtggaaacggcagcttaatcagctgtctaagagcgaatttaacacatataagagatcaggtattatggaggttgaccgttccgaagccaaagaggggttgaagaggggagagactaccaaacacgcagtgagtcggggcacagctaagctgcgctggttcgtcgaacgaaatctcgtgaaacctgagggtaaggtaatcgatttaggctgtgggagaggaggctggagctactattgcgccgggctgaagaaagtgacggaagttaagggatacaccaaaggcggtcccgggcacgaggaaccgataccaatggccacttacggatggaaccttgtgaagctgcattctggcaaagacgtctttttcatccctcccgagaagtgtgatacactactctgcgacattggcgagtcctcaccaaatcccaccatcgaagaggggaggactctgcgggtgttgaaaatggtcgaaccttggctgcgcggaaaccaattttgtattaagatcctcaatccgtatatgcccagcgtggttgagacacttgagcagatgcagagaaagcacggtggcatgctggtaaggaacccattatcgcgaaattctacccatgaaatgtactgggtgagttgcgggacgggaaacattgtctccgcggtgaatatgaccagccggatgctgttgaaccgtttcacaatggctcacagaaaacctacttatgagcgcgatgttgacctcggcgcaggtaccaggcacgtggccgtcgaacccgaggtggctaacctggatatcatagggcagcggattgaaaatatcaagcatgagcacaaatcaacatggcattacgacgaggataacccttataagacttgggcctaccacggatcctatgaagtaaaaccatctggcagcgcaagttccatggtgaatggcgttgtcaagctacttaccaagccctgggacgtgatccctatggtgacacaaattgccatgaccgatactacgccatttgggcagcagagagtcttcaaagagaaggttgacacacgcacccccaaagctaagaggggaactgcgcaaataatggaagtgaccgccaaatggctgtggggttttctcagccgaaacaagaagccgcggatctgtacaagagaggagttcacgaggaaagtacgctctaatgcagctattggcgccgtgtttgtcgacgagaaccagtggaactcagcaaaggaggccgtggaagatgagcgtttctgggacctggttcatcgggaaagagagttgcacaaacaggggaagtgcgctacctgcgtgtacaacatgatgggaaaaagggaaaagaagctgggcgagtttggtaaagccaaggggagtcgcgcgatctggtacatgtggctcggagcacgattccttgagttcgaagccctgggctttatgaatgaggatcactggttctcccgggaaaacagcttatctggcgtcgagggggagggactgcataaattgggttatattctcagagacatctcgaagatacctggcgggaatatgtacgctgatgacactgccggatgggatacaaggatcaccgaagacgatctgcagaacgaggcacgcattactgacatcatggaaccagagcacgctctacttgccaaatcaatttttaagctgacatatcaaaataaagtggtaagagttcagcggcccgctaagaacggcaccgtgatggatgtcatcagcaggcgtgaccagcgaggttccggacaggtgggaacatacggcctcaatactttcaccaacatggaagcccaactgatacgccagatggagagtgagggcatattttctcctagcgaattggagacgccaaacttagcagaaagagtgctggattggctcgagaagtatggggtcgaacggcttaaaaggatggcgatctccggagacgactgtgttgtgaagcccatcgatgaccgcttcgccaccgctctgacagccctaaatgatatgggtaaagtaagaaaggacattccgcagtgggagccttcaaaaggctggaacgattggcagcaagtgcccttttgcagtcatcacttccaccagctgataatgaaggacgggcgggagatcgtcgtgccatgtaggaatcaggatgaactcgttggacgagcacgtgtgtctcagggcgctggttggagcttgagagagactgcctgcctggggaagtcctacgcacaaatgtggcagcttatgtattttcatcgccgggacctgaggctcgccgcgaacgctatttgttcagccgtccctgtggattggatccccaccagcagaacaacttggtctattcacgcacatcaccagtggatgaccacggaagacatgttatccgtatggaatcgcgtttggatcgaggaaaacccatggatggaggataaaacacatataagtagctggggagacgtgccctacctgggcaagcgggaggaccaatggtgcggctcgttgatcgggctgaccgccagggctacttgggccacaaatattcaggtcgcaatcaaccaggtgcgaagactcattggaaatgaaaactaccttgattatatgacctccatgaaacggttcaagaatgagtctgaccctgaaggtgctctgtggtga

SEQ ID NO: 13616 - RNA, 9879 nt, synthetic construct
  misc_feature 1..9879: note = derived and/or modified CDS sequence (opt3) from DENV-1__FJ205882__SS-prME
  source 1..9879: mol_type = other RNA
agcgtgaccatgctgctcatgcttatgccaacagcactggctttccacttgactacgcgaggaggggaacctcatatgatcgtctccaagcaggaaaggggaaaatctttactgtttaagacctcagccggtgttaacatgtgcacactaattgccatggacctcggcgaactgtgtgaagatactatgacctacaaatgcccacggattacagaagcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccgtgctgaggaaactttgcattgaagctaagatctctaatacgaccacagatagccggtgtccaactcaaggagaggccaccctggtcgaagaacaggacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctagcaccgagatccagctgacagactacggggccctcacccttgattgttctccaaggactggactggacttcaacgaaatggtcttgctaacaatgaaggagaaatcctggctggtgcataagcagtggtttctcgatctgccgcttccctggacgtcaggcgcaagcaccagtcaagagacttggaatcggcaggacctgttggtaacattcaaaaccgctcacgccaagaagcaggaagttgtggtcctcggttctcaagagggggctatgcacacagccctgactggcgcaaccgaaatccagacgtccggaaccacaactatttttgccggccatttaaaatgccgtctgaagatggataaactaaccctcaaggggatgagctatgtgatgtgtacaggatcgttcaaactggagaaggaagtcgctgagactcagcacggtaccgtgcttgttcagataaagtacgagggcacggacgcgccttgcaaaatcccattctctacacaagatgaaaagggggtgacccagaacggacgcttgattactgcaaatcccatcgtaacagacaaagagaagcctgtcaacatagaagccgagccaccctttggcgagtcctatattgtgatcggtgctggggaaaaagccctgaagctctcatggttcaagaaaggcagtagcatcggaaagatgtttgaggcaaccgccagaggcgctaggcggatggccattctgggggatactgcatgggacttcggatccatcggtggcgtttttacctctgtggggaaacttgtccatcagattttcggaacagcgtacggcgtgctgtttagcggtgtatcatggacgatgaagatagggatcggcgtgttgctcacctggctgggattaaatagtcgatccactagcctgtctatgacatgtattgctgttggcctagtcaccctctacctgggggtgatggtgcaggccgattcaggatgcgtcatcaactggaaaggccgcgaacttaagtgtggtagtgggatcttcgttacaaatgaggtgcacacttggaccgaacaatataagtttcaggcagacagcccgaaaagattgtccgccgctattggaaaggcctgggacgagggcgtgtgcggtataaggtctgcaacgcggctggagaacatcatgtggaaacagatttcgaacgaactcaatcatatcctgttagagaacgatatgaagttcacagtagtcgtgggcgacgttgctgggattctggcccagggcaagaagatgatccgccctcaacccatggaatacaaatatagctggaagtcctggggcaaggcgaaaataatcggggccgatgtgcagaataccacttttattatcgacggaccaaacacccctgagtgtcccgatgaccagagagcttggaatatttggaaggtcgaagatcacggcttcggtatctttccaacaaacatatggcttaaattgagggactcatacactcaggtgtgcgatcaccgtctcatgagtgcagccattaaggactctaaagctgttcatgccgatatggggtattggatcgagagcgagaagaatgaaacctggaagctggcacgggcgtccttcattgaggtgaaaacatgtatctggcccaagtcacacacgctatggagcaacggagtactggaatctgagatgataatccctaaaatttacggcggtccaatctcccaacataattatcgaccgggctacttcacccagactgccgggccctggcacctcggaaagctggaacttgactttaacttgtgcgagggcacaaccgtcgtggtggatgagcactgcgggaatagaggacctagtctgaggactacaaccgtcacgggcaaaattatccatgaatggtgttgccgcagctgtactttaccacccctccggttcaagggtgaggacgggtgctggtacggaatggaaataagacctgttaaggagaaagaggaaaacctggtgaagtctatggtatccgctggctcaggtgaggtggacagttttagccttggcctgttgtgtatttcgatcatgatcgaagaggtcatgaggtcccgctggtctcgaaaaatgctcatgaccgggacactggccgtgttctttctactgattatgggacagctcacctggaatgatctgatccggctttgcattatggttggcgcaaacgctagcgaccgtatggggatgggaactacatatttggccctgatggcaaccttcaagatgagaccaatgttagccgtgggcctcctgtttaggcgccttacatcacgggaagtcctgctactcactataggtctgagtttggtggcttccgttgagctgcccaattctttagaggaactcggggatggactggcgatgggcatcatgattcttaaactgttgaccgacttccaaagccaccagctctgggccacgctgctatccctgacatttatcaagaccacttactcacttcattatgcatggaagaccatggctatggtgctcagcattgtcagtctgttcccgttgtgtctgtctacaacttcccagaaaaccacgtggttacctgtactcctgggcagccttgggtgcaagccactgacaatgtttttgatcgccgagaacaaaatatggggaagaaagtcgtggcccctcaacgaaggtatcatggccgtgggcattgtttcaatcctgctatctagtctgcttaaaaatgatgtgcctctcgctgggcccctgattgcaggaggcatgttgatcgcctgttacgtcatatccggtagctctgcggacttaagcctggagaaggctgccgaagtgtcctgggaggaggaagcagagcactcaggggccagtcataacattctcgtagaagtgcaggatgacggaaccatgaaaatcaaggatgaggaaagggacgatactctgacaatccttctgaaggctaccttgctagcagtcagcggcgtttatccactgtctattcctgccactctcttcgtgtggtacttttggcagaagaagaaacagcgatccggcgtgctgtgggacacaccctcaccaccggaggtcgagcgcgcggtgcttgatgacgggatatatcggatcatgcagagaggattactgggtaggagtcaggttggcgtaggggtgttccaagaaaatgtcttccacaccatgtggcacgtgacgcgtggagctgttctcatgtaccagggcaagcgcttggagcctagctgggcctccgtgaaaaaggacctgatttcttacggtgggggatggcggctccagggctcgtggaacactggcgaagaggtccaggtgatcgcagtagagcccgggaagaatcccaagaatgtccaaaccgcccccggaacatttaagaccagcgaaggtgaggtgggcgctattgccctggatttcaaacctgggacatcaggatccccaatcgttaatagagaaggcaagatagtgggtctttatgggaacggagtcgtgactaccagtggcacgtacgtttctgcaatcgctcaggccaaagcgagccaggagggccccctgcctgaaattgagaatgaggtgtttaggaagcgaaacttgacaatcatggacctacatccggggtccggaaagactcggcgctatctgccagccattgtcagagaagcaatcaaaaggaagctccggaccttaatactggctcccacacgagtggtagcctcagagatggctgaagcacttaaaggtatgcctattagataccaaaccactgccgtgaagtctgagcacaccggcaaagaaatcgttgatctgatgtgccatgccacattcacgatgcgcctcttgagcccagtcagggtgcccaattataacatgatcattatggacgaggctcactttactgatcctagttccatcgcggcacgtgggtacataagcacccgggtgggaatgggcgaggccgctgccattttcatgacagcaaccccgcccggttctgtcgaagcctttccacagtcaaatgctgtaatccaggacgaggaaagagatattcctgagaggtcctggaacagtgggtatgaatggatcactgacttccccggaaagacagtgtggtttgttccaagcataaagtcgggcaatgatattgcgaactgtctgcgcaaaaacggcaagcgagtgatccagctctctagaaaaaccttcgacacggagtaccaaaagactaaaaataacgattgggactacgtcgtgacaaccgacatctccgagatgggggccaattttcgggcagatagggttattgaccctcgccgttgcctgaagcccgtgatccttaaggatggaccagaaagagtcattctagctggtccgatgcctgtgaccgtagccagcgcagcccagcggaggggccgcatagggcgaaaccataataaagagggagaccagtatatctacatgggccagcccctgaacaatgatgaagaccacgctcactggactgaggccaagatgttgttagataacattaatacaccagagggtatcatccccgcgctgttcgaacctgagagagaaaaatcagcagccattgacggggagtatcggctcaggggcgaagctcgcaagaccttcgtggagctgatgagaaggggagatcttccagtttggctgagttacaaagtcgcctctgagggctttcaatattccgaccggcgttggtgcttcgatggggaacgcaacaatcaggtgctcgaggaaaacatggacgtggagatatggacaaaggaaggagagaggaaaaagttgagacccagatggctggatgctcggacttacagcgaccctctagcactgcgcgagtttaaggagttcgccgctggtagaaaatcagtcagtggcgacctcatccttgagattgggaagctgccgcagcatttaacgcagagggcccaaaatgcattggataacctggttatgctccacaatagcgaacagggaggccgggcgtatcgacatgccatggaggaactgccagacaccatcgagacacttatgctgctcgctttgattgccgtgctgactggtggggtaaccttatttttcctatccggcagaggactgggcaaaacatctatcgggctcctttgtgtgatggcaagctccgtcctgttgtggatggcttcagtggagccccactggatagccgcatctatcattctggaatttttcctcatggttctgcttatccctgagcccgatcgccagaggaccccacaggacaaccaactcgcctacgtggtcattggactgttgtttatgatcctgactgtagctgcgaacgaaatgggtttactagagacgaccaagaaagatctgggcatagggcacgtggccgttgagaatcatcaccatgcagctatgctcgacgtggatcttcaccctgccagtgcctggacactgtacgcagtcgctactaccattatcacacccatgatgcggcataccattgaaaacactacagccaatatctcgttgacggcgatagctaaccaggccgcaatcctgatgggactcgacaagggctggccaattagcaagatggatatcggtgtgcctctgcttgccttagggtgctattcccaggtcaatccgctgaccctcactgctgcagtgttgatgctggttgcccactacgcgattatcggccccggactacaagctaaagccacacgtgaggcacagaagagaaccgccgctggcataatgaaaaacccaaccgtggacgggattgtagccatcgatctggaccctgtggtctatgatgcaaagttcgaaaaacagctcggacagatcatgcttctgattttgtgtacatctcaaatcctgctcatgaggactacgtgggctctgtgcgagtcaataaccttagccacaggcccccttactaccctgtgggaaggtagcccagggaagttttggaatacaaccattgcggtttccatggccaacatcttccgcggaagttacctcgcaggcgctggtctagccttttctctgatgaaatcattgggcgggggacggcgaggcactggggcacagggagagacgctgggcgagaaatggaagagacagctcaatcagcttagcaaatccgagttcaacacatataagaggagtggtattatggaggtggaccgcagcgaagctaaagaggggctgaagcggggagaaaccactaagcacgccgtctctagaggcaccgccaaattgcgttggttcgtggagaggaatctggtaaagcctgagggtaaagtgatcgacctcggctgtgggcggggaggctggtcctactattgcgcggggttaaagaaagttacagaagtgaagggatacactaaaggcggtcccgggcatgaggaaccgataccaatggctacctacggatggaacctggtcaaacttcactcaggcaaggatgtgtttttcatccctcccgagaaatgtgacacactgctatgcgatattggcgaaagctcgccaaatcccacgatcgaggaggggcgcaccctccgagtcctgaagatggtggaaccttggttgagaggaaaccaattttgtattaaaatcctgaatccgtatatgccctctgttgtagagactctcgaacagatgcagaggaagcatggtggcatgcttgtgcggaacccactgagtcgcaattccacacacgagatgtactgggtcagctgcgggaccggaaacattgtgtcagcagttaacatgacttccagaatgttactgaataggttcacaatggcccaccgaaaacctacctatgagcgggacgtggatttgggcgctggtacgcgtcatgtcgccgtggaacccgaggtagcaaacctcgacatcatagggcagagaattgaaaatatcaagcacgagcataagtctacctggcactacgatgaagacaacccttataaaacatgggcctaccatggaagctatgaggtgaagccaagtggctccgctagctctatggttaatggcgtcgtgaaactgctaactaagccctgggatgtgatccctatggtcacccaaattgcgatgacagacactaccccatttgggcagcagcgcgttttcaaagagaaggtggatacaaggacccccaaggccaaacggggaactgcacaaataatggaagtaacggctaagtggctttggggttttctgtcaagaaacaaaaagccgcgcatctgtacaagggaggagttcacccgaaaagtgcggagtaatgccgcaattggcgccgtctttgtggacgagaaccagtggaactccgctaaggaagccgttgaggacgagagattctgggatctcgtgcacagggaacgcgagctgcacaagcaggggaaatgcgcgacttgcgtctacaacatgatgggaaagcgtgagaaaaagttgggcgagtttggtaaagcaaaggggagccgggccatctggtacatgtggctgggagctagattcctcgaatttgaggcccttggcttcatgaatgaggaccattggttctctagggaaaactcgctgtcaggcgtggagggggaaggattacacaaactgggttatattttgcgcgatatcagcaagatacctggcgggaatatgtacgcagacgataccgctggatgggacacacgaatcacggaggatgacctccagaacgaggccaagattaccgatatcatggaaccagagcatgctctgctagccaaatccatttttaaacttacttatcaaaataaagtagttcgggtgcagagacccgcaaagaacggcacagtcatggacgtgatcagtaggcgcgatcagagaggttctgggcaagtgggaacctacggcctgaacactttcacaaatatggaagcgcaactcatacggcagatggagagcgaaggcatattttccccttcagagctggagaccccaaacttggccgggagggtcttagactggctggaaaaacacggagttgagcgtctcaagcgaatggctatcagtggtgatgactgtgtggtaaagcccatcgacgatcgcttcgccacagcacttactgctctgaatgacatgggcaaagtgagaaaggatattccgcagtgggaaccttctaaagggtggaacgactggcagcaagtccccttttgcagccaccatttccaccagctaataatgaaggatggacgggagatcgtggttccatgtaggaatcaggacgaactggtgggccgcgccagagtctcccagggtgcagggtggtcactccgggagaccgcctgcttgggaaaaagctatgcgcaaatgtggcagctgatgtactttcataggcgagatcttcgtctggctgccaacgcaatttgttctgccgtgcctgtagactgggttcccacgtccagaaccacatggagtatccacgctcatcaccagtggatgactaccgaggatatgctcagcgtgtggaatcgcgtctggattgaagagaacccatggatggaagacaagacacacatctcgtcctggggcgatgtgccctatttaggcaagcgggaggaccaatggtgcgggtctctgataggattgactgccagggcaacctgggctacgaatatccaggttgccattaaccaggtgagacgcctgatcggtaatgaaaactacctcgactacatgacatcaatgaaacggttcaagaatgagagcgatcctgagggcgcgctttggtga

SEQ ID NO: 13617 - RNA, 9879 nt, synthetic construct
  misc_feature 1..9879: note = derived and/or modified CDS sequence (opt3) from DENV-1__FJ390388__SS-prME
  source 1..9879: mol_type = other RNA
agcgtgaccatgctgctcatgcttatgcccacagccctggctttccacttgactacgaggggaggggagcctcatatgatcgtctccaagcaggaaaggggaaaatctttactgtttaagacctcagccggtgttaatatgtgcacactaattgccatggacctcggcgagctgtgtgaagatactatgacctacaaatgcccacggataacagagaccgaaccggacgatgtggactgttggtgcaatgcgactgatacatgggtaacctatgggacgtgtagtcagactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagccgggattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatcggggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccgggtcgttcaaactggagaaggaacttgccgagacgcagcacggtacagtcttggtgcagataaagtacgagggcaccgacgctccttgcaaaatcccattctcgactcaagatgaaaagggggttacacagaacggacgcctgattaccgcgaatcccatcgtgactgacaaagagaagcctgtaaacatagaagcagagccaccctttggcgagtcttatattgtcatcggtgccggggaaaaagctctcaagctgtcctggttcaagaaaggctcaagtatcggaaagatgtttgaggccaccgcaaggggcgccaggcggatggctattcttggggatacagcctgggacttcggaagcatcggtggcgtgtttacgtccgttgggaaactggtgcatcagattttcggaaccgcatacggcgtcttgttttctggtgtgagctggactatgaagatagggatcggcgtactcatgacatggctgggattaaattcacgaagtacctccctgagcatgacatgtattgcggtgggcctagttactctctacctgggggtcatggtgcaggctgattctggatgcgtgatcaactggaaaggccgcgaacttaagtgtggttcagggatcttcgtcaccaatgaggttcacacgtggacagaacaatataagtttcaggccgacagtccgaaaagattgagcgcagccattggaaaggcttgggaggagggcgtgtgcggtataaggtccgccacccggctggaaaacatcatgtggaaacagatttctaacgagctcaatcatatcctgttagaaaacgacatgaagttcactgtggtagtcggcgatgtggcagggattctggctcagggcaaaaagatgatccgccctcaacccatggagcacaaatactcgtggaaaagctggggcaaggccaagataatcggggcggacgttcagaataccacatttattatcgatggaccaaacactcctgaatgtcccgacgatcagagagcctggaatatttgggaggtggaggactatggcttcggtatctttaccacaaacatatggcttaagttgagggattcctacacgcaggtctgcgaccaccgtctcatgtcagctgcaattaaagatagtaaggccgtgcatgctgacatggggtattggatcgaatctgagaaaaatgaaacctggaagctggcccgggcatccttcattgaggttaagacttgtatctggccaaaatcccacacactatggtcaaacggagtgctggaaagcgagatgataatccccaagatttacggcggtcctatctctcaacataattatcgaccaggctacttcacccagactgcggggccgtggcacctcggaaaactggagcttgattttgacttgtgcgaaggcacaaccgtagtcgtggatgagcactgcgggaacagaggaccctccctgaggacgactaccgtgacaggcaagattatccatgaatggtgttgccgcagttgtaccttacctccactccggttcagaggtgaggacgggtgctggtacggaatggagataaggcccgtcaaagaaaaggaggaaaatctggttaagagcatggtgtctgccggctccggtgaggtagactcatttagtcttggcctgttgtgtattagcatcatgatcgaagaggtgatgcgctcgcgatggtcccggaaaatgctcatgactgggacactggctgtcttctttctactgattgtgggacagctcacctggaacgatctgatccgtctttgcattatggttggcgccaatgcatctgacagaatggggatgggaacaacttatttggctctgatggccaccttcaagatgaggcctatgtttgcagtgggcttactcttccgccggctgacgagcagagaggtccttctgctaacaataggtctctcactggtggccagtgttgaattgccaaactccctggaggaattaggggatggactcgctatgggcatcatgattctgaaacttctgaccgactttcaatctcaccagttgtgggcgactctcctgagcctaaccttcatcaagacaactttttccctgcattacgcctggaaaaccatggcaatggtgctttcagtcgtaagcctcttccccctgtgtttgagtacgacatctcagaagaccacttggctgccggtgttactcggctccctggggtgcaagcctcttacaatgtttctgattgctgagaataaaatctggggaaggcgaagctggccattgaacgaaggtataatggccgttggcatcgtgtcgattctcctgtcatctctactgaagaacgatgtcccccttgccgggcctctcatcgctggaggcatgctgattgcatgttatgtgatcagtggttccagcgccgacttgtctttagagaaagcggctgaggtaagctgggaagaggaagccgagcactccggggcatcacataatatactggtggaagtccaggatgacggaaccatgaagattaaagatgaggagcgcgacgatactctcacaatcctgcttaaggccaccctgttggctgttagtggcgtgtaccccctaagcatcccagcaacgctgttcgtgtggtatttctggcagaaaaagaagcagcggtctggcgtcctctgggacactccttcacccccagaagtggagagagccgttctggatgacgggatttacaggataatgcagcgtggacttttaggtcgcagccaggtaggcgtgggggtctttcaagaaaacgtgttccacaccatgtggcacgttacacggggagcggtgctgatgtatcagggcaaaagactcgagccgagttgggctagcgtcaagaaagacttgatctcctacggtgggggatggaggctgcagggctcttggaataccggcgaggaagtgcaggtaattgccgtcgagcctgggaagaaccccaaaaatgtgcaaacagcaccaggaacttttaagacccccgaaggtgaggttggcgccatcgctctcgatttcaagcctgggacgtcgggaagcccaattgtgaaccgagaacggaaaatcgtcggcctgtacggtaatggggtggttacaacttcaggaacctatgtgtccgccatagcacaggctaaggccagtcaggagggcccccttcctgagatcgaagacgaggtctttcgcaaaagaaacctgacaattatggatttgcatccgggctctgggaagaccaggcggtacctaccagcgatcgtgcgagaagccattaaaagaaagctgcgcactctcatcttagcacccaccagggtagtggctagcgagatggccgaagctctgaagggaatgcctatacgttatcaaacaacggcagttaaatccgagcacactggtaaggagattgtcgaccttatgtgccatgccaccttcacaatgcggctgctctcaccagtgagagtgcccaattacaacatgatcatcatggatgaagcccactttaccgacccttctagcattgctgcgaggggctatatcagtactcgcgtcgggatgggagaggcagccgctatattcatgacagccaccccgcccggctccgtagaagcatttccacagagcaatgccgtgattcaggatgaggaacgagacatccctgagagatcttggaactcaggttacgagtggattacggatttccccgggaaaactgtttggtttgtgccatccatcaagagtggaaatgacatagctaactgtttgcggaaaaatggcaagagggtcattcagctgagccgcaagacattcgataccgaatatcagaaaaccaagaacaacgactgggactacgtggttactacagatatctcggagatgggcgcgaatttccgtgccgacagagtgatcgatcctcggaggtgcctcaaacccgtcattctgaaggacgggccagaacgcgtgatccttgcaggaccgatgcctgtaaccgtggcttctgccgcacagcgaagaggtcggattggcaggaaccataataaagagggggatcagtacatatatatgggacagcccctaaacaatgacgaggatcacgcccactggacagaagctaagatgctgttggacaacatcaatactccagagggcattatccccgccttatttgaacctgagcgcgaaaagtccgcggcaatcgatggtgagtacagactgagaggggaagcccggaaaacgttcgttgaactcatgcgtcgcggcgacctgccagtctggcttagctataaggtggcttcagagggatttcaatacagtgatcgaagatggtgcttcgacggcgaaaggaacaatcaggtgctggaggaaaacatggatgtcgagatttggaccaaagagggggaacggaagaaactccgccccagatggttggacgccaggacatattctgaccctctggctctacgggagtttaaggagttcgcagccggacgaagatccgttagcggtgatctgatactcgagatcggcaaacttccgcagcatctgactcagcgcgctcaaaatgccttagacaacttggtgatgctgcacaattcagaacaagggggaagggcataccggcatgcgatggaggagctcccagataccattgaaacactgatgcttctggccctcatcgctgtattgaccggcggtgtgactctgtttttcttaagtgggcgtggcctaggaaagacgagcattggcctgctctgtgtcatggcctcctctgtgcttctgtggatggcaagcgttgagccccactggatcgctgcctccataatcttggaatttttcctgatggtgctcctgattcctgagcccgacagacagaggaccccacaggataaccaacttgcatatgtcgtaatcgggctcctgtttatgattttgacagtggccgctaatgagatgggactgttagaaactaccaagaaagacctaggtatcggccacgttgcggtggagaaccatcaccatgccgcaatgctggatgtcgacctccaccctgcttcagcctggacactttacgccgtggcaaccactataattacacccatgatgcgccatacgatcgaaaacaccactgctaatatttctctgacagccatcgcgaaccaggctgccatattgatggggctggataagggatggccaatcagtaaaatggacattggcgtccctctcctggcacttggttgctacagccaggtgaatccgttaaccctgaccgccgctgttctcatgttggtggcacactatgccatcattgggcccggcctgcaagcgaaggctacacgggaggcccagaaacgaactgcagccggaatcatgaagaacccaacggtagatggcatagtggctattgacctagatcctgtcgtttacgacgccaagttcgaaaaacagctggggcagatcatgctccttatcctgtgtaccagccaaattttgctgatgagaacaacttgggcactctgcgagtccatcaccctggctacaggacccttaaccactctttgggagggctctccaggtaagttttggaatacgacaatagccgtgtcaatggcgaacattttcagggggagctatctggccggagcaggcctcgctttctccctaatgaaaagtctgggtggcgggcgccggggaaccggcgcccagggggaaactttgggagagaagtggaaaagacagctgaatcagctctctaagagcgaatttaacacctacaagcgttcaggcatcatggaggtcgacaggtccgaagcaaaagagggtcttaagagaggggaaacaactaaacacgctgtgagtcgcggaaccgccaagctgcgatggttcgtagaaagaaatttggtgaaacctgagggcaaggttattgatctgggttgtggcagagggggatggagctattactgcgccggcctcaagaaagtgacagaagtcaaggggtatacgaaaggaggccccggtcatgaggaaccgatcccaatggcgacctacgggtggaacttagtgaagctgcactctggaaaagacgtctttttcatacctcccgagaagtgtgatactcttctgtgcgacatcggcgagtcctcaccaaatcccacaattgaagagggccggaccctacgcgtgctcaaaatggttgaaccttggctgagagggaaccaattttgtatcaagattttgaatccgtacatgcccagcgtagtggagactctggagcagatgcagaggaagcatggaggtatgctcgtccgaaacccactttcgagaaattctacacacgaaatgtattgggtgagttgcggcaccgggaacatcgtttccgctgtgaatatgacgagccgtatgctgttaaacagattcaccatggcacaccgcaaacctacatacgagagggatgtcgacctgggagccggcactcggcatgtggctgtagaacccgaggtggccaacttggatattatcggtcagagaatagaaaatattaagcacgagcataaatcaacctggcactatgacgaggataacccttacaagacatgggcatatcatgggtcctacgaagttaaaccatctggaagcgccagttccatggtcaatggcgtggtgaagctcctgactaagccctgggacgtcatccctatggttacccaaatcgctatgacagataccactccatttggccagcagcgcgtgttcaaagagaaggtagacacgaggacacccaaagcgaagcgagggaccgcccaaattatggaagtgactgcaaaatggctatggggatttcttagccggaacaagaagccgagaatatgtaccagggaggagttcacacgcaaagtccgttctaatgctgccatcggtgcagtgtttgttgacgagaaccagtggaactcagccaaggaggctgtggaagatgagcggttctgggacctggtccacagagaaagggagctccacaaacagggcaagtgcgccacgtgcgtgtataacatgatggggaaacgcgaaaagaagctgggagagtttggcaaagcgaagggtagtcgagcaatttggtacatgtggttgggggcccggttcctggagttcgaagctctcggatttatgaatgaggatcattggttctccagagaaaacagcctttctggcgtagagggcgaggggctgcacaaattaggatacatcctgagggacatttcgaagatccctggtggcaatatgtatgccgatgacaccgcagggtgggatactcgcataacagaagacgatttgcagaacgaggctagaatcaccgacattatggaaccagagcatgccctcctggctaaatcaatctttaagctaacttaccaaaataaagttgtgcgggtccagaggcccgccaagaacggaacagtgatggatgtgattagccgtcgagaccagcgcggctccggtcaggtcgggacctatggacttaatacattcactaacatggaagcacaactgatcagacagatggagagtgagggcatattttctcctagcgaactcgagaccccaaacctggcggaacgggttttggattggttagagaagtacggcgtggaaaggctgaaacgcatggccatttccggggacgactgtgtagtgaagcccatcgatgacagattcgctacggccctcaccgcacttaatgatatgggaaaagtccggaaggacatcccgcagtgggagccttcaaaaggttggaacgattggcagcaagtgcccttttgcagtcaccacttccatcagctgattatgaaggacggcagggagatagttgtgccatgtcgaaatcaggatgagctagtcgggcgtgctagagtgtctcagggagccggctggagcctgcgcgagacagcatgcctcggtaagtcctatgcccaaatgtggcagttgatgtactttcaccggagggacctgagacttgcggctaacgccatctgttcagcagtacctgttgattggattcccactagccgcaccacatggtctatccatgcccaccatcagtggatgactaccgaagacatgctgtccgtgtggaatcgggtctggattgaggaaaacccatggatggaggataaaacgcacatcagtagctggggagacgtgccctatctcggaaagagggaggaccaatggtgcggctcgttaataggcctgacagctcgagccacctgggcaactaatatccaggttgctattaaccaggtgagacggttgatcgggaatgaaaactacctggattacatgacatccatgaaaaggttcaagaatgagtctgaccctgaaggagccctctggtga

SEQ ID NO: 13618 - RNA, 9879 nt, synthetic construct
  misc_feature 1..9879: note = derived and/or modified CDS sequence (opt3) from DENV-1__FJ024464__SS-prME
  source 1..9879: mol_type = other RNA
agcgtgaccatgctgctcatgcttatgcccacggccctggctttccacttgactacgagaggaggggaacctcatatgatcgtctccaagcaggaaagaggaaaatctttactgtttaagacctcagccggtgttaatatgtgcacgctgattgccatggacctcggcgagctgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccgggagcttcaaactggagaaggaacttgccgagacgcagcacggtacagtcttggtgcagataaagtacgagggcaccgacgctccttgcaaaatcccattctcgactcaagatgaaaagggggttacacagaacggacgcctgattaccgcgaatcccatcgtgactgacaaagagaagcctgtaaacatagaagcagagccaccctttggcgagtcttatattgtcatcggtgccggggaaaaagctctcaagctgtcctggttcaagaaaggctcaagtatcggaaagatgtttgaggccaccgcaagaggcgtgaggcggatggccattcttggggatacagcttgggacttcggaagcatcggtggcgtttttacgtccgtggggaaactggtccatcagattttcggaaccgcctacggcgtgttgttttctggtgtaagctggactatgaagatagggatcggcgtgctcctgacatggttaggactaaattcacgaagtacctccctaagcatgacatgtattgcagttggcctcgtcactctgtaccttggggtgatggtgcaggcggattctggatgcgtcatcaactggaaaggccgcgaattgaagtgtggttcagggatcttcgttaccaatgaggtgcacacgtggacagaacaatataagtttcaggctgacagtccgaaaagactgagcgccgcaattggaaaggcctgggaggagggcgtgtgcggtataaggtccgctacccggctcgaaaacatcatgtggaaacagatttctaacgagctgaatcatatcttactggaaaacgacatgaagttcactgtagtcgtgggcgatgttgccgggattcttgcacagggcaagaagatgatccgccctcaacccatggagtacaaatattcgtggaaaagctggggcaaggctaagataatcggggccgacgtgcagaataccacatttattatcgatggaccaaacactcctgaatgtcccgacgatcagagagcgtggaatatttgggaggtcgaggactacggcttcggtatctttaccacaaacatatggttgaagctcagggattcctatacacaggtgtgcgaccaccgtctgatgtcagccgctattaaagatagtaaggcagttcacgccgacatggggtactggatcgaatctgagaaaaatgaaacctggaagctagctcgggccagcttcattgaggtgaagacttgtatctggccaaaatcccatacactgtggtcaaacggagtactcgaaagcgagatgataatccccaagatttatggcggtcctatgtctcaacacaattaccgaccaggctacttcacccagactgcagggccgtggcatctgggaaaacttgagttggattttgacctgtgcgaaggcacaaccgtcgtggtggatgagcactgcgggaacagaggaccctccttaaggacgactaccgtcacaggcaagatcattcacgaatggtgttgccgcagttgtaccctccctccactgcggttcagaggtgaggacgggtgctggtatggaatggagatcaggcccgttaaagaaaaggaggaaaatcttgtgaagtccatggtatctgcgggctccggtgaggtggactcatttagtctgggcttgctctgtataagcattatgatcgaagaggtcatgcgctcgcgatggtcccggaaaatgctgatgactgggacactagccgtgttctttctgctcatcatgggacagctgacctggaacgatcttattcgtttgtgcatcatggttggcgctaatgcctctgacagaatggggatgggaacaacttacctggcattaatggctaccttcaagatgaggcctatgtttgccgtgggcctcctgttccgccggcttacgagcagagaggtcctgctactcacaattggtctgtcattggtggcaagtgttgaactgccaaactccttagaggaactcggggatggactggccatgggcataatgatccttaaactgttgaccgactttcaatctcatcagctctgggctactctgctaagcctgaccttcattaagacaactttttcccttcactatgcgtggaaaaccatggccatggtgctctcaatcgtcagcctgttccccttgtgtctgagtacgacatctcagaagaccacttggttaccggtactcctgggctcccttgggtgcaagcctctgacaatgtttttgattgcagagaataaaatctggggaaggcgaagctggccactcaacgaaggtataatggctgtgggcatcgtttcgattctgctatcatctctgcttaagaacgatgtgcccctcgccgggcctctgatcgccggaggcatgttgattgcttgttacgtcatcagtggttccagcgcagacttatctctggagaaagccgcggaggtgagctgggaagaggaagctgagcattccggggcctcacacaatatactcgtagaagtgcaggatgacggaaccatgaagattaaagatgaggagcgcgacgatactctgacaatccttctgaaggcaaccttgctagccgtcagtggcgtttatcccctgagcatcccagctacactcttcgtgtggtacttctggcagaagaagaagcagcggtctggcgtgctgtgggacactccttcacccccagaagtcgagagagcagtgcttgatgacgggatttataggataatgcagcgtggattactgggtcgcagccaggttggcgtaggggtgtttcaagaaaacgtcttccataccatgtggcacgtgacacggggagccgttctcatgtaccagggcaaaagattggagccgagttgggcgagcgtgaagaaagacctgatctcctacggtgggggatggaggctccagggctcttggaataccggcgaggaagtccaggtgattgctgtagagcctgggaagaaccccaaaaatgtccaaacagccccaggaacttttaagacccccgaaggtgaggtgggcgcaatcgccctggatttcaagcctgggacgtcgggaagcccaattgttaaccgagaaggcaaaatcgtgggtctttatgggaatggagtcgtgacaacttcaggcacctacgtttccgctatagcccaggcaaaggctagtcaggagggccccctgcctgagatcgaagacgaggtgtttcggaaacgcaacttgacaattatggatctacacccggggtctggaaagaccagaaggtatctgccagccatcgtccgggaagcgattaaacgaaagctcagaactttaatcctggcccccacccgcgtggtagcaagcgagatggctgaagcccttaagggtatgcctataaggtaccaaacaacggctgtgaaatccgagcatactggcaaggagattgttgacctgatgtgccacgcaaccttcacaatgcgtctcttgtcaccagtccgggtgcccaattataacatgatcatcatggatgaagcccattttaccgacccttctagcattgccgctagagggtacatcagtactagggtgggaatgggcgaggcggcagccatattcatgacagctaccccgcccggttccgtcgaagcctttccacagagcaatgcagtaattcaggatgaggaacgcgacatccctgagcgatcttggaactcagggtatgagtggattacggatttccccggaaaaactgtgtggtttgttccatccatcaagagtggcaatgacatagccaactgtctgaggaaaaatggcaagcgggtgattcagctcagcaggaagacattcgataccgaataccagaaaaccaagaacaacgactgggactacgtcgtgactacagatatctcggagatgggggctaatttccgcgcggaccgtgttatcgatcctagacggtgcctgaaacccgtgattcttaaggacggaccagaaagggtcatcctagccggtccgatgcctgtgaccgtagcatctgctgcccagcgccgaggcagaattgggcggaaccacaataaagagggagatcagtatatatacatgggccagcccctgaacaatgacgaggatcatgcacactggacagaagccaagatgttgttagacaacatcaatactccagagggtattatccccgctctgtttgaacctgagagggaaaagtccgccgcgatcgatggggagtatcgcctcagaggcgaggcaaggaaaacgttcgtggaactgatgcggcgtggagaccttccagtttggctgagctacaaggtcgcctcagagggctttcaatatagtgatcgccgatggtgcttcgacggggaaagaaacaatcaggtgctcgaggaaaacatggatgtggagatttggaccaaagagggagaaaggaagaaattgcggccccgctggctggacgctagaacatactctgaccctctagccctgagggagtttaaggagttcgctgcaggtcggcgatccgtcagcggcgatctcatacttgagatcgggaaactgccgcagcacttaactcagagagcccaaaatgctttggacaacctggttatgctccataattcagaacagggaggccgcgcctataggcacgcaatggaggagctgccagataccattgaaacacttatgctgctcgcgttgatcgccgtgctgaccggtggggtaactttatttttcctaagtggccggggactgggcaagacgagcattgggctcctttgtgtgatggcttcctctgtcctgttgtggatggccagcgtggagccccattggatcgcagcttccataatcctggaatttttcctcatggttctgcttattcctgagcccgaccgtcagagaaccccacaggataaccaactcgcctacgtggtcatcggactgttgtttatgattctgacagtagcagccaatgagatgggtttactagaaactaccaagaaagacctgggcatcgggcacgtggctgttgagaaccaccatcacgcggccatgctcgatgtggaccttcatcctgcatcagcttggacactgtacgccgtcgccaccactataattacacccatgatgaggcacacgatcgaaaacaccactgcaaatatttctttgacagctatcgccaaccaggcggctatactgatgggactcgataagggctggccaatcagtaaaatggacattggtgtgcctctgcttgccttagggtgctattcgcaggtcaatccgctgaccctcaccgcagccgtgttgatgctggttgctcattacgcaatcattggccccggactacaagccaaggcgacacgcgaggctcagaaacggactgccgcaggcatcatgaagaacccaacggtggatgggatagtagccattgacctggatcctgtggtctatgacgctaagttcgaaaaacagctcggacagatcatgcttctgatcttgtgtaccagccaaattctgctcatgcgaacaacttgggccctgtgcgagtccatcaccttagcaacaggcccccttaccactctgtgggagggttctccagggaagttttggaatacgacaatagctgtttcaatggccaacattttcagaggaagctacctcgcgggcgccggtctagcattctccctgatgaaaagtttgggcgggggaaggcgcggcaccggggctcagggagaaactctgggcgagaagtggaaacggcagctcaatcagctttctaagagcgaatttaacacctataagagatcaggtatcatggaggtggaccgttccgaagccaaagaggggctgaagaggggagagacaactaaacacgcagtcagtcggggcaccgctaagttgcgctggttcgtggaacgaaatctggtaaaacctgagggtaaggtgattgatctcggctgtgggagaggaggctggagctactattgcgccgggttaaagaaagttacagaagtgaagggatacacgaaaggcggtcccgggcacgaggaaccgatcccaatggccacctacggatggaacctggtcaaacttcattctggcaaagacgtgtttttcatacctcccgagaagtgtgatactctgctatgcgacatcggcgagtcctcaccaaatcccacaattgaagaggggaggaccctccgggtcctgaaaatggtggaaccttggttgcgcggaaaccaattttgtatcaagattctgaatccgtatatgcccagcgttgtagagactctcgagcagatgcagagaaagcacggtggcatgcttgtgaggaacccactgtcgcgaaattctacacatgaaatgtactgggtcagttgcgggaccggaaacatcgtgtccgcggttaatatgacgagccggatgttactgaaccgtttcaccatggctcacagaaaacctacatatgagcgcgatgtggacttgggcgcaggtactaggcacgtcgccgtggaacccgaggtagctaacctcgatattatcgggcagcggatagaaaatattaagcatgagcacaaatcaacctggcattacgacgaggataacccttataagacatgggcctaccacggatcctatgaagtgaaaccatctggcagcgcaagttccatggttaatggcgtcgtgaagctgctaactaagccctgggacgtgatccctatggtcacccaaatcgccatgacagataccactccatttgggcagcagagagttttcaaagagaaggtggacacgcgcacacccaaagctaagaggggaaccgcgcaaattatggaagtaactgccaaatggctttggggttttctgagccgaaacaagaagccgcggatatgtaccagagaggagttcacaaggaaagtgcgctctaatgcagctatcggcgccgtctttgtggacgagaaccagtggaactcagcaaaggaggccgttgaagatgagcgtttctgggacctcgtgcatcgggaaagagagctgcacaaacaggggaagtgcgctacgtgcgtctacaacatgatgggaaaaagggaaaagaagttgggcgagtttggtaaagccaaggggagtcgcgcgatttggtacatgtggctgggagcacgattcctcgagttcgaagcccttggctttatgaatgaggatcactggttctcccgggaaaacagcctgtctggcgtggagggggagggattacataaactgggttatatcttgagagacatttcgaagatccctggcgggaatatgtacgctgatgacaccgccggatgggatactaggataacagaagacgatctccagaacgaggcacgcatcaccgacattatggaaccagagcacgctctgctagccaaatcaatctttaaacttacttatcaaaataaagtagttagagtgcagcggcccgctaagaacggcacagtcatggatgtgattagcaggcgtgaccagcgaggttccggacaggtgggaacctacggcctgaatacattcactaacatggaagcccaactcatccgccagatggagagtgagggcatattttctcctagcgaactggagaccccaaacttggcaaagagagtcttagattggctggaaaaatatggggttgagcggctcaagaggatggcgatttccggagacgactgtgtggtaaaacccatcgatgaccgcttcgccacggctcttaccgccctgaatgatatgggtaaggtgagaaaagacatcccgcagtgggaaccttcaaagggctggaacgattggcagcaagtccccttttgcagtcatcacttccaccagctaattatgaaggacgggcgggagatagtggttccatgtaggaatcaggatgagctggtgggacgagcacgtgtctctcagggcgctggttggagcctcagagaaacagcctgcttggggaaatcctacgcacaaatgtggcagctgatgtattttcatcgccgggaccttaggctggccgcgaacgctatctgttcagccgtgcctgtagattggattcccactagcagaaccacatggtctatccacgcacatcaccagtggatgactaccgaggacatgctctccgtttggaatcgcgtgtggattgaagagaacccatggatggaagataagacgcatatcagtagctggggagacgtcccctacttaggcaaacgggaggaccaatggtgcggctcgctgatagggttgacagccagggctacctgggccactaatatccaggtggcaattaaccaggttcgaagactgatcggaaatgagaactacctcgattatatgacatccatgaagcggttcaaaaatgaatctgaccctgagggtgctctttggtga

SEQ ID NO: 13619 - RNA, 9879 nt, synthetic construct
  misc_feature 1..9879: note = derived and/or modified CDS sequence (opt3) from DENV-1__FJ410191__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagttctgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagaaggtggaaacttgggctttgaggcaccctggatttaccgttattgcactcttcctggcccatgctatcggcacatcgattacccagaagggcatcatatttatcctgctcatgttagtgacgccatcaatggccatgcggtgcgtcgggattggaagccgcgatttcgtggagggtctgagtggcgcgacttgggtagacgttgtgcttgagcacgggtcctgtgtcacaaccatggcaaaagataagcccactttggacatcgaactgctaaaaacagaggtgaccaaccctgccgtgctcagaaagctgtgcattgaagctaaaatctctaatacgaccacagatagcaggtgtccaactcaaggagaggccacccttgtcgaagagcaggacgcaaactttgtttgccggcgcacattcgtggatcgaggctggggtaatgggtgtggactgtttggcaagggctccttgataacttgcgctaagttcaaatgcgtaaccaagctcgaggggaaaacagtgcagcacgaaaacctgaagtactcagtcattgtgaccgttcatactggagaccagcaccaagtgggtaatgagagtacggaacatggcacaaccgccactatcaccccccaggcgcctagcacagagattcagttaaccgactatggggccctgactctcgattgttctccaagaacaggacttgactttaacgaaatggtcctgttgacgatgaaagagaagtcctggctagtgcacaaacagtggttcctggatctcccgctgccctggacctcaggcgcaagcactagtcaagagacatggaataggaaggaccttctggtaacctttaagacagctcacgccaaaaagcaggaagttgtggtcttgggttctcaggagggggctatgcatactgccctcaccggcgcaacggaaatccaaacctccggaacaactaccatcttcgccggccacctgaaatgccggttaaagatggataaactgacactaaaggggactagctacgtgatgtgtaccggatcgttcaagctcgagaaagaagtcgctgagacgcagcatggtacagtgctggttcagattaagtatgagggcaccgacgcgccttgcaaaataccattttctactcaggatgaaaagggggtgacacaaaacggacgtcttatcaccgcaaatcccattgtaactgacaaagagaagcctgtcaacatcgaagccgagccacccttcggcgagtcctacatagtgattggtgctggggaaaaggccttgaaactgtcatggtttaagaaaggcagtagcatcggaaagatgttcgaggcaaccgcccgcggcgctagaaggatggccatcctcggggatacagcatgggactttggatccattggtggcgttttcacgtctgtggggaaactggtccaccagatctttggaaccgcgtatggcgtgcttttcagcggtgtatcatggactatgaagattgggataggcgtgctgttgacatggctcggactgaatagtcggtccaccagcttatctatgacatgtatcgctgttggcctggtcactctatacctcggggtgatggtgcaggccgattcaggatgcgtcattaactggaagggccgagaactgaaatgtggtagtgggatctttgttaccaatgaggtgcatacgtggacagaacagtacaagttccaagcagacagcccgaaacgcctttccgccgctatcggaaaggcctgggaggagggcgtgtgcggtattagatctgcaaccaggttggaaaacataatgtggaaacagatctcgaacgagctgaatcacattctcctggaaaacgacatgaagtttactgtagtcgtgggcgatgttgctgggatcttagcccagggaaaaaagatgattcggcctcagcccatggagtataagtacagctggaaatcctggggcaaggcgaaaatcataggggccgacgtgcaaaataccacattcatcattgatggaccaaacactcctgaatgtcccgacgatcagcgcgcttggaatatctgggaggtcgaggactatggctttggtattttcaccacaaacatctggctgaagcttagagattcatacacgcaggtgtgcgaccacaggttgatgagtgcagccataaaagattctaaggctgttcatgccgacatggggtattggattgaaagcgagaagaatgaaacctggaaactcgcacgtgcgtccttcatcgaggtgaagacttgtatttggccaaaatcacacacactgtggagcaacggagtactagaatctgagatgatcatacccaagatctacggcggtcctacctcccagcataattatcggccaggctactttactcaaacagccgggccgtggcacctgggaaaactcgagctggatttcgacctttgcgaaggcaccacggtcgtggtggatgagcactgcgggaaccgaggacccagtttgagaactaccacagtcaccggcaagattatccatgaatggtgttgcaggagctgtactctgcctccattacgctttaagggtgaggacgggtgctggtacggaatggagattcggcccgttaaagaaaaggaggaaaatctcgtgaaatctatggtatccgctggctcaggtgaggtggacagtttcagcctgggccttctgtgtatctcgataatgattgaagaggtcatgagatccaggtggtctcgcaagatgttgatgacagggaccctcgccgtgtttttcctgctaatcatgggacagctgacatggaacgatctcatccgactgtgcattatggttggcgcaaatgctagcgaccggatggggatgggaactacctatcttgccttgatggcaacgtttaaaatgcgtcctatgttcgccgtgggcctgttatttagaaggctcacatcacgcgaggtcctgcttctgaccatcggtctaagtctcgtggcttccgttgaactgccaaactctttggaggaactgggggatggattagcgatgggcattatgatactcaagctgcttactgacttccagagccaccaactgtgggccaccttgctctccctgacatttatcaagactaccttctcactacattacgcatggaaaacgatggctatggtgctgagcattgtcagtctttttcccctctgtctgtctacaacctcccagaagactacatggttgccggtactgttaggcagcctcgggtgcaaacctctgaccatgttccttatcgccgagaataagatttggggacggaaatcgtggccactgaacgaaggtatcatggccgtgggcatagtttcaatcttgctctctagtctgctaaagaacgatgtgcccctggctgggcctcttattgcaggaggcatgctcatcgcctgttatgtcatttccggtagctctgcggacctgagcttggagaaagctgccgaggtgtcctgggaagaggaagcagagcactcaggggccagtcataatatcttagtagaagtgcaggatgacggaactatgaagataaaggatgaggagagagacgatacactgaccattctcctgaaagctacgcttctggcagtcagcggcgtttaccccttgtctatcccagccactctattcgtgtggtatttttggcagaagaaaaagcaaaggtccggcgtgctgtgggacaccccttcacccccagaagtcgagcgagcggtgctcgatgacgggatctaccgcattatgcagcggggactgcttggtagaagtcaggttggcgtaggggtgttccaggaaaacgtctttcacacaatgtggcacgtgaccaggggagctgttttaatgtatcaaggcaaacgtctggagccgagctgggcctccgtgaagaaggacctcatatcttacggtgggggatggcgcttgcagggctcgtggaatacaggcgaggaagtccaggtgatcgcagtagagcctgggaaaaaccccaagaatgtccagactgccccaggaaccttcaaaacgagcgaaggtgaggtgggcgctattgccctggattttaagcccgggacatcaggatcccctatcgttaaccgggaaggcaaaattgtgggtctctacgggaatggagtcgtgactaccagtggcacatatgtttctgcaatcgctcaagccaaggcgagccaggagggcccactgcccgagatagaagacgaggtgttcagaaagaggaaccttaccatcatggatctgcatcctgggtccggaaaaactcgacggtacttgccggccattgtccgcgaagcaatcaagagaaaactaaggaccctgattctcgctccaacacgggtggtagcctcagagatggctgaagcattaaagggtatgcccatccgatatcagacgactgccgtgaaaggcgagcacaccgggaaggagatagttgacctgatgtgccatgccacatttaccatgagacttctgtctcctgtccgcgtgccaaattacaacatgattatcatggatgaagctcacttcactgaccccagcagtatcgcggcaaggggatatatttccacacgtgtgggcatgggtgaggccgctgccatctttatgaccgcaacgcctccggggagcgtcgaagccttcccccaatctaatgctgtaatacaggatgaggaacgggacattccagagagatcatggaactccggatacgagtggatcactgattttcctggcaagacagtgtggttcgttcccagtattaaaagcggcaatgacatcgcgaactgtctcaggaagaatgggaaacgcgtgatacagttgtcgcgaaagaccttcgataccgaatatcagaaaactaagaacaacgactgggactacgtcgtgacaaccgatatttctgagatgggagccaattttagagcagaccgggttatcgatccaaggcgctgcctgaagcctgtgatcctcaaagacggtcccgaacgtgtcattctggctggcccaatgccggtgacagtagcctccgcagcccaaagacgggggaggatcggacgcaaccataataaggagggcgatcagtacatttatatgggtcagcctcttaacaatgacgaggatcacgctcactggactgaagccaaaatgctactggacaacataaatacgcccgaggggatcattccagcgttgttcgaacccgagcgagaaaagagcgcagccatcgatggcgagtacagattacggggagaggctaggaaaacctttgtggaactgatgcgcagaggcgacctccctgtttggctgtcatataaggtcgccagtgaggggttccagtactctgataggcggtggtgctttgacggagaacgtaacaatcaagtgcttgaggaaaacatggatgtggagatctggacaaaagagggtgaacgcaagaagctgcgaccaagatggctcgacgctaggacttattccgaccccttggcactgcgggagttcaaagaatttgccgctggccgcagaagcgtctcaggggatctaattctggagataggaaagctccctcagcatcttacccagagggcccagaatgcactggacaacttagttatgttgcacaatagtgaacaaggcggtcgggcgtaccgacatgccatggaggagctgccggatacaatcgaaaccctcatgctgcttgctctgattgccgtgctcactgggggcgtaacgttgttctttctgagcggaagaggcttagggaaaacctccatcggactactgtgtgtgatggcatctagcgctctcctttggatggcctccgtcgagccacactggattgcagcctcaatcatactggaattctttttgatggtgctgctcatccccgagcctgaccgccagaggacaccccaggataaccagctggcttatgttgtgattggtcttctcttcatgatcctgactgtcgcggccaatgagatgggcttgctggaaaccacaaagcgggacttagggattggacacgtagcagtggagaaccatcaccatgctgccatgctagatgttgacctgcacccagcctctgcatggaccctctacgctgtggccactacaatcataacgcctatgatgcgtcataccattgaaaacactacagcgaatatcagtcttaccgctattgccaaccaagcagccatcctgatgggcttggataaaggttggcccatatcgaagatggacatcggggtcccactgctcgctctgggctgctacagccaggtgaatcctcttaccttaacagcagccgtcctgatgctcgtggcgcactatgctattatcggaccgggcttgcaggccaaggcaactagagaggcccaaaaaaggacggctgccgggattatgaagaaccccaccgttgatggaatcgtggcaatagacctggatccagtagtgtacgacgctaaatttgaaaagcagctaggccagattatgctgctcgtcctttgtacatcccagatcctgttgatgcgcactacctgggccctgtgcgagtctatcacactcgcgaccggtcctctgactacgttatgggaggggtcacccggaaaattctggaatacaaccattgccgttagcatggcaaacatcttccggggctcctatcttgctggtgccggcctggcatttagtctcatgaagtctctagggggaggccgaagagggactggagctcaaggcgaaaccctgggtgagaagtggaaaaggcagttgaatcagctgagcaagtcagaattcaacacatacaaacgctccgggataatggaggtggaccggagtgaagccaaggagggactcaaaagaggcgagactaccaagcacgccgtcagccgtggtacagcgaagcttaggtggtttgtggaacggaatctggtaaaaccagagggcaaggtgattgatttggggtgtggacgcggcgggtggtcttattactgcgctggactgaaaaaggttacggaagtgaaaggctataccaagggtgggcctggacatgaggaacccatcccgatggcaacttacggctggaacctcgtcaaattacactccggcaaggacgtgttctttattccacctgagaagtgtgatacactgctttgcgacatcggggagtcaagccccaatccaaccatagaagagggacgaactctgagagtcctaaaaatggtggaaccctggctcaggggtaaccagttctgtatcaagattctgaatccttacatgccgtcggttgtagagacattggagcaaatgcagcggaaacatggcgggatgctggtgcgcaaccccctctctagaaatagtacccacgaaatgtattgggtctcctgcggaacgggcaacatcgtgagcgccgttaatatgacctcaaggatgcttctgaaccgatttacaatggctcaccggaagccaacttacgagcgtgatgtggacttaggtgccgggaccagacatgtcgcagtggaacctgaggtagccaacctggatattatcggacagcgcattgaaaatatcaaacacgagcataagtccacatggcactatgacgaggataacccctacaagacttgggcttatcatggctcttacgaagtgaaacctagcggcagtgcgtccagcatggttaatggggtcgtgaagttgctcaccaaaccatgggacgtgatacccatggtcacacagattgccatgaccgatactacgcctttcggacaacagagggtttttaaggagaaagtggacacacggaccccaaaggcaaagagaggtactgctcagatcatggaagtaaccgccaaatggctgtggggcttcctatctcgcaacaagaaacccaggatctgtacacgagaggaatttacgcggaaggtgagatcaaatgcagccattggggctgtcttcgtggacgagaaccaatggaatagtgccaaagaggcggttgaagatgagaggttttgggaccttgtgcaccgcgaacgtgagctgcacaagcagggaaagtgcgcaacctgcgtctataacatgatgggcaaacgggaaaagaaactcggtgagttcgggaaggccaaaggatccagagctatatggtacatgtggctgggcgccaggttcttggagtttgaagcactgggcttcatgaatgaggatcattggtttagccgcgaaaactctctctcgggggtggagggagagggtcttcacaagctgggctacatcttacgagacatttcaaaaatcccggggggaaatatgtatgctgatgacactgccggctgggatacacggattaccgaagacgatctgcagaacgaggctaagatcactgacataatggaacctgagcatgccttgctcgcaaagagcatcttcaaactgacataccagaataaggtagttagagtgcaaaggccagcgaaaaacggtaccgtcatggatgtgatttcccgcagagaccagcgggggagtggacaggtgggcacatatggcctaaatacttttaccaacatcgaagcccagcttattaggcaaatggagtctgaggaaatcttcagcccctccgagctggaaacgcctaacctcgctgggcgtgtcctggattggttggagaagcacggagttgaacgattaaaacgcatggccatatcaggtgacgactgtgtggtaaagccaattgatgacagatttgcaaccgctctgacagccctcaatgatatgggcaaggtgcggaaagacatcccccagtgggagccgagtaaggggtggaacgattggcagcaggtccctttctgctctcaccattttcaccaacttatcatgaaagacggaagggagattgtggttccctgtcgcaatcaggatgaactggtgggcagagcacgggtcagccagggtgccgggtggtccctaagggagactgcgtgcctgggaaagtcatacgctcagatgtggcaactcatgtatttccatcgacgtgacttgagactggccgcaaacgccatatgtagcgctgtgccagtagattgggttcctacctctcgcacaacttggtccatccacgcccatcaccagtggatgaccacggaagacatgcttagtgtgtggaatcgggtctggattgaggaaaacccctggatggaggataaaacacacatcagctcgtggggcgacgtgccatacctgggcaagagggaggaccagtggtgcgggtccctcattggattaaccgcaagagctacttgggccacaaatatccaagttgcgataaaccaggtgcgccggctgatcggtaatgaaaactatttggattacatgacctctatgaagaggtttaaaaatgagtcagaccccgaaggcgctctgtggtga

SEQ ID NO: 13620 - RNA, 9879 nt, synthetic construct
  misc_feature 1..9879: note = derived and/or modified CDS sequence (opt3) from DENV-1__FJ432723__SS-prME
  source 1..9879: mol_type = other RNA
agcgtgaccatgctgctcatgcttatgcccaccgcactggctttccacttgactacgaggggaggggaacctcatatgatcgtcaccaagcaggaaaggggaaaatccttactgtttaagacatctgccggtgttaatatgtgcactctaattgccatggacctcggcgaactgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggatcgttcaaactggagaaggaagtggctgagacccagcacggtacggtccttgtgcagataaagtacgagggcacagacgcgccttgcaaaatcccattctcgacccaagatgaaaagggggttactcagaacggacgcttgattacagcaaatcccatcgtgaccgacaaagagaagcctgtaaacatagaagccgagccaccctttggcgagtcttatattgtcatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtgtttacatccgttgggaaacttgtgcatcagattttcggaacggcgtacggcgtcctgttttctggtgtgagctggaccatgaagatagggatcggcgtattgctcacttggctgggattaaattcacgaagtacatccctgagcatgacctgtattgctgtgggcctagttacactctacctgggggtcatggtgcaggccgattctggatgcgtgatcaactggaaaggccgcgaacttaagtgtggttcagggatcttcgtcactaatgaggttcacacctggacggaacaatataagtttcaggcagacagtccgaaaagattgagcgccgctattggaaaggcctgggaggagggcgtgtgcggtataaggtccgcaacacggctggaaaacatcatgtggaaacagatttctaacgagctcaatcatatcctgttagaaaacgacatgaagttcaccgtggtagtcggcgatgtggttgggattctggctcagggcaagaagatgatccgccctcaacccatggagcacaaatactcgtggaaaagctggggcaaggccaaaataatcggggcggacgtgcagaatactacctttattatcgatggaccaaacacacctgaatgtcccgacgatcagagagcctggaatatttgggaggtcgaggactatggcttcggtatctttactaccaacatatggcttaagttgagggattcctacacacaggtgtgcgaccaccgtctcatgtcagctgcaattaaagatagtaaggccgttcatgctgacatggggtattggatcgaatctgagaaaaatgaaacgtggaagctggcccgggcatccttcattgaggtgaagacctgtatctggccaaaatcccacactctatggtcaaacggagtactggaaagcgagatgataatccccaagatttacggcggtcctatctctcaacataattatcgaccaggctacttcacacagaccgcggggccgtggcacctcggaaaactggagcttgattttgacttgtgcgaaggcactacagtcgtggtggatgagcactgcgggaacagaggaccctccctgaggaccacgactgtcaccggcaagattatccatgaatggtgttgccgcagttgtacattacctccactccggttcaaaggtgaggacgggtgctggtacggaatggagataagacccgttaaggaaaaggaggaaaatctggtgaaaagcatggtatctgccggctccggtgaggtggactcatttagtcttggcctgttgtgtattagcatcatgatcgaagaggtcatgaggtcgcgctggtcccgaaagatgctcatgaccgggactctggctgtgttcctactgctcattatgggacagctgacatggaacgatcttatccggttgtgcattatggttggcgccaatgcatctgaccgtatggggatgggaaccacatatctggctttaatagccacttttaaaatgagacctatgttcgcagtgggcctcctgtttaggcgccttaccagccgggaggtcctgctactcacgatcggtctgtcattggtggccagtgttgaactgccaaactccttagaggaactcggggatggactggctatgggcattatgatccttaagctgttgacagacttccaatctcaccagctctgggcgaccctgctgagctttactttcattaaaaccacattatcccttcattacgcctggaagactatggcaatggtgctctcaatcgtcagcctgtttcccttgtgtctgagtaccacgtctcagaagacaacctggttaccggtactcctgggctcccttgggtgcaaacctctgactatgttcttgatagctgagaataagatctggggaagaaaaagctggccactcaacgaaggtattatggccgtgggcgttgtgtcgatcctgctatcatctctgcttaagaacgatgtccccctcgccgggcctctgattgctggaggcatgttgatcgcatgttatgtgataagtggttccagcgccgacttatctctggagaaagcggctgaggtaagctgggaagaggaagccgagcactccggggcatcacataatattctcgtggaagtccaggatgacggaacaatgaagatcaaagatgaggagagggacgataccctgactatccttctgaaggccacattgctagctgttagtggcgtgtaccccctgagcattccagcaaccctctttgtgtggtatttctggcaaaagaaaaagcagcgatctggcgtcctgtgggacacgccttcacccccagaagtggagcgcgccgttcttgatgacgggatataccggatcatgcagagaggattactgggtaggagccaggtaggcgtgggggtcttccaagaaaacgtgtttcacactatgtggcacgttacccgtggagcggtgctcatgtatcagggcaaacgcttggagccgagttgggctagcgtcaagaaagacctgatttcctacggtgggggatggcggctccagggctcttggaatacaggcgaggaagtgcaggtaatcgccgtcgagcctgggaagaaccccaagaatgtgcaaaccgcaccaggaacattcaaaactcccgaaggtgaggttggcgccattgctctggattttaagcctgggacctcgggaagcccaatcgtgaacagagaaggcaaaatagtcggtctttacgggaatggagtggttacgacatcaggcacttatgtgtccgccatcgcacaggctaaggccagtcaggagggccccctgcctgagattgaagacgaggtcttcaggaaacgaaacttgaccatcatggatctacatccggggtctggaaagacacggcgctacctgccagcgattgtgagagaagccatcaagaggaaactccggaccttaatactggcacccactcgagtagtggctagcgagatggccgaagctcttaagggtatgcctattagatatcaaaccacagcagttaaatccgagcacacgggcaaggagatcgtcgacctgatgtgccatgccacttttaccatgcgcctcttgtcaccagtgagggtgcccaattacaacatgatcattatggatgaagcccacttcacagacccttctagcatcgctgcgcgtgggtatataagtacccgggtcggaatgggcgaggcagccgctatttttatgactgccacaccgcccggttccgtagaagcattcccacagagcaatgccgtgatccaggatgaggaaagagacattcctgagaggtcttggaactcagggtacgagtggatcaccgattttcccggaaaaacggtttggttcgtgccatccataaagagtggcaatgacattgctaactgtctgcgcaagaatggcaaacgagtcatccagctcagcagaaagacttttgatacagaatatcagaaaaccaagaacaacgactgggactacgtggttaccactgatatctcggagatgggggcgaatttccgggccgacagggtgattgatcctcgccgttgcctgaaacccgtcatccttaaggacggaccagaaagagtgattctagcaggtccgatgcctgtaacagtggcttctgccgcacagcggaggggccgcatagggcgaaaccataataaggagggagatcagtacatctatatgggccagcccctgaacaatgacgaggatcacgcccactggaccgaagctaaaatgttgttagacaacattaatacaccagagggtatcatccccgccctgttcgaacctgagagagaaaagtccgcggcaattgatggggagtaccggctcaggggcgaggcccgcaaaacttttgttgaactgatgagaaggggagaccttccagtctggctgagctataaggtggcttcagagggcttccaatacagtgatcggcgttggtgctttgacggggaacgcaacaatcaggtgctcgaggaaaacatggatgtcgagatatggacgaaagagggagaacgaaagaaattgagacccaggtggctggacgcccggacctattctgaccctctagctctgcgcgagttcaaggaatttgcagccggtagaaggtccgttagcggcgatctcatccttgagattgggaagctgccgcagcatttaacacagcgggctcaaaatgccttggacaacctggtgatgctccacaattcagaacagggaggccgagcatacagacatgcgatggaggagctgccagatactatcgaaacccttatgctgctcgccttgattgctgtactgacaggtggggtgaccttattctttctaagtggccgcggactgggcaaaactagcatcgggctcctttgtgtcatggcctcctctgtgctgttgtggatggcaagcgttgagccccactggatagctgcctccatcattctggagttctttctcatggtgctgcttatccctgagcccgacaggcagcggacgccacaggataaccaactcgcatatgtcgtaattggactgttgttcatgatcctgaccgtggccgctaatgagatgggtttactagaaacaactaagaaagacctgggcatagggcacgttgcggtggagaaccatcaccatgccaccatgctcgatgtcgaccttcaccctgcatcagcttggacactgtacgccgtggccaccactattatcacacccatgatgcgtcatacgattgaaaacaccactgcaaatatctctttgacagctatagccaaccaggcggctatcctgatgggactcgataagggctggccaattagtaaaatggacatcggtgtccctctgcttgccttagggtgctacagccaggtgaatccgctgaccctcaccgcagccgttttgatgctggtggctcactatgcaattatcggccccggactacaagccaaggcgacaagagaggctcagaagaggactgccgcaggcataatgaaaaacccaacggtagatgggattgtggccatcgacctggatcctgtcgtttacgacgctaagtttgaaaaacagctcggacagatcatgcttctgattttgtgtaccagccaaatcctgctcatgcgcacaacttgggccctgtgcgagtccataaccttagcaacaggcccccttaccactctgtgggagggttctccagggaagttctggaatacgacaattgctgtgtcaatggccaacatctttcggggaagctatctcgcgggcgccggtctagcattctccctgatgaaaagtttgggcgggggacgaagaggcaccggggctcagggagaaactctgggcgagaagtggaagaggcagctcaatcagctttctaaaagcgagttcaacacctacaagcgctcaggtattatggaggtcgaccggtccgaagccaaagaggggctgaagagaggagagacaactcgtcacgcagtgagtaggggcaccgctaaattgcggtggtttgtagaacgcaatctggtgaagcctgagggtaaggttatcgatctcggctgtgggcgaggaggctggagctattactgcgccgggctaaagaaggtgacagaagtcaaaggatatacgaagggcggtcccgggcatgaggaaccgataccaatggccacctacggatggaacctggtgaaacttcactctggcaaggacgtcttctttactcctcccgagaaatgtgatacactgctatgcgacatcggcgagtcctcaccaaatcccaccattgaagaggggagaactctcagggtgctgaagatggttgaaccttggttgcggggaaaccaattctgtatcaagattctgaatccgtacatgcccagcgtagtggagacactcgagcagatgcagcgcaaacatggtggcatgcttgtcagaaacccactgtcgagaaattctacccacgaaatgtattgggtgagttgcgggacgggaaacatcgtttccgcggtgaatatgaccagccgaatgttactgaaccggtttacaatggctcaccgtaagcctacttacgagagagatgtcgacttgggcgcaggtacccgccatgtggccgtagaacccgaggtggctaacctcgatattatcgggcagaggatagaaaatattaaacacgagcataagtcaacatggcactatgacgaggataacccttacaaaacttgggcctatcatggatcctacgaagttaagccatctggcagcgcaagttccatggtcaatggcgtggtgaagctgctaaccaaaccctgggacgtcatccctatggttacacaaatcgccatgaccgatactacgccattcgggcagcagcgggtgtttaaggagaaagtagacacaagaacccccaaggctaaacgcggaactgcgcaaattatggaagtgaccgccaagtggctttggggtttcctgagcaggaacaagaaaccgcgaatatgtacacgggaggaatttacgagaaaggtcaggtctaatgcagctatcggcgccgtgttcgttgacgagaaccagtggaactcagcaaaagaggccgtggaagatgagcgcttttgggacctcgtccagaaggaacgtgagctgcacaaacaggggaagtgcgctacctgcgtgtataacatgatgggaaagcgggagaaaaagttgggcgagttcggtaaagccaaggggagtagagcgatttggtacatgtggctgggagcaaggtttctcgagttcgaagcccttggcttcatgaatgaggatcactggttttcccgcgaaaacagcctgtctggcgtagagggggagggattacataaactgggttacatcttgcgagacatttcgaagatccctggcgggaatatgtatgctgatgacactgccggatgggatacacggataaccgaagacgatctccaaaacgaggcaaaaatcactgacattatggaaccagagcacgctctgctagccacatcaatcttcaaacttacctaccagaataaggttgtgagagtccagaggcccgctaaaaacggcacagtgatggatgtgattagccgcagagaccagcggggttccgggcaagtcggaacttatggcctgaatacctttacgaacatggaagcccagctcatcaggcagatggagagtgagggcatattcctgcctggggaattggagaccccaaacttagcagaacgtgttctggattggctcgagaagtacggagtggaacgacttaaacgcatggcgatttctggtgacgactgtgtagtgaagcccatcgatgacagatttgccacagctctgactgccctaaatgatatgggcaaagtccggaaggacatcccgcagtgggagcctagcaaggggtggaacgattggcaacaggtgcccttctgctcccatcactttcaccagctgattatgaaagacggaagggagatagttgtgccatgtcgcaatcaggatgaactcgtcggcagagcacgggtgtcacaaggtgctgggtggagtttgagggagaccgcctgcctgggaaagtcttatgcacagatgtggcagcttatgtacttccatcgacgtgacctgagactcgccgcgaacgctatctgtagcgccgtacctgttgattgggtgcccacatcccgcactacctggtcaattcacgcacatcaccaatggatgacgacagaagacatgttaagcgtctggaatcgggtgtggatcgaggaaaacccatggatggaggataaaacccatgtttcttcctggggcgacgtgccctatctgggcaagagggaggaccagtggtgcgggagtttgattggactgactgccagagctacatgggccagcaatatccaggtcgcaataaaccaggtgcgccggctcatcggtaatgaaaactaccttgattacatgacctcgatgaaaaggtttaagaatgagggcgaccctgaaggggctctgtggtga

SEQ ID NO: 13621 - RNA, 9879 nt, synthetic construct
  misc_feature 1..9879: note = derived and/or modified CDS sequence (opt3) from DENV-1__FJ410192__SS-prME
  source 1..9879: mol_type = other RNA
agcgtgaccatgctgctcatgcttatgcccacggccctggctttccacttgactacgagaggaggggaacctcatatgatcgtctccaagcaggaaagaggaaaatctttactgtttaagacctcagccggtgttaatatgtgcacactgattgccatggacctcggcgagctgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccggtagcttcaaactggagaaggaacttgccgagacgcagcacggaacagtcttggtgcagataaagtacgagggcaccgacgctccttgcaaaatcccattctcgactcaagatgaaaagggggttacacagaacggacgcctgattaccgcgaatcccatcgtgactgacaaagagaagcctgtaaacatagaagcagagccaccctttggcgagtcttatattgtcatcggtgccggggaaaaagctctcaagctgtcctggttcaagaaaggctcaagtatcggaaagatgtttgaggccaccgcaagaggcgccaggcggatggctattcttggggatacagcctgggacttcggaagcatcggtggcgtgtttacgtccgttgggaaactggtgcatcagattttcggaaccgcatacggcgtcttgttttctggtgtgagctggactatgaagatagggatcggcgtactcctgacatggttaggactaaattcacgaagtacctccctaagcatgacatgtattgcggtgggcctcgttactctgtaccttggggtcatggtgcaggctgattctggatgcgtgatcaactggaaaggccgcgaattgaagtgtggttcagggatcttcgtcaccaatgaggttcacacgtggacagaacaatataagtttcaggccgacagtccgaaaagactgagcgcagccattggaaaggcttgggaggagggcgtgtgcggtataaggtccgccacccggctcgaaaacatcatgtggaaacagatttctaacgagctgaatcatatcttactggaaaacgacatgaagttcactgtggtagtcggcgatgtggcagggattcttgctcagggcaagaagatgatccgccctcaacccatggagtacaaatattcgtggaaaagctggggcaaggccaagataatcggggcggacgttcagaataccacatttattatcgatggaccaaacactcctgaatgtcccgacgatcagagagcctggaatatttgggaggtggaggactacggcttcggtatctttaccacaaacatatggttgaagctcagggattcctatacgcaggtctgcgaccaccgtctgatgtcagctgcaattaaagatagtaaggccgtgcacgctgacatggggtactggatcgaatctgagaaaaatgaaacctggaagctagcccgggcatccttcattgaggttaagacttgtatctggccaaaatcccatacactgtggtcaaacggagtgctcgaaagcgagatgataatccccaagatttatggcggtcctatctctcaacacaattaccgaccaggctacttcacccagactgcggggccgtggcatctgggaaaacttgagttggattttgacctgtgcgaaggcacaaccgtagtcgtggatgagcactgcgggaacagaggaccctccttaaggacgactaccgtgacaggcaagattatccacgaatggtgttgccgcagttgtaccctccctccactgcggttcagaggtgaggacgggtgctggtatggaatggagataaggcccgtcaaagaaaaggaggaaaatcttgttaagagcatggtgtctgccggctccggtgaggtagactcatttagtctgggcttgctctgtattagcatcatgatcgaagaggtgatgcgctcgcgatggtcccggaaaatgctgatgactgggacactagctgtcttctttctgctcattatgggacagctgacctggaacgatcttatccgtttgtgcattatggtgggcgccaatgcatctgacagaatggggatgggaacaacttacctggctttaatggccaccttcaagatgaggcctatgtttgcagttggcctcctgttccgccggcttacgagcagagaggtgctgctactcacaataggtctgtcattggtcgccagtgtggaactgccaaactccttagaggaactcggggatggactggctatgggcatcatgattcttaaactgttgaccgactttcaatctcatcagctctgggcgactctgctaagcctgaccttcatcaagacaactttttcccttcactatgcctggaaaaccatggcaatgattctctcaatcgttagcctgttccccttgtgtctgagtacgacatctcagaagaccacttggttaccggtgctcctgggctcccttgggtgcaagcctctgacaatgtttttgatagctgagaataaaatctggggaaggcgaagctggccactcaacgaaggtattatggccgtcggcatcgtatcgattctgctatcatctctgcttaagaacgatgtgcccctcgccgggcctctgatcgctggaggcatgttgatagcatgttacgttattagtggttccagcgccgacttatctctggagaaagcggctgaggtgagctgggaagaggaagccgagcattccggggcatcacacaatatcctcgtcgaagtgcaggatgacggaaccatgaagatcaaagatgaggagcgcgacgatactctgacaattcttctgaaggccaccttgctagctgtaagtggcgtgtatcccctgagcataccagcaacactcttcgtctggtacttctggcagaagaagaagcagcggtctggcgttctgtgggacactccttcacccccagaagtggagagagccgtgcttgatgacgggatctataggattatgcagcgtggattactgggtcgcagccaggtcggcgtgggggtttttcaagaaaacgtattccataccatgtggcacgtgacacggggagcggtcctcatgtaccagggcaaaagattggagccgagttgggctagcgtgaagaaagacctgatctcctacggtgggggatggaggctccagggctcttggaataccggcgaggaagttcaggtgattgccgtcgagcctgggaagaaccccaaaaatgtgcaaacagcaccaggaacttttaagacccccgaaggtgaggtaggcgccatcgctctggatttcaagcctgggacgtcgggaagcccaatagtcaaccgagaaggcaaaatcgtgggtctttatgggaatggagttgtgacaacttcaggcacctacgtctccgccattgcacaggctaaggccagtcaggagggccccctgcctgagatcgaagacgaggtgtttcggaaacgcaacttgacaattatggatctacacccggggtctggaaagaccagaaggtatctgccagcgatcgttcgggaagccataaaacgaaagctcagaactttaattctggcacccacccgcgtggtcgctagcgagatggccgaagctcttaagggtatgcctatcaggtaccaaacaacggcagtgaaatccgagcatactggcaaggagatcgtagacctgatgtgccacgccaccttcacaatgcgtctcttgtcaccagtgcgggttcccaattataacatgattatcatggatgaagcccattttaccgacccttctagcatagctgcgagagggtacattagtactagggtcggaatgggcgaggcagccgctatcttcatgacagccaccccgcccggttccgtggaagcatttccacagagcaatgccgtgattcaggatgaggaacgcgacatccctgagcgatcttggaactcagggtatgagtggataacggatttccccggaaaaactgtctggtttgtaccatccattaagagtggcaatgacatcgctaactgtctgaggaaaaatggcaagcgggtgatccagctcagcaggaagacattcgataccgaataccagaaaaccaagaacaacgactgggactacgttgtgactacagatatttcggagatgggggcgaatttccgcgccgaccgtgtcatcgatcctagacggtgcctgaaacccgtgattcttaaggacggaccagaaagggttatactagcaggtccgatgcctgtgaccgtcgcttctgccgcacagcgccgaggcagaatcgggcggaaccacaataaagagggagatcagtatatttacatgggccagcccctgaacaatgacgaggatcatgcccactggacagaagctaagatgttgttagacaacatcaatactccagagggtatcattcccgccctgtttgaacctgagagggaaaagtccgcggcaatagatggggagtatcgcctcagaggcgaggccaggaaaacgttcgtggaactgatgcggcgtggagaccttccagtatggctgagctacaaggtggcttcagagggctttcaatatagtgatcgccgatggtgcttcgacggggaaagaaacaatcaggttctcgaggaaaacatggatgtcgagatctggaccaaagagggagaaaggaagaaattgcggccccgctggctggacgccagaacatactctgaccctctagctctgagggagtttaaggagttcgcagccggtcggcgatccgtgagcggcgatctcattcttgagatcgggaaactgccgcagcacttaactcagagagctcaaaatgccttggacaacctggtgatgctccataattcagaacagggaggccgcgcatataggcacgcgatggaggagctgccagataccattgaaacacttatgctgctcgccttgatcgctgtcctgaccggtggggttactttatttttcctaagtggccggggactgggcaagacgagcatagggctcctttgtgtgatggcctcctctgtactgttgtggatggcaagcgtggagccccattggatcgctgcctccattatcctggaatttttcctcatggtcctgcttattcctgagcccgaccgtcagagaaccccacaggataaccaactcgcatacgtggttatcggactgttgtttatgatactgacagtggccgctaatgagatgggtttactagaaactaccaagaaagacctgggcattgggcacgtcgcggtagagaaccaccatcacgccgcaatgctcgatgtggaccttcatcctgcttcagcctggacactgtacgccgttgcaaccactatcattacacccatgatgaggcacacgatcgaaaacaccactgctaatatatctttgacagccatcgcgaaccaggctgccattctgatgggactcgataagggctggccaatcagtaaaatggacattggtgtgcctctgcttgcattagggtgctattcgcaggtcaatccgctgaccctcaccgccgctgtgttgatgctggtcgcacattacgccatcataggccccggactacaagcgaaggctacacgcgaggcccagaaacggactgcagccggcattatgaagaacccaacggtggatgggatcgttgctatcgacctggatcctgtggtatatgacgccaagttcgaaaaacagctcggacagattatgcttctgatcttgtgtaccagccaaatactgctcatgcgaacaacttgggcactgtgcgagtccattaccttagctacaggcccccttaccactctgtgggagggttctccagggaagttttggaatacgacaatcgccgtgtcaatggcgaacattttcagaggaagctacctcgccggcgcaggtctagctttctccctgatgaaaagtttgggcgggggaaggcgcggcaccggggcccagggagaaactctgggcgagaagtggaaacggcagctcaatcagctttctaagagcgaatttaacacctataagagatcaggtatcatggaggtcgaccgttccgaagcaaaagaggggctgaagaggggagagacaactaaacacgctgttagtcggggcaccgccaagttgcgctggttcgtggaacgaaatctggtcaaacctgagggtaaggtgatagatctcggctgtgggagaggaggctggagctactattgcgccgggttaaagaaagtaacagaagtgaagggatacacgaaaggcggtcccgggcacgaggaaccgatcccaatggcgacctacggatggaacctggttaaacttcattctggcaaagacgtgtttttcattcctcccgagaagtgtgatactctgctatgcgacatcggcgagtcctcaccaaatcccacaattgaagaggggaggaccctccgggtcctgaaaatggtggaaccttggttgcgcggaaaccaattttgtatcaagattctgaatccgtatatgcccagcgtcgtggagactctcgagcagatgcagagaaagcacggtggcatgcttgttaggaacccactgtcgcgaaattctacacatgaaatgtactgggtaagttgcgggaccggaaacatcgtgtccgctgtcaatatgacgagccggatgttactgaaccgtttcaccatggcacacagaaaacctacatatgagcgcgatgtggacttgggcgccggtactaggcacgttgctgtggaacccgaggtcgccaacctcgatataattgggcagcggatcgaaaatatcaagcatgagcacaaatcaacctggcattacgacgaggataacccttataagacatgggcataccacggatcctatgaagtgaaaccatctggcagcgccagttccatggtaaatggcgtggttaagctgctaactaagccctgggacgtcattcctatggtgacccaaatagctatgacagataccactccatttgggcagcagagagtgttcaaagagaaggtcgacacgcgcacacccaaagcgaagaggggaaccgcccaaatcatggaagttactgcaaaatggctttggggttttctgagccgaaacaagaagccgcggatttgtaccagagaggagttcacaaggaaagtgcgctctaatgctgccatcggcgcagtatttgtggacgagaaccagtggaactcagccaaggaggctgtcgaagatgagcgtttctgggacctcgtgcatcgggaaagagagctgcacaaacaggggaagtgcgccacgtgcgtttacaacatgatgggaaaaagggaaaagaagttgggcgagtttggtaaagcgaaggggagtcgcgcaatttggtacatgtggctgggagcccgattcctcgagttcgaagctcttggctttatgaatgaggatcactggttctcccgggaaaacagcctgtctggcgtggagggggagggattacataaactgggttatatcttgagagacatatcgaagatccctggcgggaatatgtacgccgatgacaccgcaggatgggatactaggattacagaagacgatctccagaacgaggctcgcatcaccgacattatggaaccagagcacgccctgctagctaaatcaatctttaaacttacttatcaaaataaagtcgtgagagtacagagccccgccaagaacggcacagttatggatgtgatatcccggagggaccagcgtggtagtgggcaggtcggaacctacggcctgaatacattcactaacatggaagcacaactcattcgacagatggagtctgagggcatctttagcccttccgaactggagaccccaaacttggcggaacgcgtgttagattggctggagaagtatggggtggaaagactcaaacggatggccatctcaggagacgactgtgtcgttaagcccattgatgacaggttcgctacggcccttaccgcactgaatgatatgggtaaagtgcgcaaggacataccgcagtgggagcctagtaaaggctggaacgattggcagcaagtacccttttgctctcatcacttccaccagctaatcatgaaggacgggagagagattgtggtcccatgtcggaatcaggatgaactggtgggaagggctcgagttagccagggcgccggttggtccctccgtgagacagcatgcttggggaagtcatacgcccaaatgtggcagctgatgtattttcatagacgcgaccttcggctggcggctaacgccatctgtagcgcagtgcctgtcgattggattcccacttctaggaccacatggtccatccacgcccatcaccagtggatgactaccgaagacatgctcagtgtgtggaatagagtatggatagaggaaaacccatggatggaggataaaacgcatatcagctcgtggggagacgttccctacttaggcaagcgcgaggaccaatggtgcggctccctgattgggttgacagctcgggccacctgggcaactaatatccaggtggctattaaccaggtcaggcgactgatcggaaatgaaaactacctcgattatatgacatctatgaaaagattcaagaatgagtcagaccctgaaggtgccctttggtga

SEQ ID NO: 13622 - RNA, 9879 nt, synthetic construct
  misc_feature 1..9879: note = derived and/or modified CDS sequence (opt3) from DENV-1__FJ410194__SS-prME
  source 1..9879: mol_type = other RNA
agcgtgaccatgctgctcatgcttatgcccaccgccctggctttccacttgactacgcggggaggggaacctcatatgatcgtctccaagcaggaaagggggaaatctttactgtttaagacctcagccggtgttaatatgtgcacgctaattgccatggacctcggcgaactgtgtgaagatactatgacctacaaatgcccacggatcacagaaaccgaaccggacgatgtggactgttggtgcaatgcgactgatacatgggtgacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaggacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaggcccctacaaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccgggagcttcaaactggagaaggaagtcgccgagacgcagcacggtacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattgtgatcggtgccggggaaaaagctctgaagctctcctggttcaagaaaggctcaagtatcggaaagatgtttgaggccaccgcaagaggcgccaggcggatggctattctgggggatacagcctgggacttcggaagcatcggtggcgtttttacgtccgtggggaaacttgtccatcagattttcggaaccgcatacggcgtgctgttttctggtgtaagctggactatgaagatagggatcggcgtgttgctcacatggctgggattaaattcacgaagtacctccctgagcatgacatgtattgcggttggcctagtcactctctacctgggggtgatggtgcaggctgattctggatgcgtcatcaactggaaaggccgcgaacttaagtgtggttcagggatcttcgttaccaatgaggtgcacacgtggacagaacaatataagtttcaggccgacagtccgaaaagattgagcgcagccattggaaaggcttgggaggagggcgtgtgcggtataaggtccgccacccggctggaaaacatcatgtggaaacagatttctaacgagctcaatcatatcctgttagaaaacgacatgaagttcactgtagtcgtgggcgatgttgcagggattctggctcagggcaagaagatgatccgccctcaacccatggagtacaaatattcgtggaaaagctggggcaaggccaagataatcggggcggacgtgcagaataccacatttattatcgatggaccaaacactcctgaatgtcccgacgatcagagagcctggaatatttgggaggtcgaggactacggcttcggtatctttaccacaaacatatggcttaagttgagggattcctatacacaggtgtgcgaccaccgtctcatgtcagctgcaattaaagatagtaaggccgttcacgctgacatggggtactggatcgaatctgagaaaaatgaaacctggaagctggcccgggcatccttcattgaggtgaagacttgtatctggccaaaatcccatacactatggtcaaacggagtactggaaagcgagatgataatccccaagatttatggcggtcctatctctcaacacaattaccgaccaggctacttcacccaggcggccgggccgtggcatctcggaaaactggagcttgattttgacttgtgcgaaggcactacagtcgtggtggatgagcactgcgggaacagaggaccctccctgaggaccacgactgtcaccggcaagattatccacgaatggtgttgccgcagttgtacattacctccactccggttcagaggtgaggacgggtgctggtatggaatggagataaggcccgttaaagaaaaggaggaaaatctggtaaagagcatggtatctgctggctccggtgaggtggactcatttagtcttggcctgttgtgtattagcatcatgatcgaagaggtcatgcgctcgcgatggtcccggcgtatgctcatgaccgggactctggccgtgttctttctactgattatgggacagctcacatggaacgatctgatcagactttgcattatggttggcgcaaatgcttctgacaggatggggatgggaaccacatacttggccctgatggcaactttcaaaatgcgccctatgtttgccgtgggcttactcttccggagactgaccagcagggaggtccttctgctaacgataggtctctcactggtggctagtgttgaattgccaaactccctggaggaattaggggatggactcgcgatgggcatcatgattctgaaacttctgacagactttcaatctcatcagttgtgggccaccctcctgagcctaactttcatcaaaaccacattttccctgcactatgcatggaagactatggctatggtgctttcaattgtcagcctcttccccctgtgtttgagtaccacgtctcagaaaacaacctggctgccggtattactcggctccctggggtgcaagcctcttactatgtttctgatcgccgagaataagatatggggacgacgcagctggccattgaacgaaggtatcatggccgtgggcattgtttcgatcctcctgtcatctctactgaaaaacgatgtgccccttgctgggcctctcattgcaggaggcatgctgatcgcctgttacgtcataagtggttccagcgcggacttgtctttagagaaggctgccgaggtgagctgggaagaggaagcagagcattccggggcctcacacaatattctggtagaagtgcaggatgacggaacaatgaaaatcaaggatgaggagcgggacgataccctcactatcctgcttaaagctacactgttggcagtcagtggcgtttatcccctaagcattccagccaccctgttcgtgtggtacttctggcaaaagaaaaagcagagatctggcgtgctctgggacacgccttcacccccagaagtcgagagggcggtgctggatgacgggatatatcgtatcatgcagcgcggacttttaggtcggagccaggttggcgtaggggtgtttcaagaaaacgtcttccatactatgtggcacgtgaccagaggagctgttctgatgtaccagggcaagaggctcgagccgagttgggccagcgtgaaaaaggacttgatttcctacggtgggggatggcgactgcagggctcttggaatacaggcgaggaagtccaggtgatcgcagtagagcctgggaaaaaccccaagaatgtccaaaccgccccaggaacatttaaaactcccgaaggtgaggtgggcgctattgccctcgatttcaagcctgggacctcgggaagcccaatcgttaaccgggaaggcaagatagtgggtctgtatgggaatggagtcgtgacgacatcaggcacttacgtttccgcaatcgctcaggccaaagcgagtcaggagggcccccttcctgagattgaagacgaggtgtttcgcaagagaaacctgaccatcatggatttgcacccggggtctggaaaaacaaggcggtatctaccagccattgtccgagaagcaatcaagagaaaactgcgcaccctcatattagctcccactagggtggtagccagcgagatggctgaagcactgaagggtatgcctattcgttaccaaaccacagccgtgaagtccgagcatacgggcaaagagatcgttgaccttatgtgccacgccactttcaccatgcggctgctctcaccagtcagagtgcccaattataacatgatcattatggatgaagctcattttacagacccttctagcatcgcggcaagggggtacataagtacccgcgtgggaatgggcgaggccgctgccattttcatgactgcaacaccgcccggttccgtcgaagcctttccacagagcaatgctgtaatccaggatgaggaacgagacattcctgagagatcttggaactcagggtatgagtggatcaccgatttccccggaaagacggtgtggtttgttccatccataaaaagtggcaatgacattgcgaactgtttgcggaagaatggcaaaagggtgatccagctgagccgcaagactttcgatacagaataccaaaagaccaaaaacaacgactgggactacgtcgtgaccactgatatctcggagatgggggccaatttccgtgcagacagagttattgatcctcggaggtgcctcaagcccgtgatcctgaaagacggaccagaacgcgtcattcttgctggtccgatgcctgtgacagtagcctctgcagcccagcgaagaggccggatagggaggaaccacaataaggagggagatcagtatatctacatgggccagcccctaaacaatgacgaggatcatgctcactggaccgaagccaaaatgctgttggacaacattaatacaccagagggtatcatccccgcgttatttgaacctgagcgcgaaaagtccgcagccattgatggggagtatagactgaggggcgaggctcggaagactttcgtggaactcatgcgtcgcggagacctgccagtttggcttagctacaaagtcgcctcagagggctttcaatatagtgatcgaagatggtgcttcgacggggaaaggaacaatcaggtgctggaggaaaacatggatgtggagatatggacgaaggagggagaacggaaaaagctccgccccagatggttggacgctaggacctactctgaccctctggcactacgggagtttaaagagttcgccgctggtcgaagatccgtcagcggcgatctgatcctcgagattgggaaacttccgcagcacctgacacagcgcgcccaaaatgcattagacaacttggttatgctgcataattcagaacagggaggcagggcgtatcggcacgccatggaggagctcccagatactatcgaaaccctgatgcttctggctctcattgccgtgttgacaggtggggtaaccctgtttttcttaagtggccgtggactaggcaaaactagcatcgggctgctctgtgtgatggcatcctctgtccttctgtggatggctagcgtggagccccattggatagccgcatccatcattttggaatttttcctgatggttctcctgatccctgagcccgacagacagaggacgccacaggataaccaacttgcctacgtggtcattggactcctgtttatgatcttgaccgtagctgcgaatgagatgggtctgttagaaacaactaagaaggacctaggcatagggcacgtggccgttgagaaccaccatcacgcagctatgctggatgtggacctccatcctgcctcagcctggaccctttacgcagtcgctacaaccattatcactcccatgatgcgccacacaattgaaaacacgaccgccaatatctctctgactgcgatagctaaccaggccgcaatcttgatgggactggataaaggctggccaattagtaagatggacatcggtgtgcctctcctggcccttgggtgctattcgcaggtcaatccgttaacactgaccgctgcagtgctcatgttggttgcccattacgcgattatcggccccggactgcaagctaaagccacccgggaggcacagaagcgaacagccgctggcataatgaaaaacccaactgtggatgggattgtagccatcgacctagatcctgtggtctatgacgcaaagttcgaaaagcagctgggacagatcatgctccttattctgtgtacgagccaaatcttgctgatgagaaccacatgggctctctgcgagtccataactctggccaccggccccttaacaaccctttgggagggttctccagggaaattttggaatactacgattgcggtttcaatggccaacatcttcaggggaagctacctggcaggcgctggtctcgccttctccctaatgaagagtctgggcgggggacgccggggcacaggggcacagggagaaaccttgggcgagaaatggaagagacagctgaatcagctctctaaaagcgaatttaacacttataagcgttcaggtattatggaggtggacaggtccgaagctaaggaggggcttaaacggggagagaccacaaagcacgccgtcagtcgcggcactgccaaactgcgatggttcgtggaaagaaatttggtaaagcctgagggtaaagtgatcgatctgggctgtgggaggggaggctggagctactattgcgcggggctcaagaaggttaccgaagtgaaaggatacacaaagggcggtcccgggcacgaggaaccgataccaatggctacgtacggatggaacttagtcaaactgccttctggcaaggacgtgtttttcatacccccagagaaatgtgatacccttctgtgcgacattggcgagtcctcacccaatcctactatcgaagaggggcggacactacgcgtcctcaagatggtggaaccgtggctgagaggaaaccaattttgtattaaaatcttgaatccctatatgccaagcgttgtagagaccctggagcagatgcagaggaagcatggtggcatgctcgtgcgaaaccctctttcgagaaattctactcacgaaatgtactgggtcagttgcgggacaggaaacattgtgtccgcagttaatatgaccagccgtatgctgttaaacagattcacgatggcccatcgcaagcccacctatgagagggatgtggacctgggcgctggtacacggcacgtcgccgtggaacctgaggtagcaaacttggatatcatagggcagagaattgaaaatatcaaacacgagcataagtcaacttggcactacgacgaggataacccatataaaacctgggcctaccatggatcctatgaagtgaagccctctggcagcgctagttccatggttaatggcgtcgtgaaactcctgacaaagccttgggacgtgatcccaatggtcactcaaattgcgatgaccgatacaaccccctttgggcagcagcgcgttttcaaggagaaagtggacactaggacgccgaaggccaaacgaggaacagcacaaataatggaagtaaccgctaagtggctatggggttttcttagccggaacaaaaagcctagaatctgtactagggaggagttcacccgcaaggtgcgttctaatgccgcaattggcgccgtctttgtggacgagaaccagtggaactcagctaaagaggccgttgaagatgagcggttctgggacctggtgcacagagaaagggagctccataagcaggggaaatgcgcgacatgcgtctacaacatgatgggaaagcgcgagaagaagctgggcgagtttggtaaggcaaaagggagtcgagccatctggtacatgtggttgggagctcggttcctggagttcgaagccctcggctttatgaatgaggatcactggttctccagagaaaacagcctttctggcgtggagggggagggactgcacaagttaggttatattctgagggacatctcgaaaataccaggcgggaatatgtacgcagatgacacggctggatgggatacccgcatcactgaagacgatttgcagaacgagcccagaattacagacatcatggaacctgagcatgccctcctggctaagtcaatttttaaactaacctatcaaaataaggtagttcgggtgcagagcccagccaaaaacggcactgtcatggatgtgatctccaggcgtgaccagcgaggtagtggacaggtgggaacatacggccttaataccttcacaaacatggaagcacaactgatacgccagatggagtctgagggcatttttagcccctccgaactcgagactccgaacctggcggaaagagtcttggattggttagagaagtatggggttgaacggctgaagaggatggccatctcaggagacgactgtgtggtaaaacctatcgatgaccgcttcgctaccgccctcacggcacttaatgatatgggtaaggtgagaaaagacattccccagtgggagccaagtaagggctggaacgattggcagcaagtccctttttggtctcaccatttccaccagctgataatgaaagacgggcgggagatcgtggttccctgcaggaatcaggatgagctagtgggacgagctcgtgtcagccagggcgccggttggtccctgagagagaccgcatgtctcgccaagtcatacgcgcaaatgtggcagttgatgtattttcaccgccgggacctgaggcttgctgccaacgcaatttgcagcgccgtgccagtagattggatccccacatctagaactacctggtccattcatgctcaccatcagtggatgacaactgaagacatgctgagtgtttggaatcgcgtgtggatcgaggaaaacccttggatggaggataagacccacataagctcgtggggagacgtcccatacctcggaaaacgggaggaccaatggtgtggctccttaatcggcctgacggccagggcaacatgggctaccaatattcaggtggccatcaaccaggttcgaagattgattgggaatgaaaactacctggattatatgacttctatgaagcggttcaaaaatgagtcagacccggaaggagcgctctggtga

SEQ ID NO: 13623 - RNA, 9879 nt, synthetic construct
  misc_feature 1..9879: note = derived and/or modified CDS sequence (opt3) from DENV-1__FJ432725__SS-prME
  source 1..9879: mol_type = other RNA
agcgtgaccatgctgctcatgcttatgcccaccgccctggctttccacttgactacgcggggaggggaacctcatatgatcgtctccaagcaggaaaggggaaaatctttactgtttaagacctcagccggtgttaatatgtgcacgctaattgccatggacctcggcgaactgtgtgaagatactatgacctacaaatgcccacggatcacagaaaccgaaccggacgatgtggactgttggtgcaatgcgactgatacatgggtgacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaggacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaggcccctacaaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccggttcgttcaaactggagaaggaagtcgccgagacgcagcacggtacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattgtgatcggtgccggggaaaaagctctgaagctctcctggttcaagaaaggctcaagtatcggaaagatgtttgaggccaccgcaagaggcgccaggcggatggctattctgggggatacagcctgggacttcggaagcatcggtggcgtttttacgtccgtggggaaacttgtccatcagattttcggaaccgcatacggcgtgctgttttctggtgtaagctggactatgaagatagggatcggcgtgttgctcacatggctgggattaaattcacgaagtacctccctgagcatgacatgtattgcggttggcctagtcactctctacctgggggtgatggtgcaggctgattctggatgcgtcatcaactggaaaggccgcgaacttaagtgtggttcagggatcttcgttaccaatgaggtgcacacgtggacagaacaatataagtttcaggccgacagtccgaaaagattgagcgcagccattggaaaggcttgggaggagggcgtgtgcggtataaggtccgccacccggctggaaaacatcatgtggaaacagatttctaacgagctcaatcatatcctgttagaaaacgacatgaagttcactgtagtcgtgggcgatgttgcagggattctggctcagggcaagaagatgatccgccctcaacccatggagtacaaatattcgtggaaaagctggggcaaggccaagataatcggggcggacgtgcagaataccacatttattatcgatggaccaaacactcctgaatgtcccgacgatcagagagcctggaatatttgggaggtcgaggactacggcttcggtatctttaccacaaacatatggcttaagttgagggattcctatacacaggtgtgcgaccaccgtctcatgtcagctgcaattaaagatagtaaggccgttcacgctgacatggggtactggatcgaatctgagaaaaatgaaacctggaagctggcccgggcatccttcattgaggtgaagacttgtatctggccaaaatcccatacactatggtcaaacggagtactggaaagcgagatgataatccccaagatttatggcggtcctatctctcaacacaattaccgaccaggctacttcacccaggcggccgggccgtggcatctcggaaaactggagcttgattttgacttgtgcgaaggcactacagtcgtggtggatgagcactgcgggaacagaggaccctccctgaggaccacgactgtcaccggcaagattatccacgaatggtgttgccgcagttgtacattacctccactccggttcagaggtgaggacgggtgctggtatggaatggagataaggcccgttaaagaaaaggaggaaaatctggtaaagagcatggtatctgctggctccggtgaggtggactcatttagtcttggcctgttgtgtattagcatcatgatcgaagaggtcatgcgctcgcgatggtcccggcgtatgctcatgaccgggactctggccgtgttctttctactgattatgggacagctcacatggaacgatctgatcagactttgcattatggttggcgcaaatgcttctgacaggatggggatgggaaccacatacttggccctgatggcaactttcaaaatgcgccctatgtttgccgtgggcttactcttccggagactgaccagcagggaggtccttctgctaacgataggtctctcactggtggctagtgttgaattgccaaactccctggaggaattaggggatggactcgcgatgggcatcatgattctgaaacttctgacagactttcaatctcatcagttgtgggccaccctcctgagcctaactttcatcaaaaccacattttccctgcactatgcatggaagactatggctatggtgctttcaattgtcagcctcttccccctgtgtttgagtaccacgtctcagaaaacaacctggctgccggtattactcggctccctggggtgcaagcctcttactatgtttctgatcgccgagaataagatatggggacgacgcagctggccattgaacgaaggtatcatggccgtgggcattgtttcgatcctcctgtcatctctactgaaaaacgatgtgccccttgctgggcctctcattgcaggaggcatgctgatcgcctgttacgtcataagtggttccagcgcggacttgtctttagagaaggctgccgaggtgagctgggaagaggaagcagagcattccggggcctcacacaatattctggtagaagtgcaggatgacggaacaatgaaaatcaaggatgaggagcgggacgataccctcactatcctgcttaaagctacactgttggcagtcagtggcgtttatcccctaagcattccagccaccctgttcgtgtggtacttctggcaaaagaaaaagcagagatctggcgtgctctgggacacgccttcacccccagaagtcgagagggcggtgctggatgacgggatatatcgtatcatgcagcgcggacttttaggtcggagccaggttggcgtaggggtgtttcaagaaaacgtcttccatactatgtggcacgtgaccagaggagctgttctgatgtaccagggcaagaggctcgagccgagttgggccagcgtgaaaaaggacttgatttcctacggtgggggatggcgactgcagggctcttggaatacaggcgaggaagtccaggtgatcgcagtagagcctgggaaaaaccccaagaatgtccaaaccgccccaggaacatttaaaactcccgaaggtgaggtgggcgctattgccctcgatttcaagcctgggacctcgggaagcccaatcgttaaccgggaaggcaagatagtgggtctgtatgggaatggagtcgtgacgacatcaggcacttacgtttccgcaatcgctcaggccaaagcgagtcaggagggcccccttcctgagattgaagacgaggtgtttcgcaagagaaacctgaccatcatggatttgcacccggggtctggaaaaacaaggcggtatctaccagccattgtccgagaagcaatcaagagaaaactgcgcaccctcatattagctcccactagggtggtagccagcgagatggctgaagcactgaagggtatgcctattcgttaccaaaccacagccgtgaagtccgagcatacgggcaaagagatcgttgaccttatgtgccacgccactttcaccatgcggctgctctcaccagtcagagtgcccaattataacatgatcattatggatgaagctcattttacagacccttctagcatcgcggcaagggggtacataagtacccgcgtgggaatgggcgaggccgctgccattttcatgactgcaacaccgcccggttccgtcgaagcctttccacagagcaatgctgtaatccaggatgaggaacgagacattcctgagagatcttggaactcagggtatgagtggatcaccgatttccccggaaagacggtgtggtttgttccatccataaaaagtggcaatgacattgcgaactgtttgcggaagaatggcaaaagggtgatccagctgagccgcaagactttcgatacagaataccaaaagaccaaaaacaacgactgggactacgtcgtgaccactgatatctcggagatgggggccaatttccgtgcagacagagttattgatcctcggaggtgcctcaagcccgtgatcctgaaagacggaccagaacgcgtcattcttgctggtccgatgcctgtgacagtagcctctgcagcccagcgaagaggccggatagggaggaaccacaataaggagggagatcagtatatctacatgggccagcccctaaacaatgacgaggatcatgctcactggaccgaagccaaaatgctgttggacaacattaatacaccagagggtatcatccccgcgttatttgaacctgagcgcgaaaagtccgcagccattgatggggagtatagactgaggggcgaggctcggaagactttcgtggaactcatgcgtcgcggagacctgccagtttggcttagctacaaagtcgcctcagagggctttcaatatagtgatcgaagatggtgcttcgacggggaaaggaacaatcaggtgctggaggaaaacatggatgtggagatatggacgaaggagggagaacggaaaaagctccgccccagatggttggacgctaggacctactctgaccctctggcactacgggagtttaaagagttcgccgctggtcgaagatccgtcagcggcgatctgatcctcgagattgggaaacttccgcagcacctgacacagcgcgcccaaaatgcattagacaacttggttatgctgcataattcagaacagggaggcagggcgtatcggcacgccatggaggagctcccagatactatcgaaaccctgatgcttctggctctcattgccggtgtgacagggggcgtaaccttggtgtttctgagtggacgtggcttagggaaaactagcatcggactactgtgtgtcatggcatcctctgtgctcctttggatggctagcgttgagccccattggatagccgcatccatcattctggagttctttttgatggtgctgctcatccctgagcccgacagacagaggacgccacaggataaccaactggcctacgtcgtaattggtcttctcttcatgatcctgaccgtggctgcgaatgagatgggcttgctggaaacaactaagaaggacttagggataggacacgttgccgtggagaaccaccatcacgcagctatgctagatgtcgacctgcatcctgcctcagcctggaccctctacgcagtggctacaaccattatcactcccatgatgcgccacacaattgaaaacacgaccgccaatatctctcttactgcgatagctaaccaggccgcaatcctgatgggcttggccaaaggttggccaattagtaagatggatatcggggtccctctgctcgctctgggctgctatagccaggtgaatccgcttacattaaccgcacccgttctgatgctcgtggcccattacgcgattatcggaccaggcttgcaagctaaagccacccgggaggcacagaagcgaacagccgctgggataatgaaaaaccctactgtagacggaattgtggccatcgatctggaccccgtcgtttatgatgcaaagtttgaaaagcagctaggccagatcatgctgctcattctttgtacgagccaaatcctgttgatgagaaccacatgggctctgtgcgagtccataactctcgccaccggtccactgacaaccttatgggaggggtctcctggaaaattctggaatactacgattgcggtgtcaatggccaacatctttaggggcagctaccttgcaggagctggcctggccttctccctcatgaagagtctagggggaggccgccgggggacaggagcacagggcgaaaccctgggtgagaaatggaagagacagttgaatcagctgtctaaaagcgagttcaacacttataagcgttcagggattatggaggtcgacaggtccgaagctaaggagggactcaaacggggcgagaccacaaagcacgccgtgagtcgcggtactgccaaacttcgatggtttgtagaaagaaatctggtgaagcccgagggcaaagttatcgacttggggtgtggaaggggcgggtggagctactattgcgcgggactgaagaaggtgaccgaagtcaaaggctacacaaagggtgggccgggacacgaggaaccaatacctatggctacgtacggctggaacctcgtgaaattacattctggcaaggatgtcttctttatacccccagagaaatgtgacaccctgctttgcgatattggggagtcctcacccaatcctactatcgaagagggacggacactgcgcgtgctaaagatggttgaaccgtggctcagaggtaaccaattctgtattaaaatcctgaatccctatatgccaagcgtagtggagaccttggagcagatgcagaggaagcacggcgggatgctggtccgaaaccctctctcgagaaattctactcatgaaatgtactgggtgagttgcggaacaggcaacattgtttccgcagtgaatatgaccagccgtatgcttctgaacagatttacgatggcccaccgcaagcccacctatgagagggacgtcgatttaggtgctgggcctcggcacgtggccgtagaaccagaggtggcaaacctggacatcataggacagagaattgaaaatatcaaacatgagcacaagtcaacatggcattacgatgaggacaacccctataaaacttgggcctaccacggctcctatgaagttaagccttctggcagcgctagttccatggtcaatggggtggtgaaattgctcaccaagccatgggatgtcatccccatggttacacaaattgcgatgactgacaccacaccgttcggacagcagcgcgtgtttaaggagaaagtagataccaggactcctaaggccaaacgaggtacggcacaaataatggaagtgacagctaagtggctgtggggcttcctaagccggaacaaaaagccaagaatctgtaccagggaggaatttactcgcaaggtccgttctaatgccgcaattggggccgtgttcgttgacgagaaccagtggaactcagctaaagaggccgtggaagacgagcggttttgggatcttggacatagagaaagggagctgcacaagcagggcaaatgcgcgacctgcgtcagtaacatgatgggtaagcgcgagaagaagctcggggagttcggaaagcccaaaggctcccgacctatctggtacatgtggctgggcgcacggtttttggagttcgaagccctggggttcatgaatgaggaccactggtttagcagagaaaactctctctcgggagtggagggtgagggccttcataagctggggtacattttaagggatatctcaaaaataccaggaggcaatatgtatgctgacgatacagccggttgggacacgcgcatcaccgaagatgacctgcagaacgaggcaagaattactgatatcatggaacccgagcacgctttgctcgccaagagcattttcaaactgacataccaaaataaggtagttcgggtgcagaggccggctaaaaacgggaccgtcatggacgtgatctccagtcgtgatcagcgaggatctggccaggtgggcacttatgggctaaatacatttaccaacatggaagcccaacttatacgccagatggagagcgagggaattttctccccttcagaactggagacacccaacctcgcagaaagagtcctggactggttggagaagtacggtgttgaacggttaaagaggatggcgatcagtggcgatgactgtgtggtaaaaccaatcgacgatcgctttgccactgctctgaccgccctcaatgacatggggaaggtgagaaaagatattcctcagtgggagccctctaagggatggaacgactggcagcaagtcccattctgcagccatcactttcaccagcttataatgaaagatggccgggagatcgtggttccctgtaggaatcaggacgaactggtgggtcgagcacgtgtctcccagggggctggatggtcactaagagagacggcctgcctgggcaagagctatgcacaaatgtggcagctcatgtacttccatcgccgggatttgaggctggccgcgaacgctatttgttctgccgtgcctgtagactggatcccaacctccagaacaacttggagtattcacgcacatcaccagtggatgaccacagaagatatgcttagcgtttggaatcgcgtgtggatcgaggaaaacccgtggatggaggacaagactcatatatcgtcctggggcgatgtcccctatctggggaaacgggaggaccaatggtgcggatctctcatcggtttaaccgccagggctacgtgggccacaaatattcaggtggcaatcaaccaggttcgaagactgattggcaatgaaaactacttggactacatgacctcaatgaagcggtttaaaaatgagagcgatcctgaaggggctctgtggtga

SEQ ID NO: 13624 - RNA, 9879 nt, synthetic construct
  misc_feature 1..9879: note = derived and/or modified CDS sequence (opt3) from DENV-1__FJ432729__SS-prME
  source 1..9879: mol_type = other RNA
agcgtgaccatgctgctcatgcttatgcccacagccctggctttccacttgactacgaggggaggggagcctcatatgatcgtcaccaagcaggaaaggggaaaatccttactgtttaagacatctgctggtgttaatatgtgcactctaattgccatggacctcggcgagctgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgctccccatgtcggcctgggtttggagaccagaacagaaacttggatgagctccgagggggcctggaaacagatccagagggtggaaacctgggctctccggcaccctggattcacagttattgcactgtttctggcccatgtgatcggcacctctattacgcagaagggcatcatattcatcctcttaatgctggtcactccatcgatggctatgcgctgcgtggggattggatcaagagattttgtagagggtcttagcggcgccacatgggttgacgtggtcttggagcacgggagttgtgtgaccactatggcgaaggataaacccacactggacatcgaactactcaagaccgaggtgacgaaccctgcagtcctgaggaaactttgcattgaagccaagatctccaataccacaactgattctcggtgtccaacccaaggagaggctacactgatggaagaacaagacgccaacttcgtttgccgccgaacttttgtggatagaggctggggtaatgggtgtggattgttcggcaaaggcagcctcataacctgcgcaaagtttaagtgcgtaacaaaactggaggggaagattgtgcagtacgaaaacttaaaatattccgtcatcgtgaccgttcacactggagaccagcatcaagtgggtaatgagtcaacggaacacggcacaattgctaccatcactccccaggcccctaccagtgagatccagctgacagactacggggcgctcacccttgattgtagcccaaggactggactggacttcaacgaaatggtcttgctaacaatgaaggagaaatcttggctggtgcataagcagtggtttctcgatctgccgcttccctggacgtccggcgcctcaaccagccaagagacttggaatcggcaggacctgttggtaacattcaaaaccgcacacgctaagaagcaggaagttgtggtcctcggtagtcaagagggggccatgcacacagctctgactggcgccaccgaaattcagacgtctggaaccacaactatatttgcaggccatttaaaatgccgtctgaagatggataaactaaccctcaaggggatgtcctatgtgatgtgtacagggagcttcaaactggagaaggaagtcgccgagactcagcacggtaccgtgcttgttcagatcaagtacgagggcacggacgctccttgcaaaattccattctcgacacaagatgaaaagggggtgacccagaacggacgcttgatcactgcgaatcccatagtaacagacaaagagaagcctgtcaacattgaagcagagccaccctttggcgagtcttatatcgtgatcggtgccggggaaaaagctctgaagctctcctggttcaagaaaggctcaagtattggaaagatgtttgaggccaccgcaagaggcgccaggcggatggctatcctgggggatactgcctgggacttcggaagcattggtggcgtttttacctccgtggggaaacttgtccatcagatattcggaacagcatacggcgtgctgttttctggtgtaagctggacgatgaagatcgggattggcgtgttgctcacctggctgggattaaattcacgaagtacttccctgagcatgacatgtatcgcggttggcctagtcaccctctacctgggggtgatggtgcaggctgattctggatgcgtcatcaactggaaaggccgcgaacttaagtgtggttcagggattttcgttacaaatgaggtgcacacttggaccgaacaatataagtttcaggccgacagtccgaaaagattgagcgcagccataggaaaggcttgggaggagggcgtgtgcggtatcaggtccgccacgcggctggaaaacattatgtggaaacagatctctaacgagctcaatcatattctgttagaaaacgacatgaagttcacagtagtcgtgggcgatgttgtggggatcctggcacagggcaagaagatgatacgccctcaacccatggagcacaaatactcgtggaaaagctggggcaaggctaagatcattggggccgacgtccagaataccacttttatcattgatggaccaaacacccctgaatgtcccgacgatcagagagcgtggaatatctgggaggtggaggactatggcttcggtatatttacaactaacatttggcttaagttgagggattcccacacccaggtttgcgaccatcgtctcatgtcagccgctatcaaagatagtaaggcagtgcacgccgacatggggtactggattgaatctgagaaaaatgaaacatggaagctggctcgggccagcttcatcgaggtaaagacgtgtatatggccaaaatcccataccctatggtcaaacggagtcctggaaagcgagatgatcattcccaagatctatggcggtcctatttctcaacacaattaccgaccaggctatttcactcagacagcagggccgtggcacctcggaaaactggagcttgattttgacttgtgcgaaggcaccactgtggtggtcgatgagcattgcgggaacagaggaccctccctgaggacaaccacggttactggcaagatcatacacgaatggtgttgccgcagttgtaccttacctccactccggttcaaaggtgaggacgggtgctggtacggaatggagattagacccgtgaaggaaaaggaggaaaatctggtaaaaagcatggtgtctgcgggctccggtgaggtcgactcatttagtcttggcctgttgtgtatcagcatcatgattgaagaggtgatgaggtcgcgctggtcccgaaagatgctcatgacagggaccctggccgttttcctactgctcatcatgggacagctgacttggaacgatcttattcggttgtgcataatggtgggcgctaatgcctctgaccgtatggggatgggaacaacctacctggcattaatggctacatttaaaatgagacctatgttcgccgtcggcctcctgtttaggcgccttactagccgggaggtgctgctactcaccatcggtctgtcattggttgcaagtgtggaactgccaaactccttagaggaactcggggatggactggccatgggcattatgatccttaagctgttgacggacttccaatctcatcagctctgggctacactgctaagcctgacctttattaaaactaccctttccctccactatgcgtggaagacaatggccatggtcctgtcaatcgtatccttgttccccctgtgtttaagtactacctctcagaagacgacatggctcccggtgctgcttggctccctggggtgcaaacctttggcaatgctcctgatagctgagaataagatctggggaagaaaaagctggccactaaacgaaggtattatggccgttggcgtggtctcgatcctgctttcatctctcctgaagaacgatgtgcccttggccgggcctttaattgctggaggcatgctgatcgcatgttacgtaataagtggttccagcgccgacctctctctggagaaagcggctgaggtgagctgggaagaggaagccgagcattccggggcatcacacaatattcttgtcgaagttcaggatgacggaaccatgaagatcaaagatgaggagagggacgatactctgacaatcttgctaaaggccaccctgctcgctgtgagtggcgtgtatcccctgagcattccagcaactctttttgtctggtacttctggcaaaagaaaaagcagcgatctggcgtgttatgggacacaccttcacccccagaagttgagcgcgccgtactggatgacgggatatatcggatcatgcagagaggactcttgggtaggagccaggtgggcgtcggggtgtttcaagaaaacgttttccacaccatgtggcatgtgacgcgtggagcggtcctgatgtaccagggcaaacgcctcgagccgagttgggctagcgtgaagaaagacctgatttcctatggtgggggatggcggcttcagggctcttggaatactggcgaggaagtacaggtcatcgccgtggagcctgggaagaaccccaagaatgttcaaaccgcaccaggaacattcaaaacccccgaaggtgaggtgggcgccattgctctggattttaagcctgggacatcgggaagcccaatcgtcaacagagaaggcaaaatagtgggtttgtacgggaatggagttgtgactacctcaggcacgtacgtctccgccatcgcacaggctaaggccagtcaggagggccccctacctgagattgaagacgaggtgttcaggaaacgaaacctgacaatcatggatctccacccggggtctggaaagactcggcgctatttaccagcgattgtaagagaagccatcaagaggaaactgcggacccttatactggcacccacacgagtggttgctagcgagatggccgaagctctcaagggtatgcctattagataccaaaccactgcagtcaaatccgagcataccggcaaggagatcgtggacttgatgtgccacgccacatttacgatgcgcctgctctcaccagtgagggtccccaattataacatgatcattatggatgaagcccatttcactgacccttctagcatcgctgcgcgtgggtacataagtacccgggtaggaatgggcgaggcagccgctatttttatgacagccaccccgcccggttccgtggaagcattcccacagagcaatgccgttatccaggatgaggaaagagacattcctgagaggtcttggaactcagggtatgagtggatcactgattttcccggaaaaacagtgtggttcgtcccatccataaagagtggcaatgacattgctaactgtctgcgcaagaatggcaaacgagtgatccagcttagcagaaagacctttgatacggaataccagaaaactaagaacaacgactgggactatgttgtgacaaccgatatctcggagatgggggcgaatttccgggccgacagggtcattgatcctcgccgttgcctaaaacccgtgatcctgaaggacggaccagaaagagtaattttggcaggtccgatgcctgtgaccgttgcttctgccgcacagcggaggggccgcatagggcgaaaccacaataaggagggagatcagtacatctacatgggccagcccttaaacaatgacgaggatcacgcccattggactgaagctaaaatgctgctcgacaacattaatacaccagagggtatcatccccgccctgtttgaacctgagagagaaaagtccgcggcaattgatggggagtatcggcttaggggcgaggcccgcaaaaccttcgtcgaactgatgagaaggggagacctcccagtgtggttgagctacaaggtggcttcagagggcttccaatatagtgatcggcgttggtgctttgacggggaacgcaacaatcaggtcctggaggaaaacatggatgttgagatatggacaaaagagggagaacgaaagaaactaagacccaggtggctggacgcccggacttactctgaccctctcgcacttcgcgagttcaaggaatttgcagccggtagaaggtccgtgagcggcgatctgatcttagagattgggaagttgccgcagcacctgacgcagcgggctcaaaatgccctcgacaacctggtaatgcttcataattcagaacagggaggccgagcatatagacacgcgatggaggagctgccagataccatcgaaacactcatgttgctggccttaattgctgtgctaactggtggggtcaccctgttctttctcagtggccgcggacttggcaaaacaagcatcgggctgttgtgtgtgatggcctcctctgttctgctctggatggcaagcgtggagccccactggatagctgcctccatcattctggagttctttcttatggtcctcctgatccctgagcccgacaggcagcggaccccacaggataaccaattggcatacgtagtgattggactgttattcatgatcctaactgttgccgctaatgagatgggtctgctcgaaacgaccaagaaagaccttggcatagggcatgtggcggtcgagaaccaccatcacgccacaatgctggatgtggacttgcatcctgcatcagcttggactctgtatgccgtcgccaccacaattatcacccccatgatgcgtcacactattgaaaacacaacggcaaatatctctctcaccgctatagccaaccaggcggctatcctgatgggacttgataagggctggccaattagtaaaatggacatcggtgtgcctttactggccctcgggtgctactcgcaggttaatccgttgactctgacagcagccgtgctaatgctggtagctcactacgcaattatcggccccggactccaagccaaggcgaccagagaggctcagaagaggaccgccgcaggcataatgaaaaacccaacagtggatgggattgtcgccatcgaccttgatcctgttgtgtatgacgctaagtttgaaaaacagctgggacagatcatgttgctgattctctgtactagccaaatcctgttaatgcgcacgacctgggccctttgcgagtccataacactggcaactggccccctcaccacactatgggagggttctccagggaagttctggaataccactattgctgtctcaatggccaacatctttcggggaagctacctggcgggcgccggtttggcattctccctgatgaaaagtctcggcgggggacgaagaggcacgggggctcagggagaaacacttggcgagaagtggaagaggcagctgaatcagttgtctaaaagcgaatttaacatttataagcgctcaggtatcatggaggtggaccggtccgaagccaaagaggggctgaagagaggagagaccactcgtcatgcagtaagtaggggcaccgctaaactccggtggttcgtggaacgcaatttagttaagcctgagggtaaggtgatagatctgggctgtgggcgaggaggctggagctactattgcgccgggcttaaaaaggtcacagaagtgaaaggatacactaagggcggtcccgggcacgaggaaccgatcccaatggccacctatggatggaacctggtcaaactacattctggcaaggacgtgttctttacacctcccgagaaatgtgatacgctcctgtgcgacattggcgagtcctcaccaaatcccaccatcgaagaggggagaactttgagggttctgaagatggtagaaccttggctccggggaaaccaattctgtattaagatccttaatccgtacatgcccagcgtggtcgagacactggagcagatgcagcgcaaacacggtggcatgttagtgagaaacccactgtcgagaaattctacccacgaaatgtactgggttagttgcgggactggaaacattgtgtccgcggtcaatatgacaagccgaatgttgctcaaccggtttaccatggctcatcgtaagcctacgtatgagagagatgtggacctgggcgcaggtacccgccacgtagccgtggaacccgaggttgctaacctagatatcatagggcagaggattgaaaatatcaaacatgagcacaagtcaacatggcattacgacgaggataacccttataaaacttgggcctaccacggatcctatgaagtcaagccatctggcagcgcaagttccatggtgaatggcgtggtcaaacttctgaccaaaccctgggacgttatccctatggtgacacaaattgccatgactgataccacaccattcgggcagcagcgggtatttaaggagaaagtggacaccagaactcccaaggctaaacgcggaacggcgcaaataatggaagtcacagccaggtggctctggggtttcctgagccgaaacaagaagccgcggatctgtaccagagaggaatttactaggaaagtgcgctctaatgcagctattggcgccgttttcgtggacgagaaccagtggaactcagcaaaggaggccgtcgaagatgagcgtttttgggacttggtgcagaaagaacgggagctgcacaagcaggggaaatgcgctacctgcgtatacaacatgatgggaaagagagaaaagaaactcggcgagttcggtaaggccaaagggagtagggcgatctggtatatgtggcttggagcacgctttctggagttcgaagccttaggctttatgaatgaggatcattggttctcccgagaaaacagcctgtctggcgttgagggggagggattgcacaagctcggttacattctgcgggacatctcgaaaatacctggcgggaatatgtacgctgatgacacagccggatgggatacgagaatcaccgaagacgatctacaaaacgaggcaaggattactgacatcatggaaccagagcatgcacttctggccacatcaattttcaagctcacctatcagaataaagtggtccgcgtgcagagacccgctaagaacggcactgtgatggatgtcatcagccggagggaccagcgtggttccgggcaagttggaacatacggcctgaatacctttacaaacatggaagcccagttgatacgacagatggagagtgagggcattttcttaccttctgaactggagactcagaacctcgcagaacgcgtgcttgattggctggagaagtatggggtagaaagactaaaacggatggcgatcagcggagacgactgtgtggtcaagccaatcgatgacaggtttgccaccgctctgacggccctcaatgatatgggtaaagtgcgcaaggacattccccaatgggagccgtccaaaggctggaacgattggcagcaggttcctttctgctcacaccactttcatcagttgataatgaaggacgggagagagatcgtggtcccctgtcggaatcaagatgaactggtgggaagggcacgagtaagtcagggcgctggttggtctcttcgtgagaccgcctgcctgggaaagagctacgcacagatgtggcaactcatgtatttccacagacgcgacttacggctggccgcgaacgctatttgttccgccgttccagtggattgggtccctacatcaaggactacctggagcatccatgcacaccatcagtggatgacaactgaagacatgttgtctgtgtggaatagagtttggattgaggaaaacccctggatggaggataaaacccacgtgtccagttggggagacgtcccatacctgggcaagcgcgaggaccagtggtgcggcagcctcatcgggcttacggcccgggctacatgggcctcgaatatacaggtggcaatcaaccaagtaaggcgactgattggaaatgaaaactatctagattacatgacctccatgaaaagatttaagaatgagggtgaccccgaaggcgctctgtggtga

SEQ ID NO: 13625 - RNA, 9879 nt, synthetic construct
  misc_feature 1..9879: note = derived and/or modified CDS sequence (opt3) from DENV-1__FJ432730__SS-prME
  source 1..9879: mol_type = other RNA
agcgtgaccatgctgctaatgcttatgcccacagcactggctttccacttgactacgcgaggcggggaacctcatatgatcgtctccaagcaggaaagggggaaatctttactgtttaagacctcagccggtgttaacatgtgcacactaattgcaatggacctcggcgagttctgtgaagatactatgacctacaaatgcccacggataacagaggcggaaccggacgatgtggactgttggtgcaatgctaccgatacttgggtaacatatgggacctgtagtcaaacgggggagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaagacgcaaactttgtttgccgccgaacattcgtggatagaggctggggtaatgggtgtggactgtttggcaaaggctccttgataacttgcgctaagttcaagtgcgtaaccaaactcgaggggaagacagtgcagtacgaaaacctgaaatattcagtcattgtgaccgttcacactggagaccagcatcaagtgggtaatgagagtacggaacacggcacaaccgccactatcacaccccaggcgcctagcacagagattcagttaaccgactacggggccctgactctcgattgttctccaaggacaggacttgactttaacgaaatggtcctgttgacgatgaaggagaaatcctggctagtgcataagcagtggttcctggatctcccgctgccctggacctcaggcgcaagcacaagtcaagagacatggaatcggaaagaccttctggtaacctttaagacagctcacgccaagaaacaggaagttgtggtcttgggttctcaggagggggctatgcacactgccctcaccggcgcaacggaaatccaaacctccggaatgacaactatcttcgccggccatctgaagtgccgtttaaaaatggataagctgaccctaaaagggatgagctatgtgatgtgtacaggatcgttcaagctcgagaaggaagtcgctgagactcagcacggtaccgtgctggttcagattaaatacgagggcacggacgcgccttgcaagataccattttctacacaggatgaaaaaggggtgacccaaaacggacgccttatcactgcaaatcccattgtaacagacaaggagaaacctgtcaacatcgaagccgagccacccttcggcgagtcctatatagtgattggtgctggggaaaaggccttgaagctgtcatggtttaaaaagggcagtagcatcggaaaaatgttcgaggcaaccgccagaggcgctaggcggatggccatcctcggggatactgcatgggactttggatccattggtggcgttttcacctctgtggggaagctggtccatcagatctttggaacagcgtacggcgtgcttttcagcggtgtatcatggacgatgaaaattgggataggcgtgctgttgacctggctcggactgaatagtcgatccactagcttatctatgacatgtatcgctgttggcctggtcaccctatacctcggggtgatggtgcaggccgattcaggatgcgtcattaactggaagggccgcgaactgaagtgtggtagtgggatctttgttacaaatgaggtgcacacttggaccgaacagtataaattccaagcagacagcccgaagagactttccgccgctatcggaaaagcctgggaggagggcgtgtgcggtattaggtctgcaacgcggttggaaaacataatgtggaagcagatctcgaacgagctgaatcatattctcctggaaaacgacatgaaatttacagtagtcgtgggcgatgttgctgggatcttagcccagggaaagaaaatgattcgccctcagcccatggagtacaagtatagctggaagtcctggggcaaagcgaagatcataggggccgacgtgcaaaataccactttcatcattgatggaccaaacacccctgaatgtcccgacgatcagagagcttggaatatctgggaggtcgaggactacggctttggtattttcacaactaacatctggctgaaacttagggattcatatacccaggtgtgcgaccaccgtttgatgagtgcagccataaaggattctaaagctgttcacgccgacatggggtactggattgaaagcgagaagaatgaaacatggaagctcgcacgggcgtccttcatcgaggtgaaaacgtgtatttggccaaagtcacataccctgtggagcaacggagtactagaatctgagatgatcatacccaaaatctatggcggtcctatttcccagcacaattaccgaccaggctactttactcaaacagccgggccgtggcatctgggaaagctcgagctggatttcgacctttgcgaaggcaccactgtcgtggtggatgagcactgcgggaacagaggacccagtttgaggacaaccacggtcactggcaaaatcattcacgaatggtgttgccgcagctgtaccctgcctccattacggtttaagggtgaggacgggtgctggtatggaatggagatcagacccgttaaggaaaaagaggaaaatctcgtgaagtctatggtatccgctggctcaggtgaggtggacagtttcagcctgggccttctgtgtatatcgattatgatcgaagaggtcatgaggtcccgctggtctcgaaaaatgttgatgacagggaccctcgccgtgtttttcctgctaatcatgggacagctgacttggaacgatctcattcggctgtgcatcatggttggcgcaaatgctagcgaccgtatggggatgggaacaacctaccttgccttgatggcaacatttaagatgagacctatgttcgccgtgggcctgttatttaggcgcctcacttcacgggaggtcctgcttctgaccattggtctaagtctcgtggcttccgttgaactgccaaactctttggaggaactgggggatggattagcgatgggcataatgatcctcaaactgcttacggacttccagagccatcaactgtgggccacattgctctccctgacctttattaagactaccttctcactacactatgcatggaagacaatggctatggtgctgagcatcgtcagtctttttcccctctgtctgtctactacctcccagaaaacgacatggttgccggtactgttaggcagcctcgggtgcaagcctctgaccatgttccttattgccgagaataaaatctggggaagaaagtcgtggccactgaacgaaggtataatggccgtgggcatcgtttcaattttgctctctagtctgctcaagaatgatgtgcccctggctgggcctcttatcgcaggaggcatgctcattgcctgttacgtcatctccggtagctctgcggacctgagcttggagaaggctgccgaggtgtcctgggaagaggaagcagagcattcaggggccagtcacaatatattagtagaagtgcaggatgacggaactatgaaaattaaggatgaggagagggacgatacactgaccatcctcctgaaggctactcttctggcagtcagcggcgtttatcccttgtctatcccagccacactattcgtgtggtacttttggcagaaaaagaaacaacgatccggcgtgctgtgggacaccccttcacccccagaagtcgagcgcgcggtgctcgatgacgggatttatcggataatgcagagaggactgcttggtaggagtcaggttggcgtaggggtgttccaggaaaacgtctttcatacgatgtggcacgtgactcgtggagctgttttaatgtaccaaggcaagcgcctggagccgagctgggcctccgtgaaaaaggacctcatctcttacggtgggggatggcggttgcagggctcgtggaataccggcgaggaagtccaggtgattgcagtagagcctgggaagaaccccaaaaatgtccagacagccccaggaaccttcaagacaagcgaaggtgaggtgggcgctatcgccctggattttaaacccgggacttcaggatcccctattgttaacagagaaggcaagatcgtgggtctctatgggaatggagtcgtgaccacgagtggcacatacgtttctgcaatagctcaagccaaagcgagccaggagggcccactgcccgagatcgaagacgaggtgttcaggaagcgaaaccttactattatggatctgcaccctgggtccggaaagacccggcgctatttgccggccatcgtcagagaagcaattaaaaggaagctacggacactgatcctcgctccaacccgagtggtagcctcagagatggctgaagcattaaaaggtatgcccataagataccagactaccgccgtgaagtctgagcatacaggcaaagagattgttgacctgatgtgccacgccacgtttactatgcgccttctgagccctgtcagggtgccaaattataacatgatcatcatggatgaagctcatttcaccgaccccagttccattgcggcacgtgggtacatcagcacacgggtgggaatgggcgaggccgctgccatatttatgaccgcaactcctccgggttctgtcgaagccttcccccaatcaaatgctgtaattcaggatgaggaaagagacatcccagagaggtcctggaacagtgggtatgagtggattacagattttcctggaaagaccgtgtggttcgttcccagcatcaagtcgggcaatgacatagcgaactgtctccgcaaaaatggcaagcgagtgattcagttgtctagaaaaacgttcgatactgaataccagaagactaagaacaacgactgggactacgtcgtgaccaccgatatctccgagatgggggccaattttcgggcagacagggttatcgatccacgccgttgcctgaagcctgtgattctcaaggacggacccgaaagagtcatcctggctggtccaatgccggtgactgtagccagcgcagcccaacggaggggccgcattgggcgaaaccacaataaagagggagatcagtatatatacatgggccagcctcttaacaatgacgaggatcatgctcactggacagaagccaagatgctactggacaacatcaatacccccgagggtattatcccagcgttgttcgaacccgagagagaaaaatcagcagccatcgatggggagtatcggttaaggggcgaggctcgcaagacatttgtggaactgatgagaaggggagacctccctgtttggctgagttacaaagtcgcctctgagggcttccagtattccgatcggcgttggtgctttgacggggaacgcaacaatcaagtgcttgaggaaaacatggatgtggagatttggactaaggagggagaaaggaaaaagctgagaccaagatggctcgacgctcggacgtacagcgaccccttggcactgcgcgagttcaaggaatttgccgctggtagaaggtcagtcagtggcgatctaatactggagatcgggaaactccctcagcaccttacccagcgggcccagaatgcactggacaacttagttatgttgcataatagcgaacaaggaggccgagcgtatagacacgccatggaggagctgccggatacaattgaaactctcatgctgcttgctctgatcgccgtgctcaccggtggggtaacattgttctttctgtccggccgcggattaggcaagacctctattgggctactgtgtgtgatggcaagctccgtcctcctttggatggcttcagtggagccacattggatcgccgcatctataatcctggagttctttttgatggttctgctcattcccgagcctgacaggcagcggactccccaggataaccagctggcctacgtggtcatcggacttctcttcatgattctgacggtagctgcgaatgagatgggtttgctggaaaccaccaaaaaggacttaggcatcgggcacgtggccgttgagaaccaccatcacgcagctatgctagatgtggacctgcatccagccagtgcctggactctctacgcagtcgctaccacaataattacccctatgatgcgtcacactatcgaaaacacaacggccaatatttcgcttaccgcgatcgctaaccaagccgcaatactgatgggattggataaaggctggcccatcagcaagatggacattggtgtgccactgctcgccctggggtgctattcccaggtcaatcctcttactttaacagctgcagtgctgatgctcgttgcccattacgcgatcattggcccgggattgcaggctaaggccaccagagaggcacagaaaaggaccgccgctggcatcatgaagaaccccacagtggatgggatagtagccattgacctggatccagtggtctatgacgcaaaatttgaaaagcagctaggacagatcatgctgctcatcctttgtacttctcagattctgttgatgcgcacgacctgggctctgtgcgagtcaatcacactcgccactggccctctgaccacattatgggagggtagccccgggaaattctggaataccactatagcggtttccatggccaacattttccggggaagttaccttgcaggcgctggtctggccttttctctcatgaaaagcctaggcgggggacgaagaggcacgggggcacaaggagaaacactgggcgagaagtggaaaaggcagttgaatcagctgtcaaagtccgagttcaacacctataaacgcagtggtatcatggaggtggaccggagcgaagctaaggaggggctcaaaagaggagagactaccaagcacgccgtctctcgtggcacagccaaacttaggtggtttgtggaacggaatctggtaaaaccagagggtaaggtgattgatttgggctgtgggcgcggaggctggtcctactattgcgcggggctgaaaaaggttactgaagtgaaaggatacaccaagggcggtcctgggcacgaggaacccatcccgatggctacatacggatggaacctcgtcaaattacattcaggcaaggacgtgttctttataccacctgagaagtgtgatacgctgctttgcgacatcggcgagagctcgcccaatccaaccattgaagaggggcgaactctgagagtcctaaaaatggtggaaccctggctcaggggaaaccagttctgtatcaagattctgaatccttatatgccgtctgttgtagagacattggagcaaatgcagcggaaacacggtggcatgctggtgcgcaaccccctcagtagaaattccacccatgaaatgtactgggtcagctgcgggactggaaacatcgtgtcagcagttaatatgacatccaggatgcttctgaaccgatttaccatggcccaccggaagccaacgtatgagcgtgatgtggacttaggcgctggtaccagacacgtcgccgtggaacctgaggtagcaaacctggatattatcgggcagcgcatagaaaatattaaacatgagcacaagtctacatggcattacgacgaggataacccctataagacttgggcctaccacggaagctatgaagtgaaacctagtggctccgctagctctatggttaatggcgtcgtgaagttgctcaccaaaccatgggacgtgatccccatggtcacacagatcgcgatgactgataccacacctttcgggcaacagagggtttttaaggagaaagtggacacccggactccaaaggccaagagaggaacggcacagattatggaagtaacagctaaatggctgtggggtttcctatcacgcaacaagaaacccaggatatgtacccgagaggaatttactcggaaggtgagaagtaatgccgcaatcggcgccgtcttcgtggacgagaaccaatggaactccgctaaagaggccgttgaagatgagaggttttgggaccttgtgcatcgcgaacgtgagctgcacaagcaggggaagtgcgcgacctgcgtctacaacatgatgggaaaacgggaaaagaaactcggcgagttcggtaaggcaaaagggagcagagccatttggtacatgtggctgggagctaggttcttggagtttgaagccctgggcttcatgaatgaggatcactggttttctcgcgaaaactcgctctcaggcgtggagggggagggacttcataagctgggttatatcttacgagacattagcaaaatcccgggcgggaatatgtacgcagatgacacagctggatgggatacgcggataaccgaagacgatctgcagaacgaggccaagatcactgacattatggaacctgagcacgctttgctcgccaagtccatcttcaaactgacatatcagaataaggtagttagagtgcaaaggccagccaaaaacggcaccgtcatggatgtgattagtcgcagagaccagcggggttctggacaggtgggaacttacggcctaaatacatttaccaacatggaagcgcagcttatcaggcaaatggagagcgagggcatattctccccctcagaactggagacacctaacctcgcccgtcgagtcctggattggttggaaaagcatggggttgagcgcttaaaaagaatggctattagtggagacgactgtgtggtaaagccaatcgatgaccggtttgccactgcactgaccgctctcaatgatatgggtaaggtgaggaaagacatcccccagtgggaaccgtctaagggctggaacgattggcagcaggtccctttctgcagccaccactttcatcaacttattatgaaagacgggcgcgagatagtggttccctgtagaaatcaggatgagctggtgggacgggccagggtctcccagggcgcaggttggtcactacgagaaacggcctgcctgggaaagagctatgcgcagatgtggcaactcatgtacttccaccgtagagacttgcgcctggctgccaacgcaatctgttctgccgtgccagtagattgggttcctacctcccggacaacttggagtattcatgctcaccatcagtggatgaccacagaggacatgcttagcgtgtggaatagggtctggatcgaagagaacccctggatggaagataaaactcacatttcgtcctggggagacgtgccatatctgggcaagagagaggaccagtggtgcggctctctcatcgggttaaccgcccgcgcaacgtgggctacaaatatacaagttgccatcaaccaggtgcggaggctgattggaaatgagaactacttggattacatgacctcaatgaagcgatttaaaaatgaaagcgaccccgagggtgcgctgtggtga

SEQ ID NO: 13626 - RNA, 9879 nt, synthetic construct
  misc_feature 1..9879: note = derived and/or modified CDS sequence (opt3) from DENV-1__FJ432732__SS-prME
  source 1..9879: mol_type = other RNA
agcgtgaccatgctgctcatgcttatgcccacagccctggctttccacttgactacgagaggaggggaacctcatatgatcgtctccaagcaggaaagaggaaaatctttactgtttaagacctcagccggtgttaatatgtgcacactaattgccatggacctcggcgagctgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgtgatcggcacctcgattacgcagaagggcatcatattcatcctcttaatgctggtcactccatcaatggccatgcgctgcgtggggattggaagcagagattttgtagagggtcttagtggcgctacatgggttgacgtggtcttggagcacgggtcctgtgtgaccactatggccaaggataaacccacactggacatcgaactactcaagaccgaggtgacgaaccctgcggtcctgaggaaactttgcattgaagcaaagatctctaataccacaactgatagccggtgtccaacccaaggagaggccacactggttgaagaacaagacgctaacttcgtgtgccgccgaacttttgtagatagaggctggggtaatgggtgtggattgttcggcaaaggctccctcataacctgcgccaagtttaagtgcgtgacaaaactggaggggaagattgtccagtacgaaaacttaaaatattcagtgatcgttaccgtgcacactggagaccagcatcaagtcggtaatgagagtacggaacacggcacaaccgcaactattacaccccaagctcctaccaccgagatccagctgactgactacggggccctcacacttgattgtagcccaaggacgggactggacttcaacgaaatggtgttgctaaccatgaaggagaaatcttggctggtacataagcagtggtttctcgatctgccgcttccctggacttccggcgcgtcaacaagccaagagacctggaatcggcaggacctgttggttacattcaaaactgcccacgcaaagaagcaggaagtggtcgtgctcggtagtcaagagggggctatgcacaccgccctgacgggcgctaccgaaatccagacatctggaactaccacaatttttgccggccatttaaaatgccgtctgaagatggataaactaactctcaaggggatgtcctatgtcatgtgtaccgggagcttcaaactggagaaggaagtggcagagacgcagcacggtacagttcttgtgcagataaagtacgagggcaccgacgccccttgcaaaatcccattctcgactcaagatgaaaagggggtaacacagaacggacgcttgattaccgctaatcccatcgtcactgacaaagagaagcctgtgaacatagaagcggagccaccctttggcgagtcttatattaccatcggtgcaggggaaaaagccctgaagctctcctggttcaagaaaggctcaagtatcggaaagatgtttgaggctacagccagaggcgcaaggcggatggccattctgggggatacggcttgggacttcggaagcatcggtggcgtttttacctccgtggggaaacttgtccatcagattttcggaactgcctacggcgtgctgttttctggtgtaagctggacaatgaagatagggatcggcgtgttgctcacctggctgggattaaattcacgaagtacatccctgagcatgacttgtattgcagttggcctagtcaccctctacctgggggtgatggtgcaggcggattctggatgcgtcatcaactggaaaggccgcgaacttaagtgtggttcagggatcttcgttacgaatgaggtgcacacatggaccgaacaatataagtttcaggctgacagtccgaaaagattgagcgccgcaattggaaaggcctgggaggagggcgtgtgcggtataaggtccgctactcggctggaaaacatcatgtggaaacagatttctaacgagctcaatcatatcctgttagaaaacgacatgaagttcaccgtagtcgtgggcgatgttgccgggatttttgcacagggcaagaagatgatccgccctcaacccatggagtacaaatattcgtggaaaagctggggcaaggctaagataatcggggccgacgtgcagaatacaactttcattatcgatggaccaaacacccctgaatgtcccgacgatcagagagcgtggaatatttgggaggtcgaggactacggctttggtatcttcacaacgaacatatggctgaaacttagggattcctatacccaggtgtgcgaccaccgtttgatgtcagccgctattaaagatagtaaggcagttcacgccgacatggggtactggatcgaatctgagaaaaatgaaacttggaagctcgctcgggccagcttcattgaggtgaagacatgtatctggccaaaatcccataccctgtggtcaaacggagtactagaaagcgagatgataatccccaagatttatggcggtcctatctctcaacacaattaccgaccaggctactttactcagacagcagggccgtggcatctgggaaaactcgagctggatttcgacctttgcgaaggcaccacggtcgtggtggatgagcactgcgggaacagaggaccctccttgaggactaccacagtcaccggcaagattatccacgaatggtgttgccgcagttgtactctgcctccattacggtttagaggtgaggacgggtgctggtatggaatggagataaggcccgttaaagaaaaggaggaaaatctcgtgaagtccatggtatctgcgggctccggtgaggtggactcattcagtctgggccttctgtgtattagcatcatgatcgaagaggtcatgcgctcgcgatggtcccggaaaatgttgatgacagggaccctcgccgtgtttttcctgctaattatgggacagctgacatggaacgatctcatccgtctgtgcattatggttggcgctaatgcctctgacagaatggggatgggaactacctaccttgcattgatggctacgtttaagatgaggcctatgttcgccgtgggcctgttatttcgccggctcacaagcagagaggtcctgcttctgaccataggtctatcactcgtggcaagtgttgaactgccaaactccttggaggaactgggggatggattagccatgggcatcatgattctcaaactgcttactgacttccaatctcatcagctgtgggctaccttgctcagcctgacatttatcaagactaccttctccctacactatgcgtggaaaacgatggccatggtgctgtcaattgtcagcctttttcccctctgtctgagtacaacctctcagaagactacatggttgccggtactgttaggctccctcgggtgcaagcctctgaccatgttccttatcgcagagaataaaatatggggaaggcgaagctggccactgaacgaaggtatcatggctgtgggcattgtttcgatcttgctctcatctctgctaaagaacgatgtgcccctggccgggcctcttattgccggaggcatgctcatcgcttgttacgtcataagtggttccagcgcagacctgtctttggagaaagccgcggaggtgagctgggaagaggaagctgagcattccggggcctcacacaatattttagtagaagtgcaggatgacggaactatgaagatcaaagatgaggagcgcgacgatacactgaccatcctcctgaaggcaacgcttctggccgtcagtggcgtttatcccttgagcattccagctactctattcgtgtggtacttttggcagaagaagaagcagcggtctggcgtgctgtgggacaccccttcacccccagaagtcgagagagcagtgctcgatgacgggatatataggatcatgcagcgtggactgcttggtcgcagccaggttggcgtaggggtgttccaagaaaacgtctttcatacaatgtggcacgtgacccggggagccgttttaatgtaccagggcaaaagactggagccgagttgggcgagcgtgaagaaagacctcatttcctacggtgggggatggaggttgcagggctcttggaatacaggcgaggaagtccaggtgatcgctgtagagcctgggaagaaccccaaaaatgtccaaactgccccaggaaccttcaagacgcccgaaggtgaggtgggcgcaattgccctggattttaagcctgggacatcgggaagcccaatcgttaaccgagaaggcaaaatagtgggtctctatgggaatggagtcgtgactacctcaggcacatacgtttccgctatcgcccaggcaaaggctagtcaggagggccccctgcctgagattgaagacgaggtgttccggaaacgcaaccttaccatcatggatctgcacccggggtctggaaagactagaaggtatttgccagccattgtccgggaagcgatcaaacgaaagctaagaaccctgatactcgcccccacacgcgtggtagcaagcgagatggctgaagccttaaagggtatgcctattaggtaccaaacgactgctgtgaaatccgagcataccggcaaggagatcgttgacctgatgtgccacgcaacatttaccatgcgtcttctgtcaccagtccgggtgcccaattataacatgatcattatggatgaagcccatttcactgacccttctagcatcgccgctagagggtacataagtacaagggtgggaatgggcgaggcggcagccatttttatgaccgctacgccgcccggttccgtcgaagccttcccacagagcaatgcagtaatccaggatgaggaacgcgacattcctgagcgatcttggaactcagggtatgagtggatcactgattttcccggaaaaacagtgtggttcgttccatccataaagagtggcaatgacattgccaactgtctcaggaaaaatggcaagcgggtgatccagttgagcaggaagaccttcgataccgaataccagaaaactaagaacaacgactgggactacgtcgtgacaaccgatatctcggagatgggggctaattttcgcgcggaccgtgttattgatcctagacggtgcctgaaacccgtgatcctcaaggacggaccagaaagggtcattctggccggtccgatgcctgtgacagtagcatctgctgcccagcgccgaggcagaatagggcggaaccacaataaagagggagatcagtatatctacatgggccagccccttaacaatgacgaggatcatgcacactggactgaagccaagatgctactggacaacattaatacgccagagggtatcatccccgctttgttcgaacctgagagggaaaagtccgccgcgattgatggggagtatcgcttaagaggcgaggcaaggaaaacctttgtggaactgatgcggcgtggagacctcccagtttggctgagctacaaggtcgcctcagagggcttccaatatagtgatcgccgatggtgctttgacggggaaagaaacaatcaggtgcttgaggaaaacatggatgtggagatatggacaaaagagggagaaaggaagaaactgcggccccgctggctcgacgctagaacttactctgaccctttggccctgagggagttcaaggaatttgctgcaggtcggcgatccgtcagcggcgatctaatcctggagattgggaaactcccgcagcaccttacccagagagcccaaaatgctctggacaacttagttatgttgcataattcagaacagggaggccgcgcctataggcacgcaatggaggagctgccagatacaatcgaaaccctcatgctgcttgcgctgattgccgtgctcactggtggggtaacgttgttctttctgagtggccggggattaggcaagaccagcatcgggctactgtgtgtgatggcttcctctgtcctcctttggatggccagcgtggagccccattggatagcagcttccatcattctggagttctttttgatggttctgctcatccctgagcccgaccgtcagagaacaccacaggataaccaactggcctacgtggtcattggacttctcttcatgatcctgactgtagcagccaatgagatgggtttgctggaaaccacaaagaaagacttaggcatagggcacgtggctgttgagaaccaccatcacgcggccatgctagatgtggacctgcatcctgcatcagcttggaccctctacgccgtcgccactacaattatcacgcccatgatgaggcacaccattgaaaacactacagcaaatatctctcttaccgctatagccaaccaggcggctatcctgatgggattggataagggctggccaattagtaaaatggacatcggtgtgcctctgctcgccctggggtgctattcgcaggtcaatccgcttaccttaacagcagccgtgctgatgctcgttgctcattacgcaattatcggccccggattgcaagccaaggcgactcgcgaggctcagaaacggacggccgcaggcataatgaagaacccaaccgtggatgggattgtagccatcgacctggatcctgtggtctatgacgctaagtttgaaaaacagctaggacagatcatgctgctcattctttgtacaagccaaatcctgttgatgcgaactacctgggccctgtgcgagtccataacactcgcaaccggccccctgactacgttatgggagggttctccagggaagttctggaatacaaccattgctgtttcaatggccaacatcttcagaggaagctaccttgcgggcgccggtctggcattttccctcatgaaaagtctaggcgggggaaggcgcggcactggggctcagggagaaaccctgggcgagaagtggaaacggcagttgaatcagctgtctaagagcgagttcaacacatataagagatcaggtattatggaggtggaccgttccgaagccaaagaggggctcaagaggggagagactaccaaacacgcagtcagtcggggcacagctaaacttcgctggtttgtggaacgaaatctggtaaaacctgagggtaaggtgatcgatttgggctgtgggagaggaggctggagctactattgcgccgggctgaagaaagttacggaagtgaagggatacaccaaaggcggtcccgggcacgaggaaccgataccaatggccacttacggatggaacctcgtcaagttacattctggcaaagacgtgttctttatccctcccgagaagtgtgatacactgctttgcgacattggcgagtcctcaccaaatcccaccatcgaagaggggaggactctgcgggtcctaaaaatggtggaaccttggctccgcggaaaccaattctgtattaagatcctgaatccgtatatgcccagcgttgtagagacattggagcagatgcagagaaagcacggtggcatgctggtgaggaacccactctcgcgaaattctacccatgaaatgtactgggtcagttgcgggacgggaaacattgtgtccgcggttaatatgaccagccggatgcttctgaaccgttttacaatggctcacagaaaacctacttatgagcgcgatgtggacttaggcgcaggtaccaggcacgtcgccgtggaacccgaggtagctaacctggatatcatagggcagcggattgaaaatatcaagcatgagcacaaatcaacatggcattacgacgaggataacccttataagacttgggcctaccacggatcctatgaagtgaaaccatctggcagcgcaagttccatggttaatggcgtcgtgaagttgctcaccaagccctgggacgtgatccctatggtcacacaaattgccatgaccgatactacgccattcgggcagcagagagtttttaaagagaaggtggacacacgcacccccaaagctaagaggggaactgcgcaaataatggaagtaaccgccaaatggctgtggggtttcctaagccgaaacaagaagccgcggatctgtacaagagaggaatttacgaggaaagtgcgctctaatgcagctattggcgccgtcttcgtggacgagaaccagtggaactcagcaaaggaggccgttgaagatgagcgtttttgggaccttgtgcatcgggaaagagagctgcacaaacaggggaagtgcgctacctgcgtctacaacatgatgggaaaaagggaaaagaagctcggcgagttcggtaaagccaaggggagtcgcgcgatctggtacatgtggctgggagcacgattcttggagtttgaagccctgggcttcatgaatgaggatcactggttttcccgggaaaacagcctctctggcgtggagggggagggacttcataaactgggttatattttaagagacatctcgaagatacctggcgggaatatgtacgctgatgacactgccggatgggatacaaggatcaccgaagacgatctgcagaacgaggcacgcattactgacatcatggaaccagagcacgctttgctcgccaaatcaattttcaagctgacatatcaaaataaagtagttagagtgcagcggcccgctaagaacggcaccgtcatggatgtgatcagcaggcgtgaccagcgaggttccggacaggtgggaacatacggcctaaatacttttaccaacatggaagcccaacttatacgccagatggagagtgagggcattttctctcctagcgaactggagacgccaaacctcgcagaaagagtcctggattggttggagaagtatggggttgaacggttaaaaaggatggcgatctccggagacgactgtgtggtaaagcccatcgatgaccgctttgccaccgctctgacagccctcaatgatatgggtaaagtgagaaaggacattccgcagtgggagccttcaaaaggctggaacgattggcagcaagtccccttctgcagtcatcactttcaccagcttataatgaaggacgggcgggagatcgtggttccatgtaggaatcaggatgaactggtgggacgagcacgtgtctctcagggcgctggttggagcctaagagagactgcctgcctggggaagtcctacgcacaaatgtggcagctcatgtatttccatcgccgggacttgaggctggccgcgaacgctatttgttcagccgtgcctgtagattggatccccaccagcagaacaacttggtctattcacgcacatcaccagtggatgaccacggaagacatgctttccgtttggaatcgcgtgtggatcgaggaaaacccatggatggaggataaaacacatataagtagctggggagacgtcccctacctgggcaagcgggaggaccaatggtgcggctcgctcatcgggttaaccgccagggctacttgggccacaaatattcaggtggcaatcaaccaggttcgaagactgattggaaatgaaaactacttggattatatgacctccatgaaacggtttaagaatgagtctgaccctgaaggtgctctgtggtga

SEQ ID NO: 13627 - RNA, 9879 nt, synthetic construct
  misc_feature 1..9879: note = derived and/or modified CDS sequence (opt3) from DENV-1__FJ432733__SS-prME
  source 1..9879: mol_type = other RNA
agcgtgaccatgctgctcatgcttatgcccacagccctggctttccacttgactacgaggggaggggagcctcatatgatcgtcaccaagcaggaaaggggaaaatccttactgtttaagacatctgccggtgttaatatgtgcactctaattgccatggacctcggcgagctgtgtgaagataccatgacatacaaatgcccacggataaccgaggtggaaccggacgatgtagactgttggtgcaatgcgactgatacatgggtgacctatgggacgtgttcacagactggagagcaccgccgagacaagcgtagtgtcgctcttgcaccccatgtgggcctgggtttggagaccagaacagaaacttggatgagctccgagggggcatggaaacagatccagagggttgaaacctgggccctccggcaccctggattcacagtgattgctctgtttctggcccatgtcatcggcacctctattacgcagaagggcatcatattcatcctcttaatgctggtgactccatcgatggccatgcgctgcgtagggattggatcaagagattttgttgagggtcttagcggcgctacatgggtggacgtcgtgttggagcacgggagttgtgtgaccactatggccaaggataaacccacactggacatcgaactactcaagaccgaggtcacgaaccctgcggttctgaggaaactttgcattgaagcaaagatctccaataccacaactgattctcggtgtccaacccaaggagaggccacactgatggaagaacaagacgctaacttcgtgtgccgccgaacttttgtagatagaggctggggtaatgggtgtggattgttcggcaaaggcagcctcataacctgcgccaagtttaagtgcgtgacaaaactggaggggaagattgtccagtacgaaaacttaaaatattccgtgatcgttaccgtgcacactggagaccagcatcaagtcggtaatgagtcaacggaacacggcacaattgcaaccatcactccccaggctcctaccagtgagatccagctgacagactacggggccctcacccttgattgtagcccaaggactggactggacttcaacgaaatggtgttgctaacaatgaaggagaaatcttggctggtacataagcagtggtttctcgatctgccgcttccctggacgtccggcgcgtcaaccagccaagagacttggaatcggcaggacctgttggttacattcaaaaccgcccacgcaaagaagcaggaagtggtcgtgctcggtagtcaagagggggctatgcacacagccctgactggcgctaccgaaattcagacgtctggaaccacaactatatttgccggccatttaaaatgccgtctgaagatggataaactaaccctcaaggggatgtcctatgtcatgtgtacaggatcgttcaaactggagaaggaagtggcagagactcagcacggtaccgttcttgtgcagatcaagtacgagggcacggacgccccttgcaaaattccattctcgacacaagatgaaaagggggtaacccagaacggacgcttgatcactgctaatcccatagtcacagacaaagagaagcctgtgaacattgaagcggagccaccctttggcgagtcttatatcgttatcggtgcaggggaaaaagccctgaagctctcctggttcaagaaaggctcaagtattggaaagatgtttgaggctaccgccagaggcgcaaggcggatggccatcctgggggatactgcttgggacttcggaagcattggtggcgtgtttacctccgtcgggaaacttgtgcatcagatattcggaacagcctacggcgtactgttttctggtgtgagctggacgatgaagatcgggattggcgttttgctcacctggctgggattaaattcacgaagtacttccctgagcatgacatgtatcgcagtcggcctagtgaccctctacctgggggtgatggtccaggcggattctggatgcgttatcaactggaaaggccgcgaacttaagtgtggttcagggattttcgtgacaaatgaggtgcacacttggaccgaacaatataagtttcaggctgacagtccgaaaagattgagcgccgcaataggaaaggcctgggaggagggcgtatgcggtatcaggtccgctacgcggctggaaaacattatgtggaaacagatctctaacgagctcaatcatattctgttagaaaacgacatgaagttcacagtcgtggttggcgatgtggtcgggatcctggcccagggcaagaagatgatacgccctcaacccatggagcacaaatactcgtggaaaagctggggcaaggcaaagatcattggggctgacgtgcagaataccacttttatcattgatggaccaaacacccctgaatgtcccgacgatcagagagcctggaatatctgggaggttgaggactatggcttcggtatatttacaactaacatttggcttaagttgagggattcccacacccaggtgtgcgaccatcgtctcatgtcagcggccatcaaagatagtaaggctgtacacgcagacatggggtactggattgaatctgagaaaaatgaaacatggaagctggcccgggctagcttcatcgaggtcaagacgtgtatatggccaaaatcccataccctatggtcaaacggagtgctggaaagcgagatgatcattcccaagatctatggcggtcctatttctcaacacaattaccgaccaggctatttcactcagacagccgggccgtggcacctcggaaaactggagcttgattttgacttgtgcgaaggcaccactgtggtcgttgatgagcattgcgggaacagaggaccctccctgaggacaaccacggtgactggcaagatcatacacgaatggtgttgccgcagttgtaccttacctccactccggttcaaaggtgaggacgggtgctggtacggaatggagattagacccgtaaaggaaaaggaggaaaatctggtgaaaagcatggtctctgcaggctccggtgaggtggactcatttagtcttggcctgttgtgtatcagcatcatgattgaagaggttatgaggtcgcgctggtcccgaaagatgctcatgacagggaccctggcggtgttcctactgctcatcatgggacagctgacttggaacgatcttattcggttgtgcataatggtcggcgccaatgcttctgaccgtatggggatgggaacaacctacctggccttaatggcaacatttaaaatgagacctatgttcgctgtgggcctcctgtttaggcgccttactagccgggaggttctgctactcaccatcggtctgtcattggtggccagtgtcgaactgccaaactccttagaggaactcggggatggactggcaatgggcattatgatccttaagctgttgacggacttccaatctcatcagctctgggccacactgctaagcctgacctttattaaaactaccctttccctccactatgcttggaagacaatggcgatggtactgtcaatcgtgagcttgttccccctgtgtttaagtactacctctcagaagacgacatggctcccggttctgcttggctccctggggtgcaaacctttggccatgctcctgatagcagagaataagatctggggaagaaaaagctggccactaaacgaaggtattatggctgtgggcgtcgtgtcgatcctgctttcatctctcctgaagaacgatgtacccttggccgggcctttaattgccggaggcatgctgatcgcttgttacgtgataagtggttccagcgcagacctctctctggagaaagccgcggaggtcagctgggaagaggaagctgagcattccggggcctcacacaatattcttgttgaagtgcaggatgacggaaccatgaagatcaaagatgaggagagggacgatactctgacaatcttgctaaaggcaaccctgctcgccgtgagtggcgtctatcccctgagcattccagctactctttttgtgtggtacttctggcaaaagaaaaagcagcgatctggcgttttatgggacacaccttcacccccagaagtagagcgcgcagtgctggatgacgggatatatcggatcatgcagagaggactcttgggtaggagccaggtcggcgtgggggtttttcaagaaaacgtgttccacaccatgtggcatgtcacgcgtggagccgtgctgatgtaccagggcaaacgcctcgagccgagttgggcgagcgtaaagaaagacctgatttcctatggtgggggatggcggcttcagggctcttggaatactggcgaggaagtccaggtgatcgctgttgagcctgggaagaaccccaagaatgtgcaaaccgccccaggaacattcaaaacccccgaaggtgaggtcggcgcaattgccctggattttaagcctgggacatcgggaagcccaatcgtgaacagagaaggcaaaatagttggtttgtacgggaatggagtggtcactacctcaggcacgtacgtgtccgctatcgcccaggcaaaggctagtcaggagggccccctacctgagattgaagacgaggtattcaggaaacgaaacctgacaatcatggatctccacccggggtctggaaagactcggcgctatttaccagccattgtgagagaagcgatcaagaggaaactgcggacccttatactggcccccacacgagttgtcgcaagcgagatggctgaagccctcaagggtatgcctattagataccaaaccactgctgtgaaatccgagcataccggcaaggagatcgtggacttgatgtgccacgcaacatttacgatgcgcctgctctcaccagtcagggtacccaattataacatgatcattatggatgaagcccatttcactgacccttctagcatcgccgctcgtgggtacataagtacccgggtgggaatgggcgaggcggcagccatttttatgacagctaccccgcccggttccgttgaagccttcccacagagcaatgcagtgatccaggatgaggaaagagacattcctgagaggtcttggaactcagggtatgagtggatcactgattttcccggaaaaacagtctggttcgtgccatccataaagagtggcaatgacattgccaactgtctgcgcaagaatggcaaacgagttatccagcttagcagaaagacctttgatacggaataccagaaaactaagaacaacgactgggactatgtggtcacaaccgatatctcggagatgggggctaatttccgggcggacagggtgattgatcctcgccgttgcctaaaacccgtaatcctgaaggacggaccagaaagagtgattttggccggtccgatgcctgttaccgtcgcatctgctgcccagcggaggggccgcatagggcgaaaccacaataaggagggagatcagtacatctacatgggccagcccttaaacaatgacgaggatcacgcacattggactgaagccaaaatgctgctcgacaacattaatacaccagagggtatcatccccgctctgtttgaacctgagagagaaaagtccgccgcgattgatggggagtatcggcttaggggcgaggcacgcaaaaccttcgtggaactgatgagaaggggagacctcccagtgtggttgagctacaaggtcgcctcagagggcttccaatatagtgatcggcgttggtgctttgacggggaacgcaacaatcaggttctggaggaaaacatggatgtggagatatggacaaaagagggagaacgaaagaaactaagacccaggtggctggacgctcggacttactctgaccctctcgcccttcgcgagttcaaggaatttgctgcaggtagaaggtccgtaagcggcgatctgatcttagagattgggaagttgccgcagcacctgacgcagcgggcccaaaatgctctcgacaacctggtgatgcttcataattcagaacagggaggccgagcctatagacacgcaatggaggagctgccagataccatcgaaacactcatgttgctggcgttaattgccgtcctaactggtggggtgaccctgttctttctcagtggccgcggacttggcaaaacaagcatcgggctgttgtgtgttatggcttcctctgtgctgctctggatggccagcgtcgagccccactggatagcagcttccatcattctggagttctttcttatggtactcctgatccctgagcccgacaggcagcggaccccacaggataaccaattggcctacgtggttattggactgttattcatgatcctaactgtggcagccaatgagatgggtctgctcgaaacgaccaagaaagaccttggcatagggcatgtcgctgtggagaaccaccatcacgcgacaatgctggatgtcgacttgcatcctgcctcagcatggactctgtatgctgtggccaccacaattatcacccccatgatgcgtcacactattgaaaacacaacggccaatatctctctcaccgcaatagctaaccaggccgcgatcctgatgggacttgataagggctggccaattagtaaaatggacatcggtgttcctttactggctctcgggtgctacagccaggtgaatccgttgactctgacagccgcagtactaatgctggtggcccactacgctattatcggccccggactccaagcaaaggccaccagagaggcgcagaagaggaccgctgccggcataatgaaaaacccaacagtcgatgggattgttgcaatcgaccttgatcctgtggtctatgacgccaagtttgaaaaacagctgggacagatcatgttgctgattctctgtactagccaaatcctgttaatgcgcacgacctgggctctttgcgagtccataacactggccactggccccctcaccacactatgggagggttctccagggaagttctggaataccactattgcagtgtcaatggctaacatctttcggggaagctacctggccggcgcgggtttggccttctccctgatgaaaagtctcggcgggggacgaagaggcacgggggcacagggagaaacacttggcgagaagtggaagaggcagctgaatcagttgtctaaaagcgaatttaacatttataagcgctcaggtatcatggaggtagaccggtccgaagctaaagaggggctgaagagaggagagaccactcgtcatgccgtgagtaggggcaccgcaaaactccggtggttcgttgaacgcaatttagtgaagcctgagggtaaggtcatagatctgggctgtgggcgaggaggctggagctactattgcgctgggcttaaaaaggtgacagaagtcaaaggatacactaagggcggtcccgggcacgaggaaccgatcccaatggccacctatggatggaacctggtgaaactacattctggcaaggacgttttctttacacctcccgagaaatgtgatacgctcctgtgcgacattggcgagtcctcaccaaatcccaccatcgaagaggggagaactttgagggtactgaagatggtggaaccttggctccggggaaaccaattctgtattaagatccttaatccgtacatgcccagcgtcgtggagacactggagcagatgcagcgcaaacacggtggcatgttagttagaaacccactgtcgagaaattctacccacgaaatgtactgggtgagttgcgggactggaaacattgtctccgccgtgaatatgacaagccgaatgttgctcaaccggtttaccatggcgcatcgtaagcctacgtatgagagagatgtagacctgggcgctggtacccgccacgtggcagttgaacccgaggtcgccaacctagatatcatagggcagaggattgaaaatatcaaacatgagcacaagtcaacatggcattacgacgaggataacccttataaaacttgggcttaccacggatcctatgaagtgaagccatctggcagcgccagttccatggtgaatggcgtcgttaaacttctgaccaaaccctgggacgtgatccctatggtaacacaaattgcaatgactgataccacaccattcgggcagcagcgggtgtttaaggagaaagtcgacaccagaactcccaaggccaaacgcggaacggctcaaataatggaagtgacagcgaggtggctctggggtttcctgagccgaaacaagaagccgcggatctgtaccagagaggaatttactaggaaagttcgctctaatgccgcaattggcgctgtgttcgtcgacgagaaccagtggaactcagccaaggaggcagtggaagatgagcgtttttgggacttggtacagaaagaacgggagctgcacaagcaggggaaatgcgcaacctgcgtttacaacatgatgggaaagagagaaaagaaactcggcgagttcggtaaggctaaagggagtagggccatctggtatatgtggcttggagcgcgctttctggagttcgaagcattaggctttatgaatgaggatcattggttctcccgagaaaacagcctgtctggcgtggagggggagggattgcacaagctcggttacattctgcgggacatctcgaaaatacctggcgggaatatgtacgccgatgacacagctggatgggatacgagaatcaccgaagacgatctacaaaacgaggccaggattactgacatcatggaaccagagcatgcacttctggctacatcaattttcaagctcacctatcagaataaagtcgtgcgcgtgcagagacccgccaagaacggcactgtcatggatgttatcagccggagggaccagcgtggttccgggcaagtgggaacatacggcctgaatacctttacaaacatggaagctcagttgatacgacagatggagagtgagggcattttcttaccttctgaactggagactcagaacctcgccgaacgcgtacttgattggctggagaagtatggggtggaaagactaaaacggatggcaatcagcggagacgactgtgtcgtgaagccaatcgatgacaggtttgcgaccgccctgacggctctcaatgatatgggtaaagttcgcaaggacattccccaatgggagccgtccaaaggctggaacgattggcaacaggtgcctttctgctcacaccactttcatcagttgataatgaaggacgggagagagatcgtcgtgccctgtcggaatcaagatgaactggtaggaagggcccgagttagtcagggcgcaggttggtctcttcgtgagaccgcttgcctggggaagtcctacgcccagatgtggcaactcatgtatttccacagacgcgacttacggctggcagccaacgcgatttgttccgctgtgccagtcgattgggtgcctacatcaaggactacctggagcatccatgcccaccatcagtggatgacaactgaagacatgttgtctgtttggaatagagtgtggattgaggaaaacccctggatggaggataaaacccacgtctccagttggggagacgtgccatacctgggcaagcgcgaggaccagtggtgcggcagcctcatcgggcttacggcacgggccacatgggcttcgaatatacaggtagccatcaaccaagtgaggcgactgattggaaatgaaaactatctagattacatgacctccatgaaaagatttaagaatgagggtgaccccgaaggcgcactgtggtga

SEQ ID NO: 13628 - RNA, 9879 nt, synthetic construct
  misc_feature 1..9879: note = derived and/or modified CDS sequence (opt3) from DENV-1__FJ410196__SS-prME
  source 1..9879: mol_type = other RNA
agcgtgaccatgctgctcatgcttatgcccaccgcactggctttccacttgactacgcggggaggggaacctcatatgatcgtctccaagcaggaaaggggaaaatctttactgtttaagacctcagccggtgttaacatgtgcacgctaattgccatggacctcggcgaactgtgtgaagatactatgacctacaaatgcccacggataacagagaccgaaccggacgatgtggactgttggtgcaatgcgactgatacatgggtgacctatgggacgtgtagtcagactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagggattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaggacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaggcccctacaaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccgggagcttcaaactggagaaggaagtcgccgagacgcagcacggtacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattgtgatcggtgccggggaaaaagctctgaagctctcctggttcaagaaaggctcaagtatcggaaagatgtttgaggccaccgcaagaggcgccaggcggatggctattctgggggatacagcctgggacttcggaagcatcggtggcgtttttacgtccgtggggaaacttgtccatcagattttcggaaccgcatacggcgtgctgttttctggtgtaagctggactatgaagatagggatcggcgtgttgctcacatggctgggattaaattcacgaagtacctccctgagcatgacatgtattgcggttggcctagtcactctctacctgggggtgatggtgcaggctgattctggatgcgtcatcaactggaaaggccgcgaacttaagtgtggttcagggatcttcgttaccaatgaggtgcacacgtggacagaacaatataagtttcaggccgacagtccgaaaagattgagcgcagccattggaaaggcttgggaggagggcgtgtgcggtataaggtccgccacccggctggaaaacatcatgtggaaacagatttctaacgagctcaatcatatcctgttagaaaacgacatgaagttcactgtagtcgtgggcgatgttgcagggattctggctcagggcaagaagatgatccgccctcaacccatggagtacaaatattcgtggaaaagctggggcaaggccaagataatcggggcggacgtgcagaataccacatttattatcgatggaccaaacactcctgaatgtcccgacgatcagagagcctggaatatttgggaggtcgaggactacggcttcggtatctttaccacaaacatatggcttaagttgagggattcctatacacaggtgtgcgaccaccgtctcatgtcagctgcaattaaagatagtaaggccgttcacgctgacatggggtactggatcgaatctgagaaaaatgaaacctggaagctggcccgggcatccttcattgaggtgaagacttgtatctggccaaaatcccatacactatggtcaaacggagtactggaaagcgagatgataatccccaagatttatggcggtcctatctctcaacacaattaccgaccaggctacttcacccaggcggccgggccgtggcatctcggaaaactggagcttgattttgacttgtgcgaaggcactacagtcgtggtggatgagcactgcgggaacagaggaccctccctgaggaccacgactgtcaccggcaagattatccacgaatggtgttgccgcagttgtacattacctccactccggttcagaggtgaggacgggtgctggtatggaatggagataaggcccgttaaagaaaaggaggaaaatctggtaaagagcatggtatctgctggctccggtgaggtggactcatttagtcttggcctgttgtgtattagcatcatgatcgaagaggtcatgcgctcgcgatggtcccggcgtatgctcatgaccgggactctggccgtgttctttctactgattatgggacagctcacatggaacgatctgatcagactttgcattatggttggcgcaaatgcttctgacaggatggggatgggaaccacatacttggccctgatggcaactttcaaaatgcgccctatgtttgccgtgggcttactcttccggagactgaccagcagggaggtccttctgctaacgataggtctctcactggtggctagtgttgaattgccaaactccctggaggaattaggggatggactcgcgatgggcatcatgattctgaaacttctgacagactttcaatctcatcagttgtgggccaccctcctgagcctaactttcatcaaaaccacattttccctgcactatgcatggaagactatggctatggtgctttcaattgtcagcctcttccccctgtgtttgagtaccacgtctcagaaaacaacctggctgccggtattactcggctccctggggtgcaagcctcttactatgtttctgatcgccgagaataagatatggggacgacgcagctggccattgaacgaaggtatcatggccgtgggcattgtttcgatcctcctgtcatctctactgaaaaacgatgtgccccttgctgggcctctcattgcaggaggcatgctgatcgcctgttacgtcataagtggttccagcgcggacttgtctttagagaaggctgccgaggtgagctgggaagaggaagcagagcattccggggcctcacacaatattctggtagaagtgcaggatgacggaacaatgaaaatcaaggatgaggagcgggacgataccctcactatcctgcttaaagctacactgttggcagtcagtggcgtttatcccctaagcattccagccaccctgttcgtgtggtacttctggcaaaagaaaaagcagagatctggcgtgctctgggacacgccttcacccccagaagtcgagagggcggtgctggatgacgggatatatcgtatcatgcagcgcggacttttaggtcggagccaggttggcgtaggggtgtttcaagaaaacgtcttccatactatgtggcacgtgaccagaggagctgttctgatgtaccagggcaagaggctcgagccgagttgggccagcgtgaaaaaggacttgatttcctacggtgggggatggcgactgcagggctcttggaatacaggcgaggaagtccaggtgatcgcagtagagcctgggaaaaaccccaagaatgtccaaaccgccccaggaacatttaaaactcccgaaggtgaggtgggcgctattgccctcgatttcaagcctgggacctcgggaagcccaatcgttaaccgggaaggcaagatagtgggtctgtatgggaatggagtcgtgacgacatcaggcacttacgtttccgcaatcgctcaggccaaagcgagtcaggagggcccccttcctgagattgaagacgaggtgtttcgcaagagaaacctgaccatcatggatttgcacccggggtctggaaaaacaaggcggtatctaccagccattgtccgagaagcaatcaagagaaaactgcgcaccctcatattagctcccactagggtggtagccagcgagatggctgaagcactgaagggtatgcctattcgttaccaaaccacagccgtgaagtccgagcatacgggcaaagagatcgttgaccttatgtgccacgccactttcaccatgcggctgctctcaccagtcagagtgcccaattataacatgatcattatggatgaagctcattttacagaccctttctctatcgcggcaagggggtacataagcacccgcgtgggaatgggcgaggccgctgccatttttatgactgcaacaccgcccggtagtgtcgaagccttcccacagtccaatgctgtaatccaggatgaggaacgagacattcctgagagaagctggaactctgggtatgagtggatcaccgattttcccggaaagacggtgtggttcgttccatcaataaaatccggcaatgacattgcgaactgtttgcggaagaatggcaaaagggtgatccagctgagtcgcaagactttcgatacagaataccaaaagaccaaaaacaacgactgggactacgtcgtgaccactgatatcagcgagatgggggccaattttcgtgcagacagagttattgatcctcggaggtgcctcaagcccgtgatcctgaaagacggaccagaacgcgtcattcttgctggtccgatgcctgtgacagtagcctcggcagcccagcgaagaggccggatagggaggaaccacaataaggagggagatcagtatatctacatgggccagcccctaaacaatgacgaggatcatgctcactggaccgaagccaaaatgctgttggacaacattaatacaccagagggtatcatccccgcgttattcgaacctgagcgcgaaaagtctgcagccattgatggggagtatagactgaggggcgaggctcggaagacttttgtggaactcatgcgtcgcggagacctgccagtttggctttcctacaaagtcgccagcgagggcttccaatattcagatcgaagatggtgctttgacggggaaaggaacaatcaggtgctggaggaaaacatggatgtggagatatggacgaaggagggagaacggaaaaagctccgccccagatggttggacgctaggacctacagtgaccctctggcactacgggagttcaaagaatttgccgctggtcgaagatctgtctccagcgatctgatcctcgagattggcaaacttccgcagcacctgacacagcgcgcccaaaatgcattagacaacttggttatgctgcataattcagaacaagggggaagggcgtatcggcacgccatggaggagctcccagatactatcgaaaccctgatgcttctggctctcattgccgtgttgacaggcggtgtaaccctgttctttttaagtgggcgtggcctaggaaaaactagcatcggcctgctctgtgtgatggcatcctctgtccttctgtggatggctagcgtggagccccattggatagccgcatccatcattttggagttctttctgatggttctcctgatccctgagcccgacagacagaggacgccacaggataaccaacttgcctacgtggtcattgggctcctgttcatgatcttgaccgtagctgcgaatgagatgggactgttagaaacaactaagaaggacctaggtataggccacgtggccgttgagaaccaccatcacgcagctatgctggatgtggacctccatcctgcctcagcctggaccctttacgcagtcgctacaaccattatcactcccatgatgcgccacacaattgaaaacacgaccgccaatatctctctgactgcgatagctaaccaggccgcaatcttgatggggctggataaaggatggccaattagtaagatggacatcggcgtgcctctcctggcccttggttgctattcgcaggtcaatccgttaacactgaccgctgcagtgctcatgttggttgcccattacgcgattatcgggcccggcctgcaagctaaagccacccgggaggcacagaagcgaacagccgctggaataatgaaaaacccaactgtggatggcattgtagccatcgacctagatcctgtggtctatgacgcaaagtttgaaaagcagctggggcagatcatgctccttattctgtgtacgagccaaatcttgctgatgagaaccacatgggctctctgcgagtccataactctggccaccggacccttaacaaccctttgggagggctctccaggtaaattctggaatactacgattgcggtttcaatggccaacatcttcagggggagctacctggcaggagctggcctcgccttttccctaatgaagagtctgggtggcgggcgccggggaacaggcgcacagggggaaaccttgggagagaaatggaagagacagctgaatcagctctctaaaagcgagttcaacacttataagcgttcaggcattatggaggtggacaggtccgaagctaaggagggtcttaaacgcggggaaaccacaaagcacgccgtcagtcggggaactgccaaactgcgatggtttgtggaaagaaatttggtaaagcctgagggcaaagtgatcgatctgggttgtggcagagggggatggagctactattgcgcgggcctcaagaaggttaccgaagtgaaagggtacacaaagggaggccccggtcacgaggaaccgataccaatggctacgtacgggtggaacttagtcaaactgcattctggaaaggacgtgttctttatccctcccgagaaatgtgatacccttctgtgcgacattggcgagtcctcaccaaatcccactatcgaagagggccggacactacgcgtcctcaagatggtggaaccttggctgagagggaaccaattctgtattaaaatcttgaatccgtatatgcccagcgttgtagagaccctggagcagatgcagaggaagcacggaggtatgctcgtgcgaaacccactttcgagaaattctactcatgaaatgtactgggtcagttgcggcacagggaacattgtgtccgcagttaatatgaccagccgtatgctgttaaacagatttacgatggcccaccgcaagcctacctatgagagggatgtggacctgggagctggcacacggcacgtcgccgtggaacccgaggtagcaaacttggatatcataggtcagagaattgaaaatatcaaacatgagcacaagtcaacttggcattacgacgaggataacccttataaaacctgggcctaccacgggtcctatgaagtgaagccatctggaagcgctagttccatggttaatggcgtcgtgaaactcctgacaaagccctgggacgtgatccctatggtcactcaaattgcgatgaccgatacaaccccattcggccagcagcgcgtttttaaggagaaagtggacactaggacgcccaaggccaaacgagggacagcacaaataatggaagtaaccgctaagtggctatggggattccttagccggaacaaaaagccgagaatctgtactagggaggaatttacccgcaaggtgcgttctaatgccgcaattggtgccgtcttcgtggacgagaaccagtggaactcagctaaagaggccgttgaagatgagcggttttgggacctggtgcatagagaaagggagctccacaagcagggcaaatgcgcgacatgcgtctacaacatgatggggaagcgcgagaagaagctgggagagttcggcaaggcaaaaggtagtcgagccatctggtacatgtggttgggggctcggttcctggagtttgaagccctcggattcatgaatgaggatcactggttttccagagaaaacagcctttctggcgtggagggcgaggggctgcataagttaggatatattctgaggggtatctcgaaaatacctggcgggaatatgtacgcagacgatacggctggatgggacacccgcatcactgaagatgacttgcagaacgaggccagaattacagatatcatggaaccagagcacgctctcctggccaagtcaattttcaaactaacctatcaaaataaggtagttcgggtgcagaggcccgccaaaaatggcactgtcatggacgtgatcagccgtcgagatcagcgcggttccggacaggtgggaacatacggccttaatacctttacaaacatggaagcgcaactgataagacagatggagagtgagggcattttctctcctagcgaactcgagactccaaacctggccgaacgggtcttggactggttagagaagtatggggttgaaaggctgaagcgcatggctatctccggagatgactgtgtggtaaaacccatcgacgatagatttgccaccgcactcacggctcttaatgacatgggtaaggtgcggaaagatattccgcagtgggagccttcaaagggctggaacgactggcagcaagtccccttctgcagtcatcactttcaccagctgataatgaaagatgggagggagatcgtggttccatgtcgaaatcaggacgagctagtgggacgtgccagagtctctcagggcgcaggttggagcctgcgcgagaccgcctgcctcgggaagtcctacgcgcaaatgtggcagttgatgtatttccatcggagggatctgagacttgctgccaacgcaatttgttcagccgtgcctgtagactggatccccacaagccgcactacctggtctattcacgctcatcaccagtggatgacaactgaagatatgctgtccgtttggaatcgggtgtggatcgaggaaaacccatggatggaggacaagacccatataagtagctggggagatgtcccctacctcggcaaaagggaggaccaatggtgcggctcgttaatcgggctgacggcccgagcaacatgggctaccaatattcaggtggccatcaaccaggttagacggttgattggaaatgaaaactacctggactatatgacttccatgaagaggtttaaaaatgagtctgatcctgaaggtgcgctctggtga

SEQ ID NO: 13629 - RNA, 9879 nt, synthetic construct
  misc_feature 1..9879: note = derived and/or modified CDS sequence (opt3) from DENV-1__FJ432734__SS-prME
  source 1..9879: mol_type = other RNA
agcgtgaccatgctgctcatgcttatgcccacagcactggctttccacttgactacgaggggaggggaacctcatatgatcgtctccaagcaggaaaggggaaaatctttactgtttaagacctcagccggtgttaacatgtgcacattaattgccatggacctcggcgagctgtgtgaagatactatgacctacaaatgcccacggataacagaggcggaaccggacgatgtggactgttggtgcaatgctaccgatacttgggtgacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggttctccggcaccctggattcaccgtgattgctctgtttctggcacatgccatcggcacatcgattacccagaagggcatcatattcatcctcttaatgctggtcacgccatcaatggctatgcgctgcgtggggattggaagcagagattttgtagagggtcttagtggcgccacttgggttgacgtggtcttggagcacgggtcctgtgtgacaaccatggcgaaggataaacccactctggacatcgaattgctcaagacagaggtgaccaaccctgcagtcctgaggaaactttgcattgaagccaagatctctaatacgaccacagatagccggtgtccaactcaaggagaggctaccctggttgaagaacaggacgccaacttcgtgtgccgccgaacatttgtagatagaggctggggtaatgggtgtggattgttcggcaaaggctccctcataacttgcgcaaagtttaagtgcgtgaccaaactggaggggaagattgtccagtacgaaaacttaaaatattcagtgatcgttacagtgcacaccggagaccagcatcaagtcggtaatgagagtactgaacacggcacgacagctaccattactccccaggcccctaccacagagatccagctgaccgactacggggcgctcactcttgattgtagcccaaggacaggactggacttcaacgaaatggtgttgctaacgatgaaggagaaatcttggctggtacataagcagtggtttctcgatctgccgcttccctggacctccggcgcctcaactagccaagagacatggaatcggcaggacctgttggttaccttcaaaacagcacacgctaagaagcaggaagtggtcgtgctcggtagtcaagagggggccatgcacactgctctgaccggcgccacggaaatccagacctctggaacaactaccatttttgcaggccatttaaaatgccgtctgaagatggataaactaacactcaaggggatgtcctatgtcatgtgtactggatcgttcaaactggagaaggaagtggccgagacccagcacggtacggttcttgtgcagataaagtacgagggcacagacgctccttgcaaaatcccattctcgacccaagatgaaaagggggtaactcagaacggacgcttgattacagcgaatcccatcgtcaccgacaaagagaagcctgtgaacatagaagcagagccaccctttggcgagtcttatattgttatcggtgccggggaaaaagctctgaagctctcctggttcaagaaaggctcaagtatcggaaagatgtttgaggccactgcaagaggcgccaggcggatggctattctgggggataccgcctgggacttcggaagcatcggtggcgtgtttacatccgtcgggaaacttgtgcatcagattttcggaacggcatacggcgtactgttttctggtgtgagctggaccatgaagatagggatcggcgttttgctcacttggctgggattaaattcacgaagtacatccctgagcatgacctgtattgcggtcggcctagtgacactctacctgggggtgatggtccaggctgattctggatgcgttatcaactggaaaggccgcgaacttaagtgtggttcagggatcttcgtgactaatgaggtgcacacctggacggaacaatataagtttcaggccgacagtccgaaaagattgagcgcagccattggaaaggcttgggaggagggcgtatgcggtataaggtccgccacacggctggaaaacatcatgtggaaacagatttctaacgagctcaatcatatcctgttagaaaacgacatgaagctgaccgtcgtggttggcgatgtggcagggattcttggacagggcaaaaagatgatccgccctcaacccatggagtacaaatattcgtggaaaagctgggggaaggctaaaataatcggagccgacgcgcagaatactaccttcattatcgatggcccaaacacacctgaatgtcccgacgatcagagagcctggaatatttgggaggtcgaggactacggttttgggatgttcactaccaacatctggttgaagctcagggattcctatacacaggtgtgcgaccaccgtctgatgtcagctgcaataaaagatagtaaggccgttcacgctgacatgggatactggattgaatctgagaaaaatgaaacgtggaagctagcccgggcatcctttatcgaggtgaagacctgtatttggccaaaatcccatactctgtggtcaaacggcgtactcgaaagcgagatgatcatacccaagatctatggtggccctatttctcaacacaattaccgaccagggtacttcacacagaccgcgggaccgtggcatctgggcaaacttgagttggatttcgacctgtgcgaagggactacagtcgtggtggatgagcactgcggaaacagaggcccctccttaaggaccacgactgtcaccggtaagatcattcacgaatggtgttgccgcagttgtacactccctccactgcggtttagaggggaggacggatgctggtatggcatggagatcaggcccgttaaagaaaaggaggaaaatcttgtaaagagcatggtatctgccggttccggcgaggtggactcattcagtctggggttgctctgtataagcattatgatcgaagaggtcatgcgctcgcgatggtcccggaaaatgctgatgaccggaactctagctgtgtttttcctgctcatcatgggccagctgacatggaacgatcttattcgtttgtgcatcatggttggggccaatgcatctgacagaatgggaatgggcaccacatacctggctttaatggccacttttaagatgaggcctatgttcgcagtgggtctcctgtttcgccggcttaccagcagagaggtcctgctactcacgattgggctgtcattggtggccagtgttgaactgccaaactccttagaggaactcggagatggcctggctatgggcataatgatccttaaactgttgacagacttccaatctcatcagctctgggcgaccctgctaagcctgacttttattaagaccacattctcccttcactatgcctggaaaactatggcaatggtgctctcaatcgtcagcctgtttcccttgtgtctgagtaccacgtctcagaagacaacctggttaccggtactcctggggtcccttggatgcaagcctctgactatgttcttgattgctgagaataaaatctggggtagaaagagctggccactcaacgaaggcataatggccgtggggatcgtttcgattctgctatcatctctgcttaaaaacgatgtgcccctcgccggacctctgatcgctggcggtatgttgattgcatgttacgtcatcagtgggtccagcgccgacttatctctggagaaggcggctgaggtgagctgggaagaggaagccgagcattccggagcatcacacaatatactcgtagaagtgcaggatgacggcacaatgaaaattaaggatgaggagcgagacgataccctgactatccttctgaaagccacattgctagctgtcagtggcgtttatcccctgagcatcccagcaaccctctttgtgtggtacttctggcaaaagaagaaacagcgctctggggtgctgtgggacacgccttcacccccagaagtcgagcgggccgtgcttgatgacggaatttatagaataatgcagaggggtttactgggccgtagccaggttggggtaggagtgttccaagaaaacgtctttcatactatgtggcacgtgacccgcggcgcggttctcatgtaccagggtaagcggttggagccgagttgggctagcgtgaaaaaggacctgatctcctacgggggaggctggagactcaggggctcttggaatacaggggaggaagtccaggtgattgccgtagagcctggcaaaaatcccaagaatgtccagaccgcaccaggtacattcaagactcccgaaggcgaggtgggggccatcgctctggattttaaacctggaacctcgggcagcccaattgttaaccgagaaggtaagatcgtggggctttatggaaatggcgtcgtgacgacatcaggcacttacgtttccgccatagcacaagctaaagccagtcaggaggggcccctgcctgagatcgaagacgaggtgttccggaagcgcaacttgaccattatggatctacacccgggatctggtaaaacaagaaggtatctgccagcgatcgtccgggaagccattaagcgaaagctcagaaccttaatcctggcacccactcgcgtggtagctagcgagatggccgaagctcttaaaggcatgcctataaggtaccagaccacagcagtgaagtccgagcatacggggaaagagattgttgacctgatgtgccacgccacttttaccatgcgtctcttgtcaccagtccgggtgcccaattataacatgatcatcatggatgaagcccatttcacagacccttctagcattgctgcgagaggatacatcagtaccagggtgggcatgggtgaggcagccgctatatttatgactgccacaccgcccgggtccgtcgaagcattcccacaaagcaatgccgtaattcaggatgaggaacgcgacatccctgagcgatcttggaactcaggatatgagtggattaccgattttcccggcaagacggtgtggttcgttccatccatcaaaagtggcaatgacatagctaactgtctgagaaagaatgggaagcgggtgattcagctcagcaggaaaacttttgatacagaataccagaagaccaaaaacaacgactgggactacgtcgtgaccactgatatctcggagatgggagcgaatttccgcgccgaccgtgttatcgatcctagacggtgcctgaagcccgtgattcttaaagacggtccagaaagggtcatcctagcaggcccgatgcctgtgacagtagcttctgccgcacaacgccgagggagaattggacggaaccacaataaggagggcgatcagtatatatacatgggtcagcccctgaacaatgacgaggatcatgcccactggaccgaagctaagatgttgttagacaacatcaatacaccagaggggattatccccgccctgttcgaacctgagagggaaaaatccgcggcagtggatggcgagtatcgcctcagaggagaggccaggaagacttttgttgaactgatgcggcgtggcgaccttccagtctggctgagctacaaagtggcttcagaggggttccagtatagtgatcgccgatggtgctttgacggagaaagaaacaatcaagtgctcgaggaaaacatggatgtcgagatctggacgaaggagggtgaaaggaaaaagttgcggccccgctggctggacgccagaacctactctgaccctctagctctgagggagttcaaagaatttgcagccggccggcgatccgttagcggggatctcattcttgagataggaaagctgccgcagcacttaacacagagagctcagaatgccttggacaacctggtgatgctccataattcagaacaaggcggtcgcgcatataggcacgcgatggaggagctgccagatactatcgaaacccttatgctgctcgccttgattgctgtactgacagggggcgtgaccttattctttctaagtggacggggcctggggaagactagcatcggactcctttgtgtcatggcctcctctgtgctgttgtggatggcaagcgttgagccccattggattgctgcctccatcatactggagttctttctcatggtgctgcttatccctgagcccgaccgtcagagaacgccacaggataaccagctcgcatacgtcgtaattggtctgttgttcatgatcctgaccgtggccgctaatgagatgggcttactagaaacaactaaaaaggacctggggattggacacgttgcggtggagaaccaccatcacgccgcaatgctcgatgtcgaccttcatcctgcttcagcctggaccctgtacgccgtggcaacaaccatcataactcccatgatgaggcacacaattgaaaacacgaccgctaatatctctttgactgccattgcgaaccaagctgccatcctgatgggcctcgataaaggttggccaataagtaagatggacatcggggtccctctgcttgcattaggctgctatagccaggtgaatccgctgacactcaccgccgctgttttgatgctggtggcacattacgccattatcggacccggcctacaggcgaaagctacccgcgaggcccaaaagcggacagcagccgggattatgaagaacccaactgtagatggaatcgtggctatagacctggatcctgtcgtttatgacgccaaatttgaaaagcagctcggccagattatgcttctgatcttgtgtacgagccagatcctgctcatgcgaaccacatgggcactgtgcgagtccattactttagctaccggtccccttacaaccctgtgggaggggtctccaggaaaattctggaatactacgatcgccgtgtcaatggcgaacatatttagaggcagctacctcgccggtgcaggcctagctttctccctgatgaagagtctagggggaggcaggcgcgggacaggagcccaaggcgaaaccctgggtgagaaatggaagcggcagctcaatcagctttctaagagcgagttcaacacttataaaagatcagggattatggaggtcgaccgttccgaagcaaaggagggactgaaaaggggcgagaccacaaagcacgctgtgagtcggggtactgccaaattgcgctggtttgtagaacgaaatctggtgaagcctgagggcaaggttatcgatctcgggtgtggaagaggcgggtggagctactattgcgccggactaaagaaggtgaccgaagtcaaaggctacacaaagggtgggcccggacacgaggaaccgattccaatggcgacgtacggctggaacctggtgaaacttcattctggcaaggacgtcttctttatccctcccgagaaatgtgataccctgctatgcgacataggggagtcctcaccaaatcccactatcgaagagggaaggacactccgggtgctgaagatggttgaaccttggttgcgcggtaaccagttctgtattaagatcctgaatccgtatatgcccagcgtagtggagaccctcgagcaaatgcagagaaaacacggcgggatgcttgtcaggaacccactgtcgcgaaattctactcatgaaatgtactgggtgagttgcggaacaggcaacattgtttccgctgtgaatatgaccagccggatgttactgaaccgttttacgatggcacacagaaagcctacctatgagcgcgatgtcgacttgggtacagggactaggcacgtggccgtagaacccgaggtggctaacctcgatatcattggacagcggatcgaaaatataaaacatgagcacaagtcaacctggcattacgacgaggataacccttataaaacatgggcctaccacggctcctatgaagttaagccatctggcagcgcaagttccatggtcaatggggtggtgaagctgctaactaaaccctgggacgtcattcctatggttacccagatcgccatgacagataccactccattcggacaacagagagtgtttaaggagaaagtagacacgcgcacacccaaggctaaaaggggtaccgcgcagatcatggaagtgactgcccgatggctttggggcttcctgagccggaacaagaagccgagaatttgtaccagggaggaatttacacgcaaagtccgttctaatgcagctataggggccgtgttcgttgacgagaaccaatggaactcagcaaaggaggccgtggaagatgagcggttttgggacctcgtccatagagaaagggagctgcacaaacagggaaagtgcgctacgtgcgtgtacaacatgatgggcaaacgcgaaaagaagttgggtgagttcgggaaagccaagggaagtcgagcgatctggtacatgtggctgggcgcacggtttctcgagttcgaagcccttggcttcatgaatgaggatcactggttttccagagaaaacagcctgtctggggtagagggagagggtttacataaactgggctatattttgagggacatctcgaagattcctgggggaaatatgtacgctgatgacaccgccggctgggatactcgcatcacagaagacgatctccagaacgaggcaaaaataaccgacatcatggaaccagagcacgctctgctagccaaggctattttcaaacttacttatcagaataaggttgtgagagtccaacggcccgccaagaacggtacagtgatggatgtgatctcaaggcgtgaccagcgagggagcggacaggtcggcacctacggcctgaatacatttactaacatggaagcacagctcattcgccaaatggagtccgaggggatcttcagtccttctgaactggagaccccaaacttggcggaaagagccttagattggctggagaaatatggagttgaacggctcaagaggatggctataagcggtgacgactgtgtggtaaaacccattgatgaccgctttgccacggcacttaccgctctgaatgatatgggcaaggtgagaaaagacatcccgcagtgggagccttccaaggggtggaacgattggcagcaggtccccttctgctcacatcactttcaccaactaatcatgaaggacggacgggagattgtggttccatgtaggaatcaggatgaactggtgggccgagcccgtgtcagtcagggtgcagggtggtctctcagagagacagcctgcttgggaaaaagctacgcgcagatgtggcaactgatgtatttccatcgccgggaccttaggctggctgccaacgcaatatgttccgccgtgcctgtagattgggttcccacttcaagaaccacatggagcatccacgctcatcaccagtggatgactaccgaagacatgctctctgtgtggaatcgcgtctggattgaggaaaacccatggatggaggataagacgcatatctccagttgggaggacgtgccctacttaggcaaacgggaagaccagtggtgcggcagcctgattgggttgacagccagggcaacctgggctactaatatccaagttgccataaaccaggtgcgaagactgatcggaaatgagaactacctcgattatatgacatcgatgaagcggtttaaaaatgaaaccgaccctgagggtgcgctttggtga

SEQ ID NO: 13630 - RNA, 9879 nt, synthetic construct
  misc_feature 1..9879: note = derived and/or modified CDS sequence (opt3) from DENV-1__FJ432735__SS-prME
  source 1..9879: mol_type = other RNA
agcgtgaccatgctgctaatgcttatgcccaccgcactggctttccacttgactacgagaggcggggaacctcatatgatcgtctccaagcaggaaagggggaaatctttactgtttaagacctcagccggtgttaacatgtgcacactaattgccatggacctcggcgagttctgtgaagatactatgacctacaaatgcccacggataacagaagcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaggacgcaaactttgtttgccgccgaacattcgtggatagaggctggggtaatgggtgtggactgtttggcaaaggctccttgataacttgcgctaagttcaagtgcgtaaccaaactcgaggggaagacagtgcagtacgaaaacctgaaatattcagtcattgtgaccgttcacactggagaccagcatcaagtgggtaatgagagtacggaacacggcacaaccgccactatcacaccccaggcgcctagcacagagattcagttaaccgactacggggccctgactctcgattgttctccaaggacaggacttgactttaacgaaatggtcctgttgacgatgaaggagaaatcctggctagtgcataagcagtggttcctggatctcccgctgccctggacctcaggcgcaagcacaagtcaagagacatggaatcggaaagaccttctggtaacctttaagacagctcacgccaagaaacaggaagttgtggtcttgggttctcaggagggggctatgcacactgccctcaccggcgcaacggaaatccaaacctccggaacaactaccatcttcgccggccatctgaagtgccgtttaaaaatggataagctgacactaaaagggatgagctatgtgatgtgtactggatcgttcaagctcgagaaggaagtcgctgagacccagcacggtacggtgctggttcagattaaatacgagggcacagacgcgccttgcaagataccattttctacccaggatgaaaaaggggtgactcaaaacggacgccttatcacagcaaatcccattgtaaccgacaaggagaaacctgtcaacatcgaagccgagccacccttcggcgagtcctatatagtgattggtgctggggaaaaggccttgaagctgtcatggtttaaaaagggcagtagcatcggaaaaatgttcgaggcaactgccagaggcgctaggcggatggccatcctcggggataccgcatgggactttggatccattggtggcgttttcacatctgtggggaagctggtccatcagatctttggaacggcgtacggcgtgcttttcagcggtgtatcatggaccatgaaaattgggataggcgtgctgttgacttggctcggactgaatagtcgatccactagcttatctatgacctgtatcgctgttggcctggtcacactatacctcggggtgatggtgcaggccgattcaggatgcgtcattaactggaagggccgcgaactgaagtgtggtagtgggatctttgttactaatgaggtgcacacctggacggaacagtataaattccaagcagacagcccgaagagactttccgccgctatcggaaaagcctgggaggagggcgtgtgcggtattaggtctgcaacacggttggaaaacataatgtggaagcagatctcgaacgagctgaatcatattctcctggaaaacgacatgaaatttaccgtagtcgtgggcgatgttgctgggatcttagcccagggaaagaaaatgattcgccctcagcccatggagtacaagtatagctggaagtcctggggcaaagcgaagatcataggggccgacgtgcaaaatactaccttcatcattgatggaccaaacacacctgaatgtcccgacgatcagagagcttggaatatctgggaggtcgaggactacggctttggtattttcactaccaacatctggctgaaacttagggattcatatacacaggtgtgcgaccaccgtttgatgagtgcagccataaaggattctaaagctgttcacgccgacatggggtactggattgaaagcgagaagaatgaaacgtggaagctcgcacgggcgtccttcatcgaggtgaaaacctgtatttggccaaagtcacatactctgtggagcaacggagtactagaatctgagatgatcatacccaaaatctatggcggtcctatttcccagcacaattaccgaccaggctactttacacaaaccgccgggccgtggcatctgggaaagctcgagctggatttcgacctttgcgaaggcactacagtcgtggtggatgagcactgcgggaacagaggacccagtttgaggaccacgactgtcaccggcaaaatcattcacgaatggtgttgccgcagctgtacactgcctccattacggtttaagggtgaggacgggtgctggtatggaatggagatcagacccgttaaggaaaaagaggaaaatctcgtgaagtctatggtatccgctggctcaggtgaggtggacagtttcagcctgggccttctgtgtatatcgattatgatcgaagaggtcatgaggtcccgctggtctcgaaaaatgttgatgaccgggactctcgccgtgtttttcctgctaatcatgggacagctgacatggaacgatctcattcggctgtgcatcatggttggcgcaaatgctagcgaccgtatggggatgggaaccacataccttgccttgatggcaacttttaagatgagacctatgttcgccgtgggcctgttatttaggcgcctcacctcacgggaggtcctgcttctgacgattggtctaagtctcgtggcttccgttgaactgccaaactctttggaggaactgggggatggattagcgatgggcataatgatcctcaaactgcttacagacttccagagccatcaactgtgggccaccttgctctccctgacttttattaagaccacattctcactacactatgcatggaagactatggctatggtgctgagcatcgtcagtctttttcccctctgtctgtctaccacgtcccagaaaacaacctggttgccggtactgttaggcagcctcgggtgcaagcctctgactatgttccttattgccgagaataaaatctggggaagaaagtcgtggccactgaacgaaggtataatggccgtgggcatcgtttcaattttgctctctagtctgctcaagaatgatgtgcccctggctgggcctcttatcgcaggaggcatgctcattgcctgttacgtcatctccggtagctctgcggacctgagcttggagaaggctgccgaggtgtcctgggaagaggaagcagagcattcaggggccagtcacaatatattagtagaagtgcaggatgacggaacaatgaaaattaaggatgaggagagggacgataccctgactatcctcctgaaggctacacttctggcagtcagcggcgtttatcccttgtctatcccagccaccctattcgtgtggtacttttggcagaaaaagaaacaacgatccggcgtgctgtgggacacgccttcacccccagaagtcgagcgcgcggtgctcgatgacgggatttatcggataatgcagagaggactgcttggtaggagtcaggttggcgtaggggtgttccaggaaaacgtctttcatactatgtggcacgtgacccgtggagctgttttaatgtaccaaggcaagcgcctggagccgagctgggcctccgtgaaaaaggacctcatctcttacggtgggggatggcggttgcagggctcgtggaatacaggcgaggaagtccaggtgattgcagtagagcctgggaagaaccccaaaaatgtccagaccgccccaggaacattcaagactagcgaaggtgaggtgggcgctatcgccctggattttaaacccgggacctcaggatcccctattgttaacagagaaggcaagatcgtgggtctctatgggaatggagtcgtgacgacaagtggcacttacgtttctgcaatagctcaagccaaagcgagccaggagggcccactgcccgagatcgaagacgaggtgttcaggaagcgaaaccttaccattatggatctgcaccctgggtccggaaagacacggcgctatttgccggccatcgtcagagaagcaattaaaaggaagctacggaccctgatcctcgctccaactcgagtggtagcctcagagatggctgaagcattaaaaggtatgcccataagataccagaccacagccgtgaagtctgagcatacgggcaaagagattgttgacctgatgtgccacgccacttttaccatgcgccttctgagccctgtcagggtgccaaattataacatgatcatcatggatgaagctcatttcacagaccccagttccattgcggcacgtgggtacatcagcacccgggtgggaatgggcgaggccgctgccatatttatgactgcaacacctccgggttctgtcgaagccttcccccaatcaaatgctgtaattcaggatgaggaaagagacatcccagagaggtcctggaacagtgggtatgagtggattaccgattttcctggaaagacggtgtggttcgttcccagcatcaagtcgggcaatgacatagcgaactgtctccgcaaaaatggcaagcgagtgattcagttgtctagaaaaactttcgatacagaataccagaagaccaaaaacaacgactgggactacgtcgtgaccactgatatctccgagatgggggccaattttcgggcagacagggttatcgatccacgccgttgcctgaagcctgtgattctcaaggacggacccgaaagagtcatcctggctggtccaatgccggtgacagtagccagcgcagcccaacggaggggccgcattgggcgaaaccacaataaagagggagatcagtatatatacatgggccagcctcttaacaatgacgaggatcatgctcactggaccgaagccaagatgctactggacaacatcaatacacccgagggtattatcccagcgttgttcgaacccgagagagaaaaatcagcagccatcgatggggagtatcggttaaggggcgaggctcgcaagacttttgtggaactgatgagaaggggagacctccctgtttggctgagttacaaagtcgcctctgagggcttccagtattccgatcggcgttggtgctttgacggggaacgcaacaatcaagtgcttgaggaaaacatggatgtggagatttggacgaaggagggagaacgaaagaaactgagaccaaggtggctcgacgctcggacctacagcgaccccttggcactgcgcgagttcaaagaatttgccgctggtagaaggtcagtcagtggcgatctaatactggagatcgggaaactccctcagcaccttacacagaaggcccagaatgcactggacaacttagttatgttgcataatagcgaacaaggaggccgggcgtatcgacacgccatggaggagctgccggatactattgaaaccctcatgctgcttgctctgatcgccgtgctcacaggtggggtaaccttgttctttctgtccggcagaggattaggcaaaacttctattgggctactgtgtgtgatggcaagctccgtcctcctttggatggcttcagtggagccacattggatcgccgcatctataatcctggagttctttttgatggttctgctcattcccgagcctgaccgccagaggacgccccaggataaccagctggcctacgtggtcatcggacttctcttcatgattctgaccgtagctgcgaatgagatgggtttgctggaaacaactaagaaagacttaggcatcgggcacgtggccgttgagaaccaccatcacgcagctatgctagatgtggacctgcatccagccagtgcctggaccctctacgcagtcgctacaaccataattactcctatgatgcggcacacaatcgaaaacacgaccgccaatatttcgcttactgcgatcgctaaccaagccgcaatactgatgggattggataagggctggcccatcagcaagatggacattggtgtgccactgctcgccctggggtgctattcccaggtcaatcctcttacattaaccgctgcagtgctgatgctcgttgcccattacgcgatcattggcccgggattgcaggctaaagccacccgtgaggcacaaaagagaacagccgctggcatcatgaaaaaccccactgtggatgggatagtagccattgacctggatccagtggtctatgacgcaaagtttgaaaaacagctaggacagatcatgctgctcatcctttgtacgtctcagattctgttgatgaggaccacatgggctctgtgcgagtcaatcactctcgccaccggccctctgacaaccttatgggagggtagccccgggaagttctggaatactacgatagcggtttccatggccaacattttccgcggaagttaccttgcaggcgctggtctggccttttctctcatgaaaagcctaggcgggggacggcgaggcacaggggcacaaggagaaaccctgggcgagaaatggaagagacagttgaatcagctgtcaaaatccgagttcaacacttataagaggagtggtatcatggaggtggaccgcagcgaagctaaagaggggctcaagcggggagagaccacaaagcacgccgtctctagaggcactgccaaacttcgttggtttgtggaaaggaatctggtaaagccagagggtaaagtgattgatttgggctgtgggcggggaggctggtcctactattgcgcggggctgaagaaagttaccgaagtgaagggatacacaaaaggcggtcctgggcacgaggaacccatcccgatggctacgtacggatggaacctcgtcaagttacattcaggcaaggacgtgttctttataccacctgagaaatgtgataccctgctttgcgacatcggcgagagctcgcccaatccaactattgaagaggggcgcacactgcgagtcctaaagatggtggaaccctggctcagaggaaaccagttctgtatcaaaattctgaatccttatatgccgtctgttgtagagaccttggagcaaatgcagaggaagcacggtggcatgctggtgcggaaccccctcagtcgcaattccactcatgaaatgtactgggtcagctgcgggacaggaaacatcgtgtcagcagttaatatgacctccagaatgcttctgaacaggtttacgatggcccaccgaaaaccaacctatgagcgggatgtggacttaggcgctggtacacgtcacgtcgccgtggaacctgaggtagcaaacctggatattatcgggcagagaatagaaaatattaagcatgagcacaagtctacttggcattacgacgaggataacccctataaaacctgggcctaccacggaagctatgaagtgaagcctagtggctccgctagctctatggttaatggcgtcgtgaaattgctcacaaagccatgggacgtgatccccatggtcactcagatcgcgatgaccgatacaacccctttcgggcaacagcgcgtttttaaagagaaggtggacactaggacgccaaaggccaaacggggaacagcacagattatggaagtaaccgctaagtggctgtggggtttcctatcaagaaacaaaaagccccgcatatgtactagggaggaatttacccgaaaagtgcggagtaatgccgcaatcggcgccgtcttcgtggacgagaaccaatggaactccgctaaggaggccgttgaagatgagagattttgggaccttgtgcatagggaacgcgagctgcacaagcaggggaaatgcgcgacatgcgtctacaacatgatgggaaagcgtgagaagaagctcggcgagttcggtaaagcaaaggggagccgggccatttggtacatgtggctgggagctagattcttggagtttgaagccctgggcttcatgaatgaggatcactggttttctagggaaaactcgctctcaggcgtggagggggagggacttcataaactgggttatatcttacgcgacattagcaagatcccgggcgggaatatgtacgcagatgacacggctggatgggatacccgaataactgaagacgatctgcagaacgaggccaagatcacagacattatggaacctgagcacgctttgctcgccaaatccatcttcaagctgacctatcagaataaagtagttcgggtgcaaagaccagcaaagaacggcactgtcatggatgtgattagtaggcgcgaccagagaggttctggacaggtgggaacatacggcctaaatacctttacaaacatggaagcgcagcttatccggcaaatggagagcgagggcatattctccccctcagaactggagactcctaacctcgccgggagggtcctggattggttggaaaaacatggagttgagcgtttaaagcgaatggctattagtggtgacgactgtgtggtaaagccaatcgatgaccgctttgccaccgcactgacggctctcaatgatatgggcaaagtgagaaaggacatcccccagtgggaaccgtctaaagggtggaacgattggcagcaggtccctttctgcagccaccactttcatcaacttattatgaaggacggacgggagatagtggttccctgtaggaatcaggatgagctggtgggccgcgccagagtctcccagggtgcagggtggtcactacgggaaaccgcctgcctgggaaaaagctatgcgcagatgtggcaactcatgtacttccacaggcgagacttgcgtctggctgccaacgcaatctgttctgccgtgccagtagattgggttcctacatccagaactacctggagtattcatgctcaccatcagtggatgacaactgaggacatgcttagcgtgtggaatcgcgtctggatcgaagagaacccctggatggaagataagacccacatttcgtcctggggcgacgtgccatatctgggcaagcgggaggaccagtggtgcgggtctctcatcggattaacggccagggcaacatgggctaccaatatacaagttgccatcaaccaggtgagacgcctgattggtaatgagaactacttggattacatgacttcaatgaaacggtttaagaatgaaagcgaccccgagggcgcgctgtggtga

SEQ ID NO: 13631 - RNA, 9879 nt, synthetic construct
  misc_feature 1..9879: note = derived and/or modified CDS sequence (opt3) from DENV-1__FJ432736__SS-prME
  source 1..9879: mol_type = other RNA
agcgtgaccatgctgctcatgcttatgcccacagccctggctttccacttgactacgagaggaggggaacctcatatgatcgtctccaagcaggaaaggggaaaatctttactgtttaagacctcagcgggtgttaacatgtgcacactgattgccatggacctcggagagctgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccgtgctgaggaaactttgcattgaagctaagatctctaatacgaccacagatagccggtgtccaactcaaggagaggccaccctggtcgaagaacaggacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatgtgtactggcagcttcaaactggagaaggaagtcgctgagacccagcacggtacggtgcttgttcagataaagtacgagggcacagacgcgccttgcaaaatcccattctcgacccaagatgaaaagggggtgactcagaacggacgcttgattacagcaaatcccatcgtaaccgacaaagagaagcctgtcaacatagaagccgagccaccctttggcgagtcttatattgtgatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtttttacatccgtggggaaacttattcatcagatattcggaacggcgtacggcgtcctgttttctggtgtgagctggaccatgaagatcgggattggcgtattgctcacttggctgggattaaattcacgaagtacatccctgagcatgacctgtatcgctgtgggcctagttacactctacctgggggtcatggtgcaggccgattctggatgcgtgatcaactggaaaggccgcgaacttaagtgtggttcagggattttcgtcactaatgaggttcacacctggacggaacaatataagtttcaggcagacagtccgaaaagattgagcgccgctataggaaaggcctgggaggagggcgtgtgcggtatcaggtccgcaacacggctggaaaacattatgtggaaacagatctctaacgagctcaatcatattctgttagaaaacgacatgaagctgaccgtggtagtcggcgatgtggctgggatccttggacagggcaaaaagatgatacgccctcaacccatggagtacaaatattcgtggaaaagctgggggaaggccaagatcattggagcggacgcccagaatactaccttcatcattgatggcccaaacacacctgaatgtcccgacgatcagagagcttggaatatctgggaggttgaggactacggttttgggatattcactaccaacatttggttgaagctcagggattcctatacacaggtgtgcgaccaccgtctgatgtcagcagccatcaaagatagtaaggctgtccacgccgacatgggatactggattgaatctgagaaaaatgaaacgtggaagctagcacgggcgagctttatcgaggtgaagacctgtatatggccaaaatcccatactctgtggtcaaacggcgttctcgaaagcgagatgatcattcccaagatctatggtggccctatttctcaacacaattaccgaccagggtacctgacacagaccgccggaccgtggcatcttggcaaattggagctggatttcgacttatgcgaagggactacagtggtagtcgatgagcactgcggaaacagaggcccctccctcaggaccacgactgtgaccggtaagatcatacacgaatggtgttgccgcagttgtacactgcctccacttcggttcagaggggaggacggatgctggtatggcatggagattaggcccgtgaaagaaaaggaggaaaatctggtcaagagcatggtttctgctggtcctggcgaggtggactccttttcattggggctcctgtgtatcagtatcatgattgaagaggtaatgcgcagccgatggtcgcggaaaatgctaatgaccggaactctggccgtgttctttctcctgatcatgggccagcttacatggaacgatttgattcgtctgtgcataatggtcggggcaaatgctttcgacagaatgggaatgggcaccacatacttagccctcatggcaacttttaagatgaggccaatgttcgccgtgggtctgctttttcgccggctgacctccagagaggttctactcctgacgatcgggttgtctctggtggctagcgtcgaattacccaactcactcgaggaactgggagatggccttgcgatgggcattatgatcctgaaattgctcacagacttccaaagtcatcagctgtgggccaccctactgtcccttacttttattaagaccacattctctctccactatgcatggaaaactatggctatggtgctgagcatcgtttccttgtttccgctgtgtttatcaaccacgagccagaagacaacctggctccctgtgctgcttgggagtctgggatgcaagccattgactatgttcctcatagccgagaataaaatctggggtaggaagtcttggcccctgaacgaaggcattatggccgtcgggatcgtatccattctactgagctcgcttctcaaaaacgatgtgcctctggctggacccttgatcgcaggcggtatgttaatagcctgttacgttatttcagggtctagtgcggacctgtccctcgagaaggctgccgaggtgagctgggaagaggaagcagagcattctggagccagccacaatatcctggtcgaagtgcaggatgacggcacaatgaaaatcaaggatgaggagcgagacgatacccttactattctgttgaaagctacactactggcagtatccggcgtgtatccactctcaatacctgccaccctgtttgtctggtacttctggcaaaagaagaaacagcgcagtggggttctttgggacacgcccagcccaccggaagtggagcgggcggtgttagatgacggaatctatagaattatgcagaggggtctgctcggccgttctcaggtcggggtgggagttttccaagaaaacgtatttcatactatgtggcacgtgacccgcggcgctgtcttgatgtaccagggtaagcggctggagccttcctgggcctcagtgaaaaaggacctcatcagttacgggggaggctggagactgaggggcagctggaatacaggggaggaagttcaggtgattgcagtcgagcccggcaagaacccaaagaatgtgcagaccgcccccggtacattcaagactcctgaaggcgaggtaggggctatcgcccttgattttaaaccaggaacctccggctctcccatagtcaaccgagaaggtaagatcgtggggctgtatggaaatggcgttgtgacgacatcgggcatttacgtcagcgcaatcgctcaagccaaagcgtcacaggaggggcctttgccggagattgaagacgaggtgttccggaagcgcaacctaactatcatggatctgcacccaggatccggtaaaaccagaaggtatctccccgccatagttcgggaagcaattaagcgaaagttaagaacactgatccttgctcctacccgcgtggtcgccagtgagatggctgaagcactgaaaggcatgccaatcaggtaccagactaccgccgtgaagtctgagcatacagggaaagagattgtagacctcatgtgccacgccacgtttactatgcgtttgctgagccccgtgcgggttcctaattataacatgatcataatggatgaagctcatttcaccgacccgtcctcaattgcggcaagaggatacatctctacaagggtcggcatgggtgaggccgctgccatttttatgaccgcaactcccccagggagcgtggaagccttccctcaaagtaatgctgtgatccaggatgaggaacgcgacatacccgagcgatcctggaacagcggacacgagtggattacagattttccaggcaagaccgtctggttcgtaccttctatcaaatcaggcaatgacatcgcgaactgtctcagaaagaatgggaagcgggtgattcagctgtccaggaaaacgtttgatactgaatatcagaagactaaaaacaacgactgggactacgttgtgaccaccgatatcagtgagatgggagccaatttccgcgcagaccgtgtcattgatcccagacggtgccttaagccagtgatactaaaagacggtccggaaagggttatcctggctggccctatgcccgtgactgtcgccagcgcagcccaacgccgagggagaattggacggaaccataataaggagggcgatcagtacatctatatgggtcagccattgaacaatgacgaggatcacgctcactggacagaagccaagatgttactggacaacatcaatacccccgaggggattatacctgcactcttcgaaccagagagggaaaaatcggcagccgtggatggcgagtaccgcctgagaggagaggctaggaagacatttgtagaacttatgcggcgtggcgacctgcccgtgtggctctcttataaagttgcctccgaggggttccagtacagcgatcgccgatggtgctttgacggagaaagaaacaatcaagtcttggaggaaaacatggatgtggagatctggactaaggagggtgaaaggaaaaagctgcggcctcgctggctagacgctagaacgtattcagacccgctggcactcagggagttcaaagaatttgccgctggccggcgaagtgtgtctggggatcttattctggagatcggaaagttaccacagcatttgacccagagagcccagaatgcactggacaacctcgtcatgctgcacaattccgaacaaggcggtcgcgcgtacaggcatgccatggaggagcttcccgatacaattgaaactctgatgctcttggctctgatcgccgttttaaccgggggcgtgacactattctttctgagcggacggggcctcgggaagacctcaataggacttctgtgtgtaatggcaagtagcgtgttgctgtggatggcttccgtcgagcctcactggatcgccgcatctattatcctcgagttctttctgatggtgcttctcattcccgagccagaccgtcagagaactcctcaggataaccagctggcctatgttgtgatcggtttgctgttcatgatattaacggtcgctgcgaatgagatgggcctactggaaaccactaaaaaggacctcgggattggacacgtagccgtggagaaccatcaccatgcagctatgcttgatgttgacctgcaccccgccagcgcctggactttgtacgcagtggctaccacaatcattaccccaatgatgaggcatactatcgaaaacacaacggccaatatatccctgaccgcgatcgctaaccaagccgcaattctcatgggcctggataaaggttggcctatctcaaagatggacattggggtcccgcttttagccctgggctgctactctcaggtgaatcccctcactttgacagctgcagtcctgatgctagtggcccactatgcgatcataggaccaggcctgcaggctaaagccacccgcgaggcacaaaagcggaccgccgctgggattatgaagaaccctacagttgatggaatcgtggccatcgacctcgatcccgtagtgtacgacgcaaaatttgaaaagcagcttggccagattatgctgttgatcctgtgtacaagtcagatactcctgatgcgaacgacctgggctttatgcgagtcgattacacttgccactggtccactgaccacactctgggaggggagccctggaaaattctggaataccactatcgcggtctccatggccaacatttttagaggctcttatctagcaggagctggcctggccttctcattgatgaaaagcctagggggtggcaggcgcgggacgggagcacaaggcgaaacactcggtgagaaatggaagcggcagcttaatcagctgtccaagagtgagttcaacacctacaaaagatctgggatcatggaggttgaccgtagcgaagctaaggagggattgaaaaggggcgagactaccaagcacgccgtgtcacggggtacagccaaactgcgctggtttgtcgaacgaaatctcgtgaagcccgagggcaaggtaatagatttagggtgtggaagaggcgggtggtcctattactgcgcgggactgaaaaaggtgactgaagttaaaggctataccaagggtgggccgggacatgaggaaccaatccctatggctacatacggctggaaccttgtgaaactgcacagtggcaaggacgtcttctttattcccccagagaaatgtgatacgctactctgcgacatcggggagagctctcccaatcctaccattgaagagggaaggactctgcgggtgttgaagatggtcgaaccgtggctgcgcggtaaccagttctgtatcaagattctcaatccctacatgccatccgtggttgagacacttgagcaaatgcagagaaaacatggcgggatgctggtaaggaaccctttatcacgaaatagcacccacgaaatgtattgggtgtcgtgcggaactggcaacatcgtctctgcagtgaatatgacaagtcggatgctgttgaaccgttttaccatggcccacagaaagcccacgtacgagcgcgatgttgacctcggtaccgggacaaggcatgtggctgtcgaacctgaggtggccaacctggatataattggacagcggatcgaaaatatcaaacacgagcataagtccacttggcactatgacgaggataacccatacaaaacctgggcatatcatggcagctacgaagtaaagccctcaggctccgcctctagcatggtgaatggggttgtcaagctacttacaaaaccttgggacgtgattccaatggtgactcagatagctatgaccgatacaacccccttcggacaacagagagtctttaaggagaaagttgacactcgcacgccgaaggcgaaaaggggtacagcccagatcatggaagtgaccgcacgatggctgtggggcttcctcagtcggaacaagaagcctagaatttgtactagggaggaatttacccgcaaagtacgttccaatgctgccatcggggcagtgttcgtcgacgagaaccaatggaatagcgccaaggaggctgtggaagatgagcggttttgggacctggttcacagagaaagggagttgcacaaacagggaaagtgcgccacatgcgtgtataacatgatgggcaaacgcgaaaagaagctgggtgagttcgggaaagcgaagggatctcgagcaatttggtacatgtggctcggcgcccggtttcttgagttcgaagctctgggcttcatgaatgaggatcattggttttcaagagaaaacagtttatccggggtcgagggagagggtctgcacaaattgggctacatcctcagggacataagcaagatcccagggggaaatatgtatgccgatgacacggcaggctgggatacccgcattactgaagacgatctgcagaacgaggctaaaatcacagacattatggaacccgagcatgccctacttgctaaggccatcttcaaactgacctaccagaataaggtggtaagagttcaacggcctgcaaagaacggtactgtgatggatgtcatatctaggcgtgaccagcgagggtcgggacaggtgggcacatatggcctcaatacctttacaaacatggaagcgcagctgattcgccaaatggagtcagaggggatcttcagcccatccgaattggagactcccaacttagccgaaagagctctggattggctcgagaaatacggagtggaacggcttaagaggatggccatcagtggtgacgactgtgtcgttaaaccgattgatgaccgctttgcaaccgctctgacggccctaaatgatatgggcaaggtgagaaaagacatacctcagtgggagccctctaaggggtggaacgattggcagcaggtaccattctgcagccaccactttcatcaactgatcatgaaggacggacgggagattgtggtcccttgtaggaatcaggatgaactcgtgggccgagcacgtgtttcccagggtgccgggtggtcattgagagagaccgcgtgcctgggaaaaagttatgctcagatgtggcaacttatgtacttccaccgccgggacctgaggctcgccgcaaacgccatctgttctgctgtgcccgtcgattgggtgccaacaagcagaactacctggtccattcatgcccaccatcagtggatgacaactgaagacatgttatcagtatggaatcgcgtttggatcgaggaaaacccctggatggaggataagacccacataagctcttgggaggacgtgccttatctgggcaaacgggaagaccagtggtgcggctccttgatcgggctgacggcaagggctacatgggccaccaatattcaagtcgcgatcaaccaggtgcgaagactcattggaaatgagaactaccttgattacatgacaagtatgaagcggtttaaaaatgaaagcgacccagagggtgctctgtggtga

SEQ ID NO: 13632 - RNA, 9879 nt, synthetic construct
  misc_feature 1..9879: note = derived and/or modified CDS sequence (opt3) from DENV-1__FJ410198__SS-prME
  source 1..9879: mol_type = other RNA
agcgtgaccatgctgctcatgcttatgcccacggccctggctttccacttgactacgagaggaggggagcctcatatgatcgtctccaagcaggaaagaggaaaatctttactgtttaagacctcagccggtgttaatatgtgcacactgattgccatggacctcggcgagctgtgtgaagatactatgacctacaaatgcccacggattacagagaccgaaccggacgatgtggactgttggtgcaatgcgactgatacatgggtgacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccggtagcttcaaactggagaaggaagtcgccgagacgcagcacggaacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattgtgatcggtgccggggaaaaagctctgaagctctcctggttcaagaaaggctcaagtatcggaaagatgtttgaggccaccgcaagaggcgccaggcggatggctattctgggggatacagcctgggacttcggaagcatcggtggcgtttttacgtccgtggggaaacttgtccatcagattttcggaaccgcatacggcgtgctgttttctggtgtaagctggactatgaagatagggatcggcgtgttgctcacatggctgggattaaattcacgaagtacctccctgagcatgacatgtattgcggttggcctagtcactctctacctgggggtgatggtgcaggctgattctggatgcgtcatcaactggaaaggccgcgaacttaagtgtggttcagggatcttcgttaccaatgaggtgcacacgtggacagaacaatataagtttcaggccgacagtccgaaaagattgagcgcagccattggaaaggcttgggaggagggcgtgtgcggtataaggtccgccacccggctggaaaacatcatgtggaaacagatttctaacgagctcaatcatatcctgttagaaaacgacatgaagttcactgtagtcgtgggcgatgttgcagggattctggctcagggcaaaaagatgatccgccctcaacccatggagtacaaatattcgtggaaaagctggggcaaggccaagataatcggggcggacgtgcagaataccacatttattatcgatggaccaaacactcctgaatgtcccgacgatcagagagcctggaatatttgggaggtcgaggactacggcttcggtatctttaccacaaacatatggcttaagttgagggattcctatacacaggtgtgcgaccaccgtctcatgtcagctgcaattaaagatagtaaggccgttcacgctgacatggggtactggatcgaatctgagaaaaatgaaacctggaagctggcccgggcatccttcattgaggtgaagacttgtatctggccaaaatcccatacactatggtcaaacggagtactggaaagcgagatgataatccccaagatttatggcggtcctatctctcaacacaattaccgaccaggctacttcacccagactgcggggccgtggcatctcggaaaactggagcttgattttgacttgtgcgaaggcacaaccgtcgtggtggatgagcactgcgggaacagaggaccctccctgaggacgactaccgtcacaggcaagattatccacgaatggtgttgccgcagttgtaccttacctccactccggttcagaggtgaggacgggtgctggtatggaatggagataaggcccgttaaagaaaaggaggaaaatctggtaaagagcatggtatctgccggctccggtgaggtggactcatttagtcttggcctgttgtgtattagcatcatgatcgaagaggtcatgcgctcgcgatggtcccggaaaatgctcatgactgggacactggctgtgttctttctactgattatgggacagctcacctggaacgatctgatccgtctttgcattatggttggcgccaatgcatctgacagaatggggatgggaacaacttacttggctctgatggccaccttcaagatgaggcctatgtttgcagtgggcttactcttccgccggctgacgagcagagaggtccttctgctaacaataggtctctcactggtggccagtgttgaattgccaaactccctggaggaattaggggatggactcgctatgggcatcatgattctgaaacttctgaccgactttcaatctcatcagttgtgggcgactctcctgagcctaaccttcatcaagacaactttttccctgcactatgcctggaaaaccatggcaatggtgctttcaattgtcagcctcttccccctgtgtttgagtacgacatctcagaagaccacttggctgccggtattactcggctccctggggtgcaagcctcttacaatgtttctgatcgctgagaataaaatatggggaaggcgaagctggccattgaacgaaggtatcatggccgtgggcattgtttcgatcctcctgtcatctctactgaagaacgatgtgccccttgccgggcctctcattgctggaggcatgctgatcgcatgttacgtcataagtggttccagcgccgacttgtctttagagaaagcggctgaggtgagctgggaagaggaagccgagcattccggggcatcacacaatattctggtagaagtgcaggatgacggaaccatgaagatcaaagatgaggagcgcgacgatactctcacaatcctgcttaaggccaccctgttggctgtcagtggcgtttatcccctaagcattccagcaacgctgttcgtgtggtacttctggcagaaaaagaagcagcggtctggcgtgctctgggacactccttcacccccagaagtcgggagagccgtgctggatgacggaatatataggatcatgcagcgtggtcttttaggccgcagccaggttggggtaggagtgtttcaagagaacgtcttccataccatgtggcacgtgacacggggcgcggttctgatgtaccagggtaaaagactcgaaccgagttgggctagcgtgaagaaagacttgatttcctacgggggaggctggaggctgcagggctcttggaataccggggaggaggtccaggtgatcgccgtagaacctggaaagaaccccaaaaatgtccaaacagcaccaggtacttttaagacccccgagggcgaagtgggggccattgctctcgatttcaagcctggaacgtcgggcagcccaatcgttaaccgagagggtaaaatagtggggctgtatggaaatggcgtcgtgacaacttcaggcacctacgtttccgccatcgcacaggctaaggccagtcaggaagggccccttcctgagattgaggacgaagtgtttcggaaacgcaacctgacaatcatggatttgcacccgggatctggtaagaccagaaggtatctaccagcgattgtccgggaggccatcaaacgaaagctgagaactctcatattagcacccacccgcgtggtagctagcgaaatggccgaggctctgaagggcatgcctattaggtaccaaacaacggcagtgaaatccgaacatactgggaaggagatcgttgaccttatgtgccacgccaccttcacaatgcgtctgctctcaccagtccgggtgcccaattataacatgatcattatggatgaggcccattttaccgacccttctagcatcgctgcgagaggatacataagtactagggtgggcatgggtgaagcagccgctattttcatgacagccaccccgcccgggtccgtcgaggcatttccacagagcaatgccgtaatccaggatgaggaacgcgacattcctgaacgatcttggaactcaggatatgagtggatcacggatttccccggcaaaactgtgtggtttgttccatccataaagagtggcaatgacattgctaactgtttgaggaaaaatgggaagcgggtgatccagctgagcaggaagacattcgataccgagtaccagaaaaccaagaacaacgactgggactacgtcgtgactacagatatctcggaaatgggagcgaatttccgcgccgaccgtgttattgatcctagacggtgcctcaaacccgtgatcctgaaggacggtccagagagggtcattcttgcaggcccgatgcctgtgaccgtagcttctgccgcacagcgccgagggagaataggacggaaccacaataaagaaggcgatcagtatatctacatgggtcagcccctaaacaatgacgaggatcatgcccactggacagaggctaagatgctgttggacaacattaatactccagaagggatcatccccgccttatttgagcctgaaagggagaagtccgcggcaattgatggcgaatatcgcctgagaggagaggccaggaaaacgttcgtggagctcatgcggcgtggcgacctgccagtttggcttagctacaaggtcgcttcagaagggtttcaatatagtgatcgccgatggtgcttcgacggagagagaaacaatcaggtgctggaagagaacatggatgtggaaatatggaccaaagagggtgagaggaagaaactccggccccgctggttggacgccagaacatactctgaccctctggctctaagggaatttaaggagttcgcagccggccggcgatccgtcagcggggatctgatcctcgaaattggaaaacttccgcagcacctgactcagagagctcaaaatgccttagacaacttggttatgctgcataattcagagcagggcggtcgcgcatataggcacgcgatggaggaactcccagataccatcgagacactgatgcttctggccctcattgctgtgttgaccgggggcgtaactctgtttttcttaagtggacggggcctagggaagacgagcatcggactgctctgtgtgatggcctcctctgtccttctgtggatggcaagcgtggaaccccattggatagctgcctccatcattttggagtttttcctgatggttctcctgatccctgaacccgaccgtcagagaaccccacaggataaccaacttgcatacgtggtcattggtctcctgtttatgatcttgacagtagccgctaatgagatgggcctgttagagactaccaagaaagacctagggataggacacgtggcggttgaaaaccaccatcacgccacaatgctggatgtggacctccatcctgcatcagcttggaccctttacgccgtcgccactacaattatcacgcccatgatgaggcacaccattgagaacactacagcaaatatctctctgaccgctatagccaaccaggcggctatcttgatgggcctggataagggttggccaattagtaaaatggacatcggggtgcctctcctggcccttggctgctattcgcaggtcaatccgttaaccctgacagcagccgtgctcatgttggttgctcattacgcaattatcggacccggcctgcaagccaaggcgactcgcgaagctcagaaacggacggccgcagggataatgaagaacccaaccgtggatggaattgtagccatcgacctagatcctgtggtctatgacgctaagttcgagaaacagctgggccagatcatgctccttattctgtgtacaagccaaatcttgctgatgcgaactacctgggccctctgcgaatccataacactggcaaccggtcccttaactacgctttgggaggggtctccaggaaagttttggaatacaaccattgctgtttcaatggccaacatcttcagaggcagctacctggcgggtgccggcctcgcattctccctaatgaaaagtctagggggaggcaggcgcgggactggagctcagggcgagaccttgggtgaaaagtggaaacggcagctgaatcagctctctaagagcgagtttaacacatataagagatcagggattatggaagtggaccgttccgaggccaaagaaggacttaagaggggcgagactaccaaacacgcagtcagtcggggtacagctaagctgcgctggttcgtggagcgaaatttggtaaaacctgaaggcaaggtgatcgatctggggtgtggaagaggcgggtggagctactattgcgccggactcaagaaagttacggaggtgaagggctacaccaaaggtgggcccggacacgaggagccgataccaatggccacttacggctggaacttagtcaagctgcattctggcaaagacgtgtttttcatccctcccgaaaagtgtgatacacttctgtgcgacattggggagtcctcaccaaatcccaccatcgaggaaggaaggactctacgggtcctcaaaatggtggagccttggctgcgcggtaaccaattttgtattaagatcttgaatccgtatatgcccagcgttgtagaaacactggagcagatgcagagaaagcacggcgggatgctcgtgaggaacccactttcgcgaaattctacccatgagatgtactgggtcagttgcggaacgggcaacattgtgtccgcggttaatatgaccagccggatgctgttaaaccgtttcacaatggctcacagaaaacctacttatgaacgcgatgtggacctgggtgcagggaccaggcacgtcgccgtggagcccgaagtagctaacttggatatcataggacagcggattgagaatatcaagcatgaacacaaatcaacatggcattacgacgaggataacccttataagacttgggcctaccacggctcctatgaggtgaaaccatctggcagcgcaagttccatggttaatggggtcgtgaagctcctgaccaagccctgggacgtgatccctatggtcacacaaattgccatgaccgatactacgccatttggacagcagagagttttcaaagaaaaggtggacacacgcacccccaaagctaagaggggtactgcgcaaataatggaggtaaccgccaaatggctatggggctttcttagccgaaacaagaagccgcggatctgtacaagagaagagttcacgaggaaagtgcgctctaatgcagctattggggccgtctttgtggacgaaaaccagtggaactcagcaaaggaggccgttgaggatgaacgtttctgggacctggtgcatcgggagagagaactccacaaacagggaaagtgcgctacctgcgtctacaacatgatgggcaaaagggagaagaagctgggtgaatttgggaaagccaagggaagtcgcgcgatctggtacatgtggttgggcgcacgattcctggagttcgaggccctcggctttatgaatgaagatcactggttctcccgggagaacagcctttctggggtggaaggagagggtctgcataaattaggctatattctgagagacatctcgaatatacctgggggaaacatgtacgctgatgacactgccggctgggatacaaggatcaccgaggacgatttgcagaatgaagcacgcattactgacatcatggagccagaacacgctctcctggccaagtcaatttttaaactaacatatcaaaacaaggtagttagagtgcagcggcccgctaaaaatggtaccgtcatggatgtgatcagcaggcgtgaccagcgagggtccggacaggtgggcacatacggccttaacactttcaccaacatggaggcccaactgatacgccagatggaaagtgaggggatattttctcctagcgagctcgaaacgccaaatctggcagagagagtcttggattggttagaaaagtatggagttgagcggctgaagaggatggcgatctccggtgacgactgtgtggtaaaacccatcgatgaccgcttcgccaccgctctcacagcccttaacgatatgggcaaggtgagaaaagacattccgcagtgggaaccttcaaaggggtggaatgattggcagcaagtccccttttgcagtcatcacttccaccagctgataatgaaagacggacgggagatcgtggttccatgtaggaaccaggatgagctagtgggccgagcacgtgtctctcagggtgctgggtggagcctgagagaaactgcctgcctcggaaagtcctacgcacaaatgtggcagttgatgtattttcatcgccgggacctgaggcttgccgcgaatgctatttgttcagccgtgcctgtagattggatccccaccagcagaacaacttggtctattcacgcacatcaccagtggatgaccacggaggacatgctgtccgtttggaaccgcgtgtggatcgaagagaatccatggatggaagataagacacatataagtagctggggcgacgtcccctacctcggcaaacgggaggaccaatggtgcgggtcgttaatcggactgaccgccagggctacttgggccacaaacattcaggtggcaatcaatcaggttcgaagattgattggtaacgagaattacctggattatatgacctccatgaagcggttcaaaaacgaatctgaccctgagggcgctctctggtga

SEQ ID NO: 13633 - RNA, 9879 nt, synthetic construct
  misc_feature 1..9879: note = derived and/or modified CDS sequence (opt3) from DENV-1__FJ410199__SS-prME
  source 1..9879: mol_type = other RNA
agcgtgaccatgctgctcatgcttatgcccaccgcactggctttccacttgactacgagaggcggggaacctcatatgatcgtctccaagcaggaaagggggaaatctttactgtttaagacctcagccggtgttaacatgtgcacactaattgccatggacctcggcgagttctgtgaagatactatgacctacaaatgcccacggataacagaagcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaggacgcaaactttgtttgccgccgaacattcgtggatagaggctggggtaatgggtgtggactgtttggcaaaggctccttgataacttgcgctaagttcaagtgcgtaaccaaactcgaggggaagacagtgcagtacgaaaacctgaaatattcagtcattgtgaccgttcacactggagaccagcatcaagtgggtaatgagagtacggaacacggcacaaccgccactatcacaccccaggcgcctagcacagagattcagttaaccgactacggggccctgactctcgattgttctccaaggacaggacttgactttaacgaaatggtcctgttgacgatgaaggagaaatcctggctagtgcataagcagtggttcctggatctcccgctgccctggacctcaggcgcaagcacaagtcaagagacatggaatcggaaagaccttctggtaacctttaagacagctcacgccaagaaacaggaagttgtggtcttgggttctcaggagggggctatgcacactgccctcaccggcgcaacggaaatccaaacctccggaacaactaccatcttcgccggccatctgaagtgccgtttaaaaatggataagctgacactaaaagggatgagctatgtgatgtgtactggatcgttcaagctcgagaaggaagtcgctgagacccagcacggtacggtgctggttcagattaaatacgagggcacagacgcgccttgcaagataccattttctacccaggatgaaaaaggggtgactcaaaacggacgccttatcacagcaaatcccattgtaaccgacaaggagaaacctgtcaacatcgaagccgagccacccttcggcgagtcctatatagtgattggtgctggggaaaaggccttgaagctgtcatggtttaaaaagggcagtagcatcggaaaaatgttcgaggcaactgccagaggcgctaggcggatggccatcctcggggataccgcatgggactttggatccattggtggcgttttcacatctgtggggaagctggtccatcagatctttggaacggcgtacggcgtgcttttcagcggtgtatcatggaccatgaaaattgggataggcgtgctgttgacttggctcggactgaatagtcgatccactagcttatctatgacctgtatcgctgttggcctggtcacactatacctcggggtgatggtgcaggccgattcaggatgcgtcattaactggaagggccgcgaactgaagtgtggtagtgggatctttgttactaatgaggtgcacacctggacggaacagtataaattccaagcagacagcccgaagagactttccgccgctatcggaaaagcctgggaggagggcgtgtgcggtattaggtctgcaacacggttggaaaacataatgtggaagcagatctcgaacgagctgaatcatattctcctggaaaacgacatgaaatttaccgtagtcgtgggcgatgttgctgggatcttagcccagggaaagaaaatgattcgccctcagcccatggagtacaagtatagctggaagtcctggggcaaagcgaagatcataggggccgacgtgcaaaatactaccttcatcattgatggaccaaacacacctgaatgtcccgacgatcagagagcttggaatatctgggaggtcgaggactacggctttggtattttcactaccaacatctggctgaaacttagggattcatatacacaggtgtgcgaccaccgtttgatgagtgcagccataaaggattctaaagctgttcacgccgacatggggtactggattgaaagcgagaagaatgaaacgtggaagctcgcacgggcgtccttcatcgaggtgaaaacctgtatttggccaaagtcacatactctgtggagcaacggagtactagaatctgagatgatcatacccaaaaattatggcggtcctatctcccagcacaactaccgaccaggctactttacacaaaccgccgggccgtggcatctgggaaagctcgagctggatttcgacctttgcgaaggcactacagtcgtggtggatgagcactgcgggaatagaggacccagtttgaggaccacgactgtcaccggcaaaattatccacgaatggtgttgccgcagctgtacactgcctccattacggtttaagggtgaggacgggtgctggtatggaatggagattagacccgttaaggaaaaagaggaaaacctcgtgaagtctatggtatccgctggctcaggtgaggtggacagtttcagcctgggccttctgtgtatctcgataatgattgaagaggtcatgaggtcccgctggtctcgaaaaatgttgatgaccgggactctcgccgtgctgtttctactgatcatgggacagctcacatggagcgatctgatccggctttgcattatggttggcgcaaatgcttcagaccgtatggggatgggaaccacatacttggccctgatggcaactttcaagatgagacctatgtttgccgtgggcttactcttcaggcgcctgaccagtcgggaggtccttctgctaacgatcggtctctccctggtggcttctgttgaattgccaaacagcctggaggaattaggggatggactcgcgatgggcattatgatactgaaacttctgacagactttcagtcccatcaattgtgggccaccctcctgtcactaactttcatcaagaccacatttagcctgcactatgcatggaagactatggctatggtgcttagtattgtctctctcttccccctgtgtttgtccaccacgagccagaaaacaacctggctgccggtattactcggctcgctggggtgcaagcctcttactatgtttctgatcgccgagaataaaatttggggaagaaagtcatggccattgaacgaaggtatcatggccgtgggcatagtttctatcctcctgagttccctactgaaaaacgatgtgccccttgctgggcctctcattgcaggaggcatgctgatcgcctgttacgtcattagcggttctagcgcggacttgtccttagagaaggctgccgaggtgtcatgggaagaggaagcagagcatagtggggccagccacaatatcctggtagaagtgcaggatgacggaacaatgaaaataaaggatgaggagagggacgataccctcactattctgcttaaggctacactgttggcagtctctggcgtttatcccctatccatcccagccaccctgttcgtgtggtacttctggcagaaaaagaaacaacgatcaggcgtgctctgggacacgcctagtcccccagaagtcgagcgcgcggtgctggatgacgggatctatcggattatgcagagaggacttttaggtaggagccaggttggcgtaggggtgtttcaggaaaacgtcttccatactatgtggcacgtgacccgtggagctgttctgatgtaccaaggcaagcgcctcgagccgtcctgggcctctgtgaaaaaggacttgatatcgtacggtgggggatggcggctgcagggcagctggaatacaggcgaggaagtccaggtgatcgcagtagagcctgggaagaaccccaaaaatgtccagaccgccccaggaacatttaagacttcagaaggtgaggtgggcgctattgccctcgatttcaaacccgggacctccggaagtcctatcgttaacagagaaggcaagattgtgggtctgtatgggaatggagtcgtgacgacatctggcacttacgttagcgcaatcgctcaagccaaagcgtcccaggagggcccacttcccgagatagaagacgaggtgtttaggaagcgaaacctgaccatcatggatttgcaccctgggtcaggaaagacacggaaatatctaccggccattgtccgcgaagcaatcaagagaaaactgaggaccctcattttagctccaactcgggtggtagcctctgagatggctgaagcactgaagggtatgcccatccgataccagaccacagccgtgaaaagcgagcatacgggcaaggagatagttgaccttatgtgccacgccactttcaccatgagactgctcagtcctgtccgcgtgccaaattataacatgattatcatggatgaagctcattttacagacccctccagcatcgcggcaagggggtacatttctacccgtgtgggaatgggcgaggccgctgccatcttcatgactgcaacacctccgggttcagtcgaagcctttccccaatccaatgctgtaatacaggatgaggaacgggacattccagagagaagttggaacagcgggtatgagtggatcaccgatttccctggaaagacggtgtggtttgttccctcgattaaatctggcaatgacatcgcgaactgtttgaggaagaatggcaaacgcgtgatacagctgtcccgaaagactttcgatacagaataccagaaaaccaagaacaacgactgggactacgtcgtgaccactgatattagcgagatgggggccaatttcagagcagaccgggttatcgatccaaggcgctgcctcaagcctgtgatcctgaaagacggacccgaacgtgtcattcttgctggtccaatgccggtgacagtagcctcagcagcccaaagacggggcaggatcgggcgcaaccacaataaggagggagatcagtatatttacatgggccagcctctaaacaatgacgaggatcatgctcactggaccgaagccaaaatgctgttggacaacataaatacacccgagggtatcattccagcgttatttgaacccgagcgagaaaagagtgcagccatcgatggggagtatagactgcggggcgaggctaggaaaactttcgtggaactcatgcgcagaggagacctgcctgtttggctttcttacaaggtcgcctccgagggctttcagtatagcgataggcggtggtgcttcgacggggaacgtaacaatcaagtgctggaggaaaacatggatgtggagatctggacgaaagagggagaacgcaagaagctccgaccaagatggttggacgctaggacctactcagaccccctggcactacgggagtttaaagagttcgccgctggtcgcagaagtgtcagcggcgatctgattctcgagatagggaaacttcctcagcacctgacacagagggcccagaatgcattagacaacttggttatgctgcataattccgaacaaggaggccgggcgtatcgacacgccatggaggagctcccggatactatcgaaaccctgatgcttctggctctcattgccgtgttgacaggtggggtaaccctgtttttcttatctggcagaggactaggcaaaactagcatcgggctgctctgtgtgatggcatcctcagtccttctgtggatggcttctgtggagccacattggattgccgcaagtatcatattggaatttttcctgatggttctcctgatccccgagcctgaccgccagaggacgccccaggataaccagcttgcctacgtggtcattggactcctgtttatgatcttgaccgtagctgcgaatgagatgggtctgttagaaacaactaagaaagacctaggcattgggcacgtggccgttgagaaccaccatcacgcagctatgctggatgtggacctccatccagcctcggcctggaccctttacgcagtcgctacaaccatcataactcctatgatgcggcacacaattgaaaacacgaccgccaatatcagcctgactgcgattgctaaccaagccgcaatcttgatgggactggataagggctggcccatatccaagatggacatcggtgtgccactcctggcccttgggtgctattctcaggtcaatcctttaacactgaccgctgcagtgctcatgttggttgcccattacgcgattatcggcccgggactgcaggctaaagccacccgtgaggcacaaaagagaacagccgctggcattatgaaaaaccccactgtggatgggatcgtagccatagacctagatccagtggtctatgacgcaaagttcgaaaaacagctgggacagattatgctccttatcctgtgtacgtcacagatcttgctgatgaggaccacatgggctctctgcgagagcattactctggccaccggccctttaacaaccctttgggagggttcccccgggaagttttggaatactacgatcgcggttagtatggccaacatattccgcggatcttacctggcaggcgctggtctcgccttcagcctaatgaagtcactgggcgggggacggcgaggcacaggggcacaaggagaaaccttgggcgagaaatggaagagacagctgaatcagctctccaaaagtgaatttaacacttataagaggagcggtattatggaggtggaccgctctgaagctaaagaggggcttaagcggggagagaccacaaagcacgccgtctccagaggcactgccaaactgcgttggttcgtggaaaggaatttggtaaagccagagggtaaagtgatcgatctgggctgtgggcggggaggctggtcatactattgcgcggggctcaagaaagttaccgaagtgaagggatacacaaaaggcggtcctgggcacgaggaacccattccgatggctacgtacggatggaacttagtcaagctgcatagcggcaaggacgtgtttttcatcccacctgagaaatgtgatacccttctgtgcgacataggcgagtcgtctcccaatccaactatcgaagaggggcgcacactacgagtcctcaagatggtggaaccctggctgagaggaaaccagttttgtattaaaatcttgaatccttatatgccgagtgttgtagagaccctggagcaaatgcagaggaagcacggtggcatgctcgtgcggaaccccctttcccgcaatagcactcatgaaatgtactgggtctcatgcgggacaggaaacattgtgtccgcagttaatatgacctctagaatgctgttaaacaggttcacgatggcccaccgaaaaccaacctatgagcgggatgtggacctgggcgctggtacacgtcacgtcgccgtggaacctgaggtagcaaacttggatatcattgggcagagaatcgaaaatataaagcatgagcacaagagcacttggcattacgacgaggataacccctataaaacctgggcctaccacggaagttatgaagtgaagccttccggcagcgcttcttcaatggttaatggcgtcgtgaaactcctgacaaagccatgggacgtgattcccatggtcactcagatcgcgatgaccgatacaaccccttttgggcaacagcgcgttttcaaagagaaggtggacactaggacgccaaaggccaaacggggaacagcacagatcatggaagtaaccgctaagtggctatggggttttcttagtagaaacaaaaagccccgcatttgtactagggaggagttcacccgaaaagtgcggtccaatgccgcaataggcgccgtctttgtggacgagaaccaatggaatagcgctaaggaggccgttgaagatgagagattctgggacctggtgcatagggaacgcgagctccacaagcaggggaaatgcgcgacatgcgtctacaacatgatgggaaagcgtgagaagaagctgggcgagtttggtaaagcaaaggggtctcgggccatctggtacatgtggttgggagctagattcctggagttcgaagccctcggctttatgaatgaggatcactggttctcgagggaaaactcacttagcggcgtggagggggagggactgcataaattaggttatattctgcgcgacatctccaagattccgggcgggaatatgtacgcagatgacacggctggatgggatacccgaatcactgaagacgatttgcagaacgaggccaagataacagacatcatggaacctgagcacgctctcctggccaaaagtatttttaagctaacctatcagaataaagtagttcgggtgcaaagaccagcaaagaacggcactgtcatggatgtgatctctaggcgcgaccagagaggtagcggacaggtgggaacatacggccttaataccttcacaaacatggaagcgcagctgattcggcaaatggagtccgagggcatcttttcacccagtgaactcgagactcctaacctggccgggagggtcttggattggttagaaaaacatggagttgagcgtctgaagcgaatggctatatctggtgacgactgtgtggtaaagccaattgatgaccgcttcgccaccgcactcacggctcttaatgatatgggcaaagtgagaaaggacatcccccagtgggaaccgagcaaagggtggaacgattggcagcaggtccctttttgctcccaccacttccatcaactgatcatgaaggacggacgggagattgtggttccctgtaggaatcaggatgagctagtgggccgcgccagagtctcacagggtgcagggtggagcctgcgggaaaccgcctgcctcggaaaatcttatgcgcagatgtggcaattgatgtactttcacaggcgagacctgcgtcttgctgccaacgcaatatgttccgccgtgccagtagattgggttcctacaagtagaactacctggagcatccatgctcaccatcagtggatgacaactgaggacatgctgtcggtgtggaatcgcgtctggattgaagagaacccctggatggaagataagacccacatctcctcttggggcgacgtgccatatctcggcaagcgggaggaccagtggtgcgggtcattaattggactgacggccagggcaacatgggctaccaatatccaagttgccataaaccaggtgagacgcttgatcggtaatgagaactacctggattacatgactagcatgaaacggttcaagaatgaaagtgaccccgagggcgcgctctggtga

SEQ ID NO: 13634 - RNA, 9879 nt, synthetic construct
  misc_feature 1..9879: note = derived and/or modified CDS sequence (opt3) from DENV-1__FJ432739__SS-prME
  source 1..9879: mol_type = other RNA
agcgtgaccatgctgctaatgcttatgcccaccgcactggctttccacttgactacgcgaggcggggaacctcatatgatcgtctccaagcaggaaaggggaaaatctttactgtttaagacctcagccggtgttaacatgtgcaccctgattgccatggacctcggcgagttctgtgaagatactatgacctacaaatgcccacggataacagaagcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaagacgcaaactttgtttgccgccgaacattcgtggatagaggctggggtaatgggtgtggactgtttggcaaaggctccttgataacttgcgctaagttcaagtgcgtaaccaaactcgaggggaagacagtgcagtacgaaaacctgaaatattcagtcattgtgaccgttcacactggagaccagcatcaagtgggtaatgagagtacggaacacggcacaaccgccactatcacaccccaggcgcctagcacagagattcagttaaccgactacggggccctgactctcgattgttctccaaggacaggacttgactttaacgaaatggtcctgttgacgatgaaggagaaagcatggctagtgcataagcagtggttcctggatctcccgctgccctggacctccggcgcttcaactagccaagagacatggaatcggaaagaccttctggtaacctttaagacagcccacgctaagaaacaggaagttgtggtcttgggtagtcaggagggggccatgcacactgcactcaccggcgccacggaaatccaaacctctggaacaactaccatcttcgctggccatctgaagtgccgtttaaaaatggataagctgacactaaaagggatgtcctatgtgatgtgtactgggagcttcaagctcgagaaggaagtcgcggagacccagcacggtacggtgctggttcagattaaatacgagggcacagacgcaccttgcaagataccattttcgacccaggatgaaaaaggggtgactcaaaacggacgccttatcacagccaatcccattgtaaccgacaaggagaaacctgtcaacatcgaagctgagccacccttcggcgagtcttatatagtgattggtgccggggaaaaggcattgaagctgtcctggtttaaaaagggctcaagtatcggaaaaatgttcgaggccactgctagaggcgccaggcggatggcaatcctcggggataccgcgtgggactttggaagcattggtggcgttttcacatccgtggggaagctggtccatcagatctttggaacggcttacggcgtgcttttctctggtgtaagctggaccatgaaaattgggataggcgtgctgttgacttggctcggactaaattcacgaagtacatccttaagcatgacctgtatcgccgttggcctggtcacactatacctcggggtgatggtgcaggcagattctggatgcgtcattaactggaagggccgcgaactgaagtgtggttcagggatctttgttactaatgaggtgcacacctggacggaacagtataaattccaagccgacagtccgaagagacttagcgctgccatcggaaaagcatgggaggagggcgtgtgcggtattaggtccgctacacggttggaaaacataatgtggaagcagatctctaacgagctgaatcatattctcctggaaaacgacatgaaatttaccgtagtcgtgggcgatgttgccgggatcttagcgcagggaaagaaaatgattcgccctcagcccatggagtacaagtattcgtggaaaagctggggcaaagccaagatcataggggctgacgtgcaaaatgcaactttcatcattgatggaccaaacacccctgaatgtcccgacgatcagagagcctggaatatctgggaggtcgaggactacggctttggtattttcacaactaacatctggctgaaacttagggattcctatacccaggtgtgcgaccaccgtttgatgtcagctgccataaaggatagtaaagcagttcacgcggacatggggtactggattgaatctgagaagaatgaaacatggaagctcgcccgggctagcttcatcgaggtgaaaacgtgtatttggccaaagtcccataccctgtggtcaaacggagtactagaaagcgagatgatcatacccaaaatctatggcggtcctatttctcagcacaattaccgaccaggctactttactcaaacagccgggccgtggcatctgggaaagctcgagctggatttcgacctttgcgaaggcaccactgtcgtggtggatgagcactgcgggaacagaggaccctccttgaggacaaccacggtcactggcaaaatcattcacgaatggtgttgccgcagttgtaccctgcctccattacggtttaagggtgaggacgggtgctggtatggaatggagatcagacccgttaaggaaaaagaggaaaatctcgtgaagtccatggtatctgcaggctccggtgaggtggactcattcagtctgggccttctgtgtataagcattatgatcgaagaggtcatgaggtcgcgctggtcccgaaaaatgttgatgacagggatcctcgctgtgtttttcctgctaattatgggacagctgacctggaacgatctcatccggctgtgcattatggttggcgccaatgcatctgaccgtatggggatgggaactacataccttgccttgatggctacctttaagatgagacctatgttcgcggtgggcctgttatttaggcgcctcacaagccgggaggtcctgcttctgactataggtctatcactcgtggccagtgttgaactgccaaactccttggaggaactgggggatggattagcaatgggcatcatgattctcaaactgcttaccgacttccagtctcatcaactgtgggctacgttgctcagcctgacatttatcaagaccactttctccctacactatgcctggaagaccatggccatggtgctgtcaattgtcagcctttttcccctctgtctgagtacaacttctcagaaaaccacgtggttgccggtactgttaggctccctcgggtgcaagcctctgacaatgttccttatcgctgagaataaaatatggggaagaaagagctggccactgaacgaaggtatcatggcagtgggcattgtttcgatcttgctctcatctctgctcaagaacgatgtgcccctggccgggcctcttattgcgggaggcatgctcatcgcttgttacgtcataagtggttccagcgccgacctgtctttggagaaggcagccgaggtgagctgggaagaggaagctgagcattccggggcatcacacaatattttagtagaagtgcaggatgacggaaccatgaaaatcaaggatgaggagagggacgatactctgacaatcctcctgaaggccacccttctggcggtcagtggcgtttatcccttgagcattccagctactctattcgtgtggtacttttggcagaaaaagaaacaacgatctggcgtgctgtgggacacaccttcacccccagaagtcgagcgcgccgtgctcgatgacgggatatatcggatcatgcagagaggactgcttggtaggagccaggttggcgtaggggtgttccaggaaaacgtctttcataccatgtggcacgtgacgcgtggagcagttttaatgtaccaaggcaagcgcctggagccgagttgggccagcgtgaaaaaggacctcatttcctacggtgggggatggcggttgcagggctcttggaatactggcgaggaagtccaggtgatcgctgtagagcctgggaagaaccccaaaaatgtccagaccgccccaggaacattcaagacctcggaaggtgaggtgggcgcaattgctctggattttaaacccgggacaagcggatcacctatcgttaacagagaaggcaagatagtgggtctctatgggaatggagtcgtgactacctccggcacgtacgttagtgccatcgcgcaagccaaagcatctcaggagggcccactgcccgagattgaagacgaggtgttcaggaagcgaaaccttacaatcatggatctgcaccctgggagcggaaagactcggcgctatttgccggctattgtcagagaagccatcaaaaggaagctacggaccctgatactcgctccaacacgagtggtagcatccgagatggccgaagccttaaaaggtatgcccattagataccagaccactgctgtgaagtcagagcataccggcaaagagatcgttgacctgatgtgccacgcgacatttacgatgcgccttctgtctcctgtcagggtgccaaattataacatgatcattatggatgaagcacatttcactgaccccagcagtatcgccgctcgtgggtacatatccacccgggtgggaatgggcgaggccgcagccatttttatgacagctacccctccgggtagcgtcgaagcgttcccccaatctaatgccgtaatccaggatgaggaaagagacattccagagaggtcatggaactccgggtatgagtggatcactgattttcctggaaagacagtgtggttcgttcccagtataaagagcggcaatgacattgcaaactgtctccgcaaaaatggcaagcgagtgatccagttgtcgagaaaaaccttcgatacggaataccagaagactaaaaacaacgactgggactacgtcgtgacaaccgatatctctgagatgggggctaattttcgggccgacagggttattgatccacgccgttgcctgaagcctgtgatcctcaaggacggacccgaaagagtcattctggcaggtccaatgccggtgaccgtagcctccgctgcccaacggaggggccgcatagggcgaaaccacaataaagagggagatcagtatatctacatgggccagcctcttaacaatgacgaggatcatgcgcactggactgaagcaaagatgctactggacaacattaatacacccgagggtatcatcccagccttgttcgaacccgagagagagaaaagcgctgccattgatggggagtatcggttaaggggcgaggctcgcaagacctttgtggaactgatgagaaggggagacctccctgtttggctgtcatacaaagtcgcaagtgagggcttccagtattctgatcggcgttggtgctttgacggggaacgcaacaatcaagtgcttgaggaaaacatggatgtggagatatggacaaaggagggagaaagaaagaagctgagaccaaggtggctcgacgcccggacttactccgaccccttggctctgcgcgagttcaaggaatttgccgcaggtagaaggagcgtctcaggcgatctaatcctggagattgggaaactccctcagcaccttacgcagcgggcgcagaatgccctggacaacttagttatgttgcataatagtgaacaaggaggccgagcttatagacacgccatggaggagctgccggataccatcgaaacactcatgctgcttgcactgattgctgtgctcactggtggggtaaccttgttctttctgagcggccgcggattaggcaagacatccatcgggctactgtgtgtgatggcctctagcgtcctcctttggatggcatccgtggagccacattggatagccgcttcaatcattctggagttctttttgatggttctgctcatccccgagcctgacaggcagcggacaccccaggataaccagctggcgtacgtggtcattggacttctcttcatgatcctgactgtagccgcaaatgagatgggtttgctggaaacgaccaaaaaggacttaggcatagggcacgtggctgttgagaaccaccatcacgccgccatgctagatgtggacctgcatccagcatctgcttggacactctacgccgtcgcgactaccattatcacacctatgatgcgtcacaccattgaaaacactacagctaatatcagtcttacggccatagcaaaccaagccgctatcctgatgggattggataaaggctggcccatttcgaagatggacatcggtgtgccactgctcgcactggggtgctatagccaggtcaatcctcttaccttaactgccgcggtgctgatgctcgttgctcattacgccattatcggcccgggattgcaggcaaaggccacaagagaggctcagaaaaggaccgccgcaggcataatgaagaaccccaccgtggatgggattgtagctatcgacctggatccagtggtctatgacacaaaatttgaaaagcagctaggacagatcatgctgctcattctttgtacttcccagatcctgttgatgcgcacgacctgggccctgtgcgagtctataacactcgcgactggccctctgaccacattatgggagggttcacccgggaaattctggaataccactattgccgttagcatggcaaacatcttccggggatcctaccttgctggcgccggtctggcatttagtctcatgaagtctctaggcgggggacgaagaggcacgggggctcaaggagaaacactgggcgagaagtggaaaaggcagttgaatcagctgagcaagtcagagttcaacacctataaacgctccggtattatggaggtggaccggagtgaagccaaggaggggctcaaaagaggagagactaccaagcacgccgtcagccgtggcacagcgaaacttaggtggtttgtggaacggaatctggtaaaaccagagggtaaggtgatcgatttgggctgtgggcgcggaggctggtcttactattgcgctgggctgaaaaaggttactgaagtgaaaggatacaccaagggcggtcctgggcacgaggaacccataccgatggcaacatacggatggaacctcgtcaaattacattccggcaaggacgtgttctttatcccacctgagaagtgtgatacgctgctttgcgacattggcgagtcaagccccaatccaaccatcgaagaggggcgaactctgagagtcctaaaaatggtggaaccctggctcaggggaaaccagttctgtattaagatcctgaatccttatatgccgtcggttgtagagacattggagcaaatgcagcggaaacacggtggcatgctggtgcgcaaccccctctctagaaatagtacccatgaaatgtactgggtctcctgcgggactggaaacattgtgagcgccgttaatatgacatcaaggatgcttctgaaccgatttaccatggctcaccggaagccaacgtatgagcgtgatgtggacttaggcgccggtaccagacacgtcgcagtggaacctgaggtagccaacctggatatcatagggcagcgcattgaaaatatcaaacatgagcacaagtccacatggcattacgacgaggataacccctataagacttgggcttaccacggatcttatgaagtgaaacctagcggcagtgcgtccagcatggttaatggcgtcgtgaagttgctcaccaaaccatgggacgtgatccccatggtcacacagattgccatgactgataccacacctttcgggcaacagagggtttttaaggagaaagtggacacccggactccaaaggcaaagagaggaacggctcagataatggaagtaacagccaaatggctgtggggtttcctatctcgcaacaagaaacccaggatctgtacccgagaggaatttactcggaaggtgagatcaaatgcagccattggcgctgtcttcgtggacgagaaccaatggaatagtgccaaagaggcggttgaagatgagaggttttgggaccttgtgcatcgcgaacgtgagctgcacaagcaggggaagtgcgcaacctgcgtctacaacatgatgggaaaacgggaaaagaaactcggcgagttcggtaaggccaaagggtccagagctatctggtacatgtggctgggagccaggttcttggagtttgaagcactgggcttcatgaatgaggatcactggtttagccgcgaaaactctctctcgggcgtggagggggagggacttcataagctgggttatattttacgagacatctcaaaaataccgggcgggaatatgtacgctgatgacacagccggatgggatacgcggatcaccgaagacgatctgcagaacgaggctaagattactgacatcatggaacctgagcacgccttgctcgcaaagagcattttcaaactgacatatcagaataaggtagttagagtgcaaaggccagcgaaaaacggcaccgtcatggatgtgatctcccgcagagaccagcggggtagtggacaggtgggaacttacggcctaaatacatttaccaacatggaagcccagcttataaggcaaatggagtctgagggcattttcagcccctccgaactggagacacctaacctcgctgggcgtgtcctggattggttggaaaagcatggagttgagcgattaaaacgcatggccatctcaggtgacgactgtgtggtaaagccaatcgatgacagatttgcaactgctctgaccgccctcaatgatatgggcaaggtgcggaaagacattccccagtgggaaccgagtaaggggtggaacgattggcagcaggtccctttctgctctcaccactttcatcaacttataatgaaagacggaagggagatcgtggttccctgtcgcaatcaggatgagctggtgggcagagcacgggtcagccagggtgccgggtggtccctaagggaaacggcgtgcctgggaaagtcatatgctcagatgtggcaactcatgtacttccaccgacgtgacttgagactggccgcaaacgccatttgtagcgctgtgccagtagattgggttcctacctctcgcacaacttggtccatccatgcccaccatcagtggatgaccacagaggacatgcttagtgtgtggaatcgggtctggattgaagagaacccctggatggaagataaaactcacatcagctcgtggggcgacgtgccatatctgggcaagagggaggaccagtggtgcgggtccctcataggattaaccgcaagagctacgtgggccacaaatatccaagttgcgattaaccaggtgcgccggctgatcggtaatgagaactacttggattacatgacctctatgaagaggtttaaaaatgaaattgaccccgagggcgctctgtggtga

SEQ ID NO: 13635 - RNA, 9879 nt, synthetic construct
  misc_feature 1..9879: note = derived and/or modified CDS sequence (opt3) from DENV-1__FJ410201__SS-prME
  source 1..9879: mol_type = other RNA
agcgtgaccatgctgctcatgcttatgcccacagcactggctttccacttgactacgagaggaggggaacctcatatgatcgtctccaagcaggaaaggggaaaatctttactgtttaagacctcagccggtgttaacatgtgcacattaattgccatggacctcggcgagctgtgtgaagatactatgacctacaaatgcccacggataacagaggcggaaccggacgatgtggactgttggtgcaatgctaccgatacttgggtaacatatgggacctgtagtcagacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaattgctcaagacagaggtgaccaaccctgccgtgctgaggaaactttgcattgaagctaagatctctaatacgaccacagatagccggtgtccaactcaaggagaggccaccctggtcgaagaacaggacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatgtgtactggtagcttcaaactggagaaggaagtcgctgagacccagcacggtacggtgcttgttcagataaagtacgagggcacagacgcgccttgcaaaatcccattctcgacccaagatgaaaagggggtgactcagaacggacgcttgattacagcaaatcccatcgtaaccgacaaagagaagcctgtcaacatagaagccgagccaccctttggcgagtcttatattgtgatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtttttacatccgtggggaaacttgtccatcagattttcggaacggcgtacggcgtgctgttttctggtgtaagctggaccatgaagatagggatcggcgtgttgctcacttggctgggattaaattcacgaagtacatccctgagcatgacctgtattgctgttggcctagtcacactctacctgggggtgatggtgcaggccgattctggatgcgtcatcaactggaaaggccgcgaacttaagtgtggttcagggatcttcgttactaatgaggtgcacacctggacggaacaatataagtttcaggcagacagtccgaaaagattgagcgccgctattggaaaggcctgggaggagggcgtgtgcggtataaggtccgcaacacggctggaaaacatcatgtggaaacagatttctaacgagctcaatcatatcctgttagaaaacgacatgaagctgaccgtagtcgtgggcgatgttgctgggattcttggacagggcaaaaagatgatccgccctcaacccatggagtacaaatattcgtggaaaagctgggggaaggccaaaataatcggagcggacgcccagaatactaccttcattatcgatggcccaaacacacctgaatgtcccgacgatcagagagcttggaatatttgggaggtggaggactacggttttgggatcttcactaccaacatatggttgaagctcagggattcctatacacaggtctgcgaccaccgtctgatgtcagcagccattaaagatagtaaggctgtgcacgccgacatgggatactggatcgaatctgagaaaaatgaaacgtggaagctagcacgggcgagctttattgaggttaagacctgtatctggccaaaatcccatactctgtggtcaaacggcgtgctcgaaagcgagatgataatccccaagatttatggtggccctatctctcaacacaattaccgaccagggtacttcacacagaccgccggaccgtggcatctgggcaaacttgagttggatttcgacctgtgcgaagggactacagtagtcgtggatgagcactgcggaaacagaggcccctccttaaggaccacgactgtgaccggtaagattatccacgaatggtgttgccgcagttgtacactccctccactgcggtttagaggggaggacggatgctggtatggcatggagataaggcccgtcaaagaaaaggaggaaaatcttgttaagagcatggtgtctgctggttccggcgaggtagactcattcagtctggggttgctctgtattagcatcatgatcgaagaggtgatgcgctcgcgatggtcccggaaaatgctgatgaccggaactctagccgtctttttcctgctcattatgggccagctgacatggaacgatcttatccgtttgtgcattatggtgggggcaaatgcttctgacagaatgggaatgggcaccacatacctggccttaatggcaacttttaagatgaggcctatgttcgccgttggtctcctgtttcgccggcttaccagcagagaggtgctgctactcacgatagggctgtcattggtcgctagtgtggaactgccaaactccttagaggaactcggagatggcctggcgatgggcatcatgattcttaaactgttgacagacttccaatctcatcagctctgggccaccctgctaagcctgacttttatcaagaccacattctcccttcactatgcatggaaaactatggctatggttctctcaattgtgagcctgtttcccttgtgtctgagtaccacgtctcagaagacaacctggttaccggtcctcctggggtcccttggatgcaagcctctgactatgttcttgatcgccgagaataaaatatggggtaggaagtcctggccactcaacgaaggcatcatggccgtagggattgtgtcgatcctgctatcatctctgcttaaaaacgatgttcccctcgctggacctctgattgcaggcggtatgttgatcgcctgttacgtgataagtgggtccagcgcggacttatctctggagaaggctgccgaggtcagctgggaagaggaagcagagcattccggagcctcacacaatattctcgtggaagtacaggatgacggcacaatgaaaatcaaggatgaggagcgagacgataccctgactatccttctgaaagctacattgctagcagtgagtggcgtctatcccctgagcattccagccaccctctttgtttggtacttctggcaaaagaagaaacagcgctctggggtgctgtgggacacgccttcacccccagaagtggagcgggcggtccttgatgacggaatatatagaatcatgcagaggggtttactgggccgtagccaggtgggggttggagtattccaagaaaacgtgtttcatactatgtggcacgtcacccgcggcgctgtgctcatgtaccagggtaagcggttggagccgagttgggccagcgttaaaaaggacctgatttcctacgggggaggctggagactcaggggctcttggaatacaggggaggaagtgcaggtcatcgcagtggagcctggcaaaaatcccaagaatgtacagaccgccccaggtacattcaagactcccgaaggcgaggtcggggctattgccctggattttaaacctggaacctcgggcagcccaatcgtgaaccgagaaggtaagatagttgggctttatggaaatggcgtggtcacgacatcaggcacttacgtgtccgcaatcgctcaagccaaagcgagtcaggaggggcccctgcctgagattgaagacgaggttttccggaagcgcaacttgaccatcatggatctacacccgggatctggtaaaacaagaaggtatctgccagccattgtgcgggaagcaatcaagcgaaagctcagaaccttaatactggctcccactcgcgtcgtggccagcgagatggctgaagcacttaaaggcatgcctattaggtaccagaccacagccgtaaagtccgagcatacggggaaagagatcgtggacctgatgtgccacgccacttttaccatgcgtctcttgtcaccagttcgggtccccaattataacatgatcattatggatgaagctcatttcacagacccttctagcatcgcggcaagaggatacataagtaccagggtgggcatgggtgaggccgctgccatttttatgactgcaacaccgcccgggtccgtggaagccttcccacaaagcaatgctgtcatccaggatgaggaacgcgacattcctgagcgatcttggaactcaggatatgagtggatcaccgattttcccggcaagacggtatggttcgtgccatccataaaaagtggcaatgacattgcgaactgtctgagaaagaatgggaagcgggttatccagctcagcaggaaaacttttgatacagaataccagaagaccaaaaacaacgactgggactacgtggtcaccactgatatctcggagatgggagccaatttccgcgcagaccgtgtgattgatcctagacggtgcctgaagcccgttatccttaaagacggtccagaaagggtgattctagctggcccgatgcctgtcacagtggcctctgcagcccaacgccgagggagaataggacggaaccacaataaggagggcgatcagtatatctacatgggtcagcccctgaacaatgacgaggatcatgctcactggaccgaagccaagatgttgttagacaacattaatacaccagaggggatcatccccgcgctgttcgaacctgagagggaaaaatccgcagccgtagatggcgagtatcgcctcagaggagaggctaggaagacttttgtggaactgatgcggcgtggcgaccttccagtttggctgagctacaaagtcgcctcagaggggttccagtatagtgatcgccgatggtgctttgacggagaaagaaacaatcaagtgctcgaggaaaacatggatgtggagatttggacgaaggagggtgaaaggaaaaagttgcggccccgctggctggacgctagaacctactctgaccctctagcactgagggagttcaaagaatttgccgctggccggcgatccgtcagcggggatctcatacttgagatcggaaagctgccgcagcacttaacacagagagcccagaatgcattggacaacctggttatgctccataattcagaacaaggcggtcgcgcgtataggcacgccatggaggagctgccagatactattgaaacccttatgctgctcgctttgatcgccgtgctgacagggggcgtaaccttattctttctaagtggacggggcctggggaagactagcattggactcctttgtgtgatggcatcctctgtcctgttgtggatggctagcgtggagccccattggatcgccgcatccataatcctggagttctttctcatggttctgcttattcctgagcccgaccgtcagagaacgccacaggataaccagctcgcctacgtggtcatcggtctgttgttcatgattctgaccgtagctgcgaatgagatgggcttactagaaacaactaaaaaggacctggggatcggacacgtggccgttgagaaccaccatcacgcagctatgctcgatgtggaccttcatcctgcctcagcctggaccctgtacgcagtcgctacaaccataattactcccatgatgaggcacacaatcgaaaacacgaccgccaatatttctttgactgcgatcgctaaccaagccgcaatactgatgggcctcgataaaggttggccaatcagtaagatggacattggggtgcctctgcttgccttaggctgctattcgcaggtcaatccgctgacactcaccgctgcagtgttgatgctggttgcccattacgcgatcattggacccggcctacaggctaaagccacccgcgaggcacaaaagcggacagccgctgggatcatgaagaacccaactgtggatggaatagtagccattgacctggatcctgtggtctatgacgcaaaatttgaaaagcagctcggccagatcatgcttctgatcttgtgtacgagccagattctgctcatgcgaaccacatgggctctgtgcgagtccatcactttagccaccggtccccttacaaccctgtgggaggggtctccaggaaaattctggaatactacgatagcggtttcaatggccaacatttttagaggcagctacctcgcaggagctggcctagccttctccctgatgaagagtctagggggaggcaggcgcgggacaggagcacaaggcgaaaccctgggtgagaaatggaagcggcagctcaatcagctttctaagagcgagttcaacacttataaaagatcagggatcatggaggtggaccgttccgaagctaaggagggactgaaaaggggcgagaccacaaagcacgccgtcagtcggggtactgccaaattgcgctggtttgtggaacgaaatctggtaaagcctgagggcaaggtgattgatctcgggtgtggaagaggcgggtggagctactattgcgcgggactaaagaaggttaccgaagtgaaaggctacacaaagggtgggcccggacacgaggaaccgatcccaatggctacgtacggctggaacctggtcaaacttcattctggcaaggacgtgttctttatacctcccgagaaatgtgataccctgctatgcgacatcggggagtcctcaccaaatcccactattgaagagggaaggacactccgggtcctgaagatggtggaaccttggttgcgcggtaaccagttctgtatcaagattctgaatccgtatatgcccagcgttgtagagaccctcgagcaaatgcagagaaaacacggcgggatgcttgtgaggaacccactgtcgcgaaattctactcatgaaatgtactgggtcagttgcggaacaggcaacatcgtgtccgcagttaatatgaccagccggatgttactgaaccgttttacgatggcccacagaaagcctacctatgagcgcgatgtggacttgggtacagggactaggcacgtcgctgtggaacccgaggtagccaacctcgatattatcggacagcggatagaaaatattaaacatgagcacaagtcaacctggcattacgacgaggataacccttataaaacatgggcataccacggctcctatgaagtgaagccatctggcagcgccagttccatggttaatggggtcgtgaagctgctaactaaaccctgggacgtgatccctatggtcacccagatcgctatgacagataccactccattcggacaacagagagtttttaaggagaaagtggacacgcgcacacccaaggcgaaaaggggtaccgcccagattatggaagtaactgcacgatggctttggggcttcctgagccggaacaagaagccgagaatatgtaccagggaggaatttacacgcaaagtgcgttctaatgctgccatcggggcagtcttcgtggacgagaaccaatggaactcagccaaggaggctgttgaagatgagcggttttgggacctcgtgcatagagaaagggagctgcacaaacagggaaagtgcgccacgtgcgtctacaacatgatgggcaaacgcgaaaagaagttgggtgagttcgggaaagcgaagggaagtcgagcaatttggtacatgtggctgggcgcccggtttctcgagttcgaagctcttggcttcatgaatgaggatcactggttttccagagaaaacagcctgtctggggtggagggagagggtttacataaactgggctatatcttgagggacatttcgaagatccctgggggaaatatgtacgccgatgacaccgcaggctgggatactcgcataacagaagacgatctccagaacgaggctaaaatcaccgacattatggaaccagagcacgccctgctagctaaggccatcttcaaacttacttatcagaataaggtagttagagtgcaacggcccgcaaagaacggtacagtcatggatgtgatttcaaggcgtgaccagcgagggagcggacaggtgggcacctacggcctgaatacatttactaacatggaagcgcagctcatccgccaaatggagtccgaggggatattcagtccttctgaactggagaccccaaacttggccgaaagagctttagattggctggagaaatatggagtcgaacggctcaagaggatggccattagcggtgacgactgtgttgtgaaacccatcgatgaccgctttgcaacggctcttaccgccctgaatgatatgggcaaggtaagaaaagacatcccgcagtgggagccttccaaggggtggaacgattggcaacaggtgcccttctgctcacatcactttcaccaactaattatgaaggacggacgggagatagtcgtgccatgtaggaatcaggatgaactggttggccgagcacgtgtgagtcagggtgccgggtggtctctcagagagacagcgtgcttgggaaaaagctacgctcagatgtggcaactgatgtatttccatcgccgggaccttaggctggccgcaaacgccatctgttccgctgtccctgtggattgggtacccacttcaagaaccacatggagcattcacgcccatcaccagtggatgactaccgaagacatgctctctgtttggaatcgcgtgtggatcgaggaaaacccatggatggaggataagacgcatatttccagttgggaggacgtcccctacttaggcaaacgggaagaccagtggtgcggcagcctgatcgggttgacagcaagggctacctgggccactaatatacaagtggcgatcaaccaggttcgaagactgattggaaatgagaactacctcaattatatgacatcgatgaagcggtttaaaaacgaatccgatcctgagggtgctctttggtga

SEQ ID NO: 13636 - RNA, 9879 nt, synthetic construct
  misc_feature 1..9879: note = derived and/or modified CDS sequence (opt3) from DENV-1__FJ410203__SS-prME
  source 1..9879: mol_type = other RNA
agcgtgaccatgctgctcatgcttatgcccactgcactggctttccacttgactacgagaggaggggaacctcatatgatcgtctccaagcaggaaaggggaaaatctttactgtttaagacctcagccggtgttaacatgtgcacattaattgccatggacctcggagagctgtgtgaagatactatgacctacaaatgcccacggattacagaggcggaaccggacgatgtggactgttggtgcaatgctaccgatacttgggtgacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaattgctcaagacagaggtgaccaaccctgccgtgctgaggaaactttgcattgaagctaagatctctaatacgaccacagatagccggtgtccaactcaaggagaggccaccctggtcgaagaacaggacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatgtgtactggcagcttcaaactggagaaggaagtcgctgagacccagcacggtacggtgcttgttcagataaagtacgagggcacagacgcgccttgcaaaatcccattctcgacccaagatgaaaagggggtgactcagaacggacgcttgattacagcaaatcccatcgtaaccgacaaagagaagcctgtcaacatagaagccgagccaccctttggcgagtcttatattgtgatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtttttacatccgtggggaaacttattcatcagatattcggaacggcgtacggcgtcctgttttctggtgtgagctggaccatgaagatcgggattggcgtattgctcacttggctgggattaaattcacgaagtacatccctgagcatgacctgtatcgctgtgggcctagttacactctacctgggggtcatggtgcaggccgattctggatgcgtgatcaactggaaaggccgcgaacttaagtgtggttcagggattttcgtcactaatgaggttcacacctggacggaacaatataagtttcaggcagacagtccgaaaagattgagcgccgctataggaaaggcctgggaggagggcgtgtgcggtatcaggtccgcaacacggctggaaaacattatgtggaaacagatctctaacgagctcaatcatattctgttagaaaacgacatgaagctgaccgtggtagtcggcgatgtggctgggatccttggacagggcaaaaagatgatacgccctcaacccatggagtacaaatattcgtggaaaagctgggggaaggccaaaatcattggagcggacgcccagaatactaccttcatcattgatggcccaaacacacctgaatgtcccgacgatcagagagcttggaatatctgggaggttgaggactacggttttgggatattcactaccaacatttggttgaagctcagggattcctatacacaggtgtgcgaccaccgtctgatgtcagcagccatcaaagatagtaaggctgtccacgccgacatgggatactggattgaatctgagaaaaatgaaacgtggaagctagcacgggcgagctttatcgaggtgaagacctgtatatggccaaaatcccatactctgtggtcaaacggcgttctcgaaagcgagatgatcattcccaagatctatggtggccctatttctcaacacaattaccgaccagggtacttcacacagaccgccggaccgtggcatctgggcaaacttgagttggatttcgacctgtgcgaagggactacagtggtagtcgatgagcactgcggaaacagaggcccctccttaaggaccacgactgtgaccggtaagatcatacacgaatggtgttgccgcagttgtacactccctccactgcggtttagaggggaggacggatgctggtatggcatggagattaggcccgtgaaagaaaaggaggaaaatcttgtcaagagcatggtttctgctggttccggcgaggtggactcattcagtctggggttgctctgtatcagcatcatgattgaagaggtaatgcgctcgcgatggtcccggaaaatgctgatgaccggaactctagccgtgtttttcctgctcatcatgggccagctgacatggaacgatcttattcgtttgtgcataatggtcggggcaaatgcttttgacagaatgggaatgggcaccacatacctggccttaatggcaactttcaagatgaggcctatgtttgccgtgggtctcctgttccgccggcttacctctagagaggttctgctactcacgatcgggctgagcttggtggcttcagtcgaactgccaaacagtttagaggaactcggagatggcctggcgatgggcattatgatccttaaactgttgacagactttcaatcccatcagctctgggccaccctgctatctctgactttcattaagaccacatttagccttcactatgcatggaaaactatggctatggtgctctccatcgtttcactgttccccttgtgtctgagcaccacgagtcagaagacaacctggttaccggtgctcctggggtctcttggatgcaagcctctgactatgtttttgatagccgagaataaaatctggggtaggaagtcctggccactcaacgaaggcattatggccgtcgggatcgtaagcattctgctatcgtcactgcttaaaaacgatgtgcccctcgctggacctctgatcgcaggcggtatgttgatagcctgttacgttatttctgggagttccgcggacttaagcctggagaaggctgccgaggtgtcttgggaagaggaagcagagcatagcggagcctcccacaatatcctcgtcgaagtgcaggatgacggcacaatgaaaatcaaggatgaggagcgagacgataccctgactattcttctgaaagctacattgctagcagtatcaggcgtgtatcccctgagtataccagccaccctcttcgtctggtacttctggcaaaagaagaaacagcgcagcggggttctgtgggacacgccttctcccccagaagtggagcgggcggtgcttgatgacggaatctatagaattatgcagaggggtttactgggccgttcccaggtcggggtgggagtttttcaagaaaacgtattccatactatgtggcacgtgacccgcggcgctgtcctcatgtaccagggtaagcggttggagccgtcatgggccagtgtgaaaaaggacctgatcagctacgggggaggctggagactcaggggctcctggaatacaggggaggaagttcaggtgattgcagtcgagcctggcaaaaatcccaagaatgtgcagaccgccccaggtacatttaagactcccgaaggcgaggtaggggctatcgccctggatttcaaacctggaacctctggctcgccaatagtcaaccgagaaggtaagatcgtggggctttatggaaatggcgttgtgacgacaagcggcacttacgtctcagcaattgctcaagccaaagcgtcccaggaggggcccctgcctgagatcgaagacgaggtgtttcggaagcgcaacttgaccattatggatctacacccgggaagtggtaaaacaagaaggtatctgccagccatcgttcgggaagcaataaagcgaaagctcagaaccttaattctggctcccactcgcgtggtcgcctctgagatggctgaagcacttaaaggcatgcctatcaggtaccagaccacagccgtaaagagcgagcatacggggaaagagatcgtagacctgatgtgccacgccactttcaccatgcgtctcttgtccccagtgcgggttcccaattataacatgattatcatggatgaagctcattttacagacccttcatctatagcggcaagaggatacattagcaccagggtcggcatgggtgaggccgctgccatcttcatgactgcaacaccgcccgggagtgtggaagcctttccacaatccaatgctgtgattcaggatgaggaacgcgacatccctgagcgaagctggaactctggacacgagtggataaccgatttccccggcaagacggtctggtttgtaccatcaattaaatccggcaatgacatcgcgaactgtctgagaaagaatgggaagcgggtgatccagctcagtaggaaaactttcgatacagaatatcagaagaccaaaaacaacgactgggactacgttgtgaccactgatattagcgagatgggagccaatttccgcgcagaccgtgtcatcgatcctagacggtgcctgaagcccgtgattcttaaagacggtccagaaagggttatactagctggcccgatgcctgtgacagtcgcctcggcagcccaacgccgagggagaatcggacggaaccataataaggagggcgatcagtacatttatatgggtcagcccctgaacaatgacgaggatcacgctcactggaccgaagccaagatgttgttagacaacatcaatacaccagaggggatcattcccgcgctgtttgaacctgagagggaaaaatctgcagccgtggatggcgagtaccgcctcagaggagaggctaggaagactttcgtagaactgatgcggcgtggcgaccttccagtgtggctgtcctataaagttgccagcgaggggtttcagtactcagatcgccgatggtgcttcgacggagaaagaaacaatcaagtcctcgaggaaaacatggatgtggagatatggacgaaggagggtgaaaggaaaaagttgcggccccgctggctggacgctagaacctatagtgaccctctagcactgagggagtttaaagagttcgccgctggccggcgatctgtgtccggggatctcatccttgagattggaaagctgccgcagcatttaacacagagagcccagaatgcattggacaacctggtcatgctccacaatagcgaacaaggcggtcgcgcgtacaggcatgccatggaggagctgccagatactatcgaaacccttatgctgctcgctttgattgccgttctgacagggggcgtgaccttatttttcctatcaggacggggcctggggaagacaagtatcggactcctttgtgtaatggcaagctccgtgctgttgtggatggcttctgtcgagccccactggatagccgcaagcatcattctggaatttttcctcatggtgctgcttatccctgagcccgaccgtcagagaacgccacaggataaccagctcgcctatgttgtgattggtctgttgtttatgatcctgaccgtcgctgcgaatgagatgggcttactagaaacaactaaaaaggacctggggataggacacgtagccgtggagaaccatcaccatgcagctatgctcgatgttgaccttcaccctgcctccgcctggaccctgtacgcagtggctacaaccattatcactcccatgatgaggcatacaattgaaaacacgaccgccaatatctcattgactgcgatagctaaccaagccgcaatcctgatgggcctcgataaaggttggccaatttctaagatggacatcggggtccctctgcttgccttaggctgctacagtcaggtgaatccgctgacactcaccgctgcagtcttgatgctggtggcccactatgcgattatcggacccggcctacaggctaaagccacccgcgaggcacaaaagcggacagccgctgggataatgaagaacccaactgttgatggaattgtggccatcgacctggatcctgtagtgtacgacgcaaaattcgaaaagcagctcggccagatcatgcttctgattttgtgtacgtcgcagatcctgctcatgcgaaccacatgggctctgtgcgagagcataactttagccaccggtccccttacaaccctgtgggaggggtccccaggaaaattttggaatactacgattgcggtctctatggccaacatcttcagaggctcatatctcgcaggagctggcctagccttcagcctgatgaagtccctagggggtggcaggcgcgggacaggagcacaaggcgaaaccctgggtgagaaatggaagcggcagctcaatcagcttagtaagtctgaatttaacacttacaaaagaagcgggattatggaggttgaccgttcagaagctaaggagggactgaaaaggggcgagaccacaaagcacgccgtgtcccggggtactgccaaattgcgctggttcgtcgaacgaaatctggtgaagcctgagggcaaggtaatcgatctcgggtgtggaagaggcgggtggagttattactgcgcgggactaaagaaggtgaccgaagttaaaggctatacaaagggtgggcccggacatgaggaaccgataccaatggctacgtacggctggaacctggtgaaacttcacagcggcaaggacgtctttttcatccctcccgagaaatgtgataccctgctatgcgacattggggagtcttccccaaatcccactatcgaagagggaaggacactccgggtgctgaagatggtcgaaccttggttgcgcggtaaccagttttgtattaagatcctgaatccgtacatgccctcagtggttgagaccctcgagcaaatgcagagaaaacatggcgggatgcttgtaaggaacccactgagccgaaattcgactcacgaaatgtattgggtgtcttgcggaacaggcaacattgtcagtgcagtgaatatgacctcccggatgttactgaaccgtttcacgatggcccacagaaagcctacctacgagcgcgatgttgacttgggtacagggactaggcatgtggctgtcgaacccgaggtggccaacctcgatatcataggacagcggattgaaaatatcaaacacgagcataagagcacctggcactatgacgaggataacccttacaaaacatgggcatatcatggctcatacgaagtaaagccatccggctctgccagcagtatggtgaatggggttgtcaagctgctaactaaaccctgggacgtgatccctatggtgacccagattgctatgacagataccactccatttggacaacagagagtcttcaaggagaaagttgacacgcgcacacccaaggcgaaaaggggtaccgcccagataatggaagtgactgcacgatggctttggggctttctgtcccggaacaagaagccgagaatctgtaccagggaggagttcacacgcaaagtacgtagcaatgctgccattggggcagtgtttgtcgacgagaaccaatggaactctgccaaggaggctgtggaagatgagcggttctgggacctcgttcacagagaaagggagctgcacaaacagggaaagtgcgccacgtgcgtgtataacatgatgggcaaacgcgaaaagaagttgggtgagtttgggaaagcgaagggatcacgagcaatctggtacatgtggctgggcgcccggttcctcgagttcgaagctcttggctttatgaatgaggatcattggttcagtagagaaaactccctgagcggggtcgagggagagggtttacacaaactgggctacattttgagggacatctctaagatacctgggggaaatatgtatgccgatgacaccgcaggctgggatactcgcatcacagaagacgatctccagaacgaggctaaaattaccgacatcatggaaccagagcatgccctgctagctaaggccatttttaaacttacttaccagaataaggtggtaagagttcaacggcccgcaaagaacggtacagtgatggatgtcatctcgaggcgtgaccagcgagggtcaggacaggtgggcacctatggcctgaatacattcactaacatggaagcgcagctcatacgccaaatggagagcgaggggatattttcccctagtgaactggagaccccaaacttggccgaaagagctttagattggctggagaaatacggagtggaacggctcaagaggatggccatctctggtgacgactgtgtcgttaaacccatcgatgaccgcttcgcaacggctcttaccgccctgaatgatatgggcaaggtgagaaaagacattccgcagtgggagcctagcaaggggtggaacgattggcagcaggtacccttttgctcccaccacttccatcaactaataatgaaggacggacgggagatcgtggtcccatgtaggaatcaggatgaactggtgggccgagcacgtgtttcacagggtgccgggtggagtctcagagagacagcgtgcttgggaaaatcttatgctcagatgtggcaactgatgtactttcaccgccgggaccttaggctggccgcaaacgccatttgtagcgctgtgcctgtcgattgggtgcccacttccagaaccacatggtcaatccatgcccaccatcagtggatgactaccgaagacatgctcagcgtatggaatcgcgtttggattgaggaaaacccatggatggaggataagacgcacatctcttcctgggaggacgtgccctatttaggcaaacgggaagaccagtggtgcggcagtctgatagggttgacagcaagggctacctgggccactaatatccaagtcgcgattaaccaggtgcgaagactgatcggaaatgagaactacctcgattacatgacaagcatgaagcggttcaaaaatgaatcggaccctgagggtgctctttggtga

SEQ ID NO: 13637 - RNA, 9879 nt, synthetic construct
  misc_feature 1..9879: note = derived and/or modified CDS sequence (opt3) from DENV-1__FJ410204__SS-prME
  source 1..9879: mol_type = other RNA
agcgtgaccatgctgctcatgcttatgcccactgcactggctttccacttgactacgaggggaggggaacctcatatgatcgtctccaagcaggaaaggggaaagtctttactgtttaagacctcagccggtgttaacatgtgcacactaattgccatggacctcggagaactgtgtgaagatactatgacctacaaatgcccacggattacagaggcggaaccggacgatgtggactgttggtgcaatgctaccgatacttgggtgacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccgtgctgaggaaactttgcattgaagctaagatctctaatacgaccacagatagccggtgtccaactcaaggagaggccaccctggtcgaagaacaggacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatgtgtactggcagcttcaaactggagaaggaagtcgctgagacccagcacggtacggtgcttgttcagataaagtacgagggcacagacgcgccttgcaaaatcccattctcgacccaagatgaaaagggggtgactcagaacggacgcttgattacagcaaatcccatcgtaaccgacaaagagaagcctgtcaacatagaagccgagccaccctttggcgagtcttatattgtgatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtttttacatccgtggggaaacttattcatcagatattcggaacggcgtacggcgtcctgttttctggtgtgagctggaccatgaagatcgggattggcgtattgctcacttggctgggattaaattcacgaagtacatccctgagcatgacctgtatcgctgtgggcctagttacactctacctgggggtcatggtgcaggccgattctggatgcgtgatcaactggaaaggccgcgaacttaagtgtggttcagggattttcgtcactaatgaggtttatacctggacggaacaatacaagtttcaggcagacagtccgaaaagattgagcgccgctataggaaaggcctgggaggagggcgtgtgcggtatcaggtccgcaacacggctggaaaacattatgtggaaacagatctctaacgagctcaatcacattctgttagaaaacgacatgaagctgaccgtggtagtcggcgatgtggctgggatccttggacagggcaaaaagatgatacgccctcaacccatggagtataaatactcgtggaaaagctgggggaaggccaagatcattggagcggacgcccagaatactaccttcatcattgatggcccaaacacacctgaatgtcccgacgatcagagagcttggaatatctgggaggttgaggactatggttttgggatattcactaccaacatttggttgaagctcagggattcctacacacaggtgtgcgaccatcgtctgatgtcagcagccatcaaagatagtaaggctgtccacgccgacatgggatattggattgaatctgagaaaaatgaaacgtggaagctagcacgggcgagctttatcgaggtgaagacctgtatatggccaaaatcccacactctgtggtcaaacggcgttctcgaaagcgagatgatcattcccaagatctacggtggccctatttctcaacataattaccgaccagggtatttcacacagaccgccggaccgtggcacctgggcaaacttgagttggatttcgacctgtgcgaagggactacagtggtagtcgatgagcattgcggaaacagaggcccctccttaaggaccacgactgtgaccggtaagatcatacacgaatggtgttgccgcagttgtacactccctccactgcggtttagaggggaggacggatgctggtacggcatggagattaggcccgtgaaagaaaaggaggaaaatcttgtcaagagcatggtttctgctggttccggcgaggtggactcattcagtctggggttgctctgtatcagcatcatgattgaagaggtaatgcgctcgcgatggtcccggaaaatgctgatgaccggaactctagccgtgtttttcctgctcatcatgggccagctgacatggaacgatcttattcgtttgtgcataatggtcggggcaaatgcttttgacagaatgggaatgggcaccacatatctggccttaatggcaactttcaagatgaggcctatgtttgccgtgggtctcctgttccgccggcttacctctagagaggttctgctactcacgatcgggctgagcttggtggcttcagtcgaactgccaaacagtttagaggaactcggagatggcctggcgatgggcattatgatccttaaactgttgacagactttcaatcccaccagctctgggccaccctgctatctctgactttcattaagaccacatttagccttcattacgcatggaaaactatggctatggtgctctccatcgtttcactgttccccttgtgtctgagcaccacgagtcagaagacaacctggttaccggtgctcctggggtctcttggatgcaagcctctgactatgtttttgatagccgagaataaaatctggggtaggaagtcctggccactcaacgaaggcattatggccgtcgggatcgtaagcattctgctatcgtcactgcttaaaaacgatgtgcccctcgctggacctctgatcgcaggcggtatgttgatagcctgttatgttatttctgggagttccgcggacttaagcctggagaaggctgccgaggtgtcttgggaagaggaagcagagcacagcggagcctcccataatatcctcgtcgaagtgcaggatgacggcacaatgaaaatcaaggatgaggagcgagacgataccctgactattcttctgaaagctacattgctagcagtatcaggcgtgtaccccctgagtataccagccaccctcttcgtctggtatttctggcaaaagaagaaacagcgcagcggggttctgtgggacacgccttctcccccagaagtggagcgggcggtgcttgatgacggaatctacagaattatgcagaggggtttactgggccgttcccaggtcggggtgggagtttttcaagaaaacgtattccacactatgtggcatgtgacccgcggcgctgtcctcatgtaccagggtaagcggttggagccgtcatgggccagtgtgaaaaaggacctgatcagctatgggggaggctggagactcaggggctcctggaatacaggggaggaagttcaggtgattgcagtcgagcctggcaagaatcccaagaatgtgcagaccgccccaggtacatttaagactcccgaaggcgaggtaggggctatcgccctggatttcaaacctggaacctctggctcgccaatagtcaaccgagaaggtaagatcgtggggctttacggaaatggcgttgtgacgacaagcggcacttatgtctcagcaattgctcaagccaaagcgtcccaggaggggcccctgcctgagatcgaagacgaggtgtttcggaagcgcaacttgaccattatggatctacacccgggaagtggtaaaacaagaaggtacctgccagccatcgttcgggaagcaataaagcgaaagctcagaaccttaattctggctcccactcgcgtggtcgcctctgagatggctgaagcacttaaaggcatgcctatcaggtatcagaccacagccgtaaagagcgagcacacggggaaagagatcgtagacctgatgtgccatgccactttcaccatgcgtctcttgtccccagtgcgggttcccaattacaacatgattatcatggatgaagctcactttacagacccttcatctatagcggcaagaggatatattagcaccagggtcggcatgggtgaggccgctgccatcttcatgactgcaacaccgcccgggagtgtggaagcctttccacaatccaatgctgtgattcaggatgaggaacgcgacatccctgagcgaagctggaactctggacatgagtggataaccgatttccccggcaagacggtctggtttgtaccatcaattaaatccggcaatgacatcgcgaactgtctgagaaagaatgggaagcgggtgatccagctcagtaggaaaactttcgatacagaataccagaagaccaaaaacaacgactgggactacgttgtgaccactgatattagcgagatgggagccaatttccgcgcagaccgtgtcatcgatcctagacggtgcctgaagcccgtgattcttaaagacggtccagaaagggttatactagctggcccgatgcctgtgacagtcgcctcggcagcccaacgccgagggagaatcggacggaaccacaataaggagggcgatcagtatatttacatgggtcagcccctgaacaatgacgaggatcatgctcactggaccgaagccaagatgttgttagacaacatcaatacaccagaggggatcattcccgcgctgtttgaacctgagagggaaaaatctgcagccgtggatggcgagtatcgcctcagaggagaggctaggaagactttcgtagaactgatgcggcgtggcgaccttccagtgtggctgtcctacaaagttgccagcgaggggtttcagtattcagatcgccgatggtgcttcgacggagaaagaaacaatcaagtcctcgaggaaaacatggatgtggagatatggacgaaggagggtgaaaccaaaaagttgaggcaccggtggcccgacgctcgccagtacagtgaccctctgggcctaagagagtttaaagagttcgcagccgggaggcggtctgtgtccggagatctgatcctcgagattggcaaacttccgcagcatctgacacagcgagctcaaaatgccttagacaacttggtcatgctgcacaatagcgaacagggtgggagagcatatcgccatgcgatggaggagctcccagatactatcgaaaccctgatgcttctggccctcattgctgttttgacaggcggagtgaccctgtttttcttatcaggcagggggctaggaaagacaagtatcggtctgctctgtgtaatggccagctccgtgcttctgtggatggcatctgtcgagccccactggatagctgccagcatcattttggaatttttcctgatggtgctcctgatccctgagcccgaccggcagcgtacgccacaggataaccaacttgcatacgttgtgattggcctcctgtttatgatcttgaccgtcgccgctaatgagatggggctgttagaaacaactaaaaaggacctaggaataggccacgtagcggtggagaaccatcaccatgccgcaatgctggatgttgacctccaccctgcttccgcctggaccctttacgccgtggcaacaaccattatcactcccatgatgagacatacaattgaaaacacgaccgctaatatctcactgactgccatagcgaaccaggctgccatcttgatgggtctggataaagggtggccaatttctaagatggacatcggcgtccctctcctggcacttggatgctatagtcaggtgaatccgttaacactgaccgccgctgtcctcatgttggtggcacactacgccattatcggccccgggctgcaagcgaaagctaccagggaggcccagaagcgcacagcagccggaataatgaagaacccaactgttgatggcattgtggctatcgacctagatcctgtagtgtatgacgccaaattcgaaaagcagctgggtcagatcatgctccttattctgtgtacgtcgcaaatcttgctgatgcggaccacatgggcactctgcgagagcataactctggctaccgggcccttaacaaccctttgggagggatccccaggcaaattttggaatactacgattgccgtctctatggcgaacatcttccgaggttcatacctggccggcgcagggctcgctttcagcctaatgaagtccctgggaggcgggagaaggggaacaggcgcccagggtgaaaccttgggggagaaatggaagcgccagctgaatcagctcagtaagtctgaatttaacacttataaacggagcggaattatggaggttgacagatcagaagcaaaggagggccttaaacgtggtgagaccacaaagcacgctgtgtccaggggcactgccaaactgcggtggttcgtcgaacgcaatttggtgaagcctgaggggaaggtaatcgatctgggatgtggccgagggggatggagttactattgcgccggcctcaaaaaggtgaccgaagttaaaggttacacaaaagggggacccggccatgaggaaccgataccaatggcgacgtacggctggaacttagtgaaactgcacagcgggaaggacgtctttttcatccctcccgagaaatgtgatacccttctgtgcgacattggagagtcttccccaaatcccactatcgaagagggtagaacactaagggtgctcaagatggtcgaaccttggctgcggggcaaccaattttgtattaagatcttgaatccgtatatgccctcagtggttgagaccctggagcagatgcagcgcaaacatgggggaatgctcgtaagaaacccacttagcagaaattcgactcacgaaatgtactgggtgtcttgcggcacaggtaacattgtcagtgctgtgaatatgacctcccgaatgctgttaaaccggttcacgatggcacaccgtaagcctacctatgagagagatgttgacctggggacaggaactcgccatgtggccgtcgaacccgaggtggctaacttggatatcataggccagaggattgaaaatatcaaacacgagcataagagcacctggcactacgacgaggataacccttataaaacatgggcctaccatggctcatatgaagtaaagccatccgggtctgcaagcagtatggtgaatggagttgtcaagctcctgactaaaccctgggacgtgatccctatggtgacccaaattgccatgacagataccactccatttggtcagcagcgggtcttcaaggagaaagttgacacgagaacacccaaggctaaacgcggcaccgcgcaaataatggaagtgactgccaggtggctatgggggtttctttcccgaaacaagaagccgcggatctgtaccagagaggagttcacaaggaaagtacgcagcaatgcagctattggagccgtgtttgtcgacgagaaccagtggaactctgcaaaggaggccgtggaagatgagcgtttctgggacctggttcaccgggaaagagagctccacaaacagggcaagtgcgctacgtgcgtgtacaacatgatgggtaaaagggaaaagaagctgggggagtttggaaaagccaagggctcacgcgcgatctggtacatgtggttgggcgcacgattcctggagttcgaagccctcgggtttatgaatgaggatcattggttcagtcgggaaaactcccttagcggagtcgagggtgagggcctgcacaaattagggtatattctgagagacatctctaagatacctggaggcaatatgtacgctgatgacaccgccggttgggatactaggatcacagaagacgatttgcagaacgaggcaaaaattaccgacatcatggaaccagagcatgctctcctggccaaggctatttttaaactaacttatcaaaataaggtggtacgcgttcagagacccgccaagaacgggacagtgatggatgtcatctcgcggagggaccagcgtggatcaggccaggtgggcacctacgggcttaatacattcactaacatggaagcacaactgatacgacagatggagagcgagggaatattttcccctagtgaactcgagaccccaaacctggcggaacgcgccttggattggttagagaaatatggtgtggaaagactgaagcggatggctatctctggcgacgactgtgtcgttaaacccatcgatgacaggttcgccacggcactcaccgctcttaatgatatggggaaggtgcgcaaagacattccgcagtgggagcctagcaagggatggaacgattggcagcaagtacccttttgctcccaccacttccatcagctgataatgaaggacggcagagagatcgtggtcccatgtcggaatcaggatgagctagtgggtagggcccgagtttcacagggggcaggatggagtctgcgtgagacagcctgcctcggcaaatcttacgcgcaaatgtggcagttgatgtattttcacagacgcgacctgcggcttgctgccaacgcaatttgtagcgccgtgcctgtcgattgggtgcccacttccaggaccacatggtcaatccatgctcaccatcagtggatgactaccgaagacatgctgagcgtatggaatagagtttggattgaggaaaacccatggatggaggataagacgcacatctcttcctgggaggacgtgccctacctcggcaaacgcgaagaccaatggtgcgggagtttaataggactgacagcccgggcaacctgggctactaatatccaggtcgccattaaccaggtgaggcgattgatcggtaatgagaactacctggattatatgacaagcatgaagagattcaaaaatgaatcggaccctgagggcgcgctctggtga

SEQ ID NO: 13638 - RNA, 9879 nt, synthetic construct
  misc_feature 1..9879: note = derived and/or modified CDS sequence (opt3) from DENV-1__FJ432742__SS-prME
  source 1..9879: mol_type = other RNA
agcgtgaccatgctgctcatgcttatgcccaccgccctggctttccacttgactacgaggggaggggaacctcatatgatcgtaaccaagcaggaaaggggaaaatccttactgtttaagacatctgccggtgttaatatgtgcactctaattgccatggacctcggcgaactgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggtagcttcaaactggagaaggaagtggctgagacccagcacggaacggtccttgtgcagataaagtacgagggcacagacgcgccttgcaaaatcccattctcgacccaagatgaaaagggggttactcagaacggacgcttgattacagcaaatcccatcgtgaccgacaaagagaagcctgtaaacatagaagccgagccaccctttggcgagtcttatattgtcatcggtgctggggaaaaagccctgaagctctcctggttcaagaaaggctcaagtatcggaaagatgtttgaggcaactgccagaggcgctaggcggatggccattctgggggataccgcatgggacttcggaagcgtgggtggcgtttttacatccgtggggaaacttgtccatcagatcttcggaacggcgtacggcgtgctgttttctggtgtaagctggaccatgaagattgggataggcgtgttgctcacttggctgggattaaattcacgaagtacatccctgagcatgacctgtatcgctgttggcctagtcacactctacctgggggtgatggtgcaggccgattctggatgcgtcattaactggaaaggccgcgaacttaagtgtggttcagggatcttcgttactaatgaggtgcacacctggacggaacaatataagtttcaggcagacagtccgaaaagattgagcgccgctatcggaaaggcctgggaggagggcgtgtgcggtattaggtccgcaacacggctggaaaacataatgtggaaacagatctctaacgagctcaatcatattctgttagaaaacgacatgaagttcaccgtagtcgtgggcgatgttgtggggatcctggctcagggcaaaaagatgattcgccctcaacccatggagcacaaatactcgtggaaaagctggggcaaggccaagatcataggggcggacgtccagaatactacctttatcattgatggaccaaacacacctgaatgtcccgacgatcagagagcctggaatatctgggaggtggaggactatggcttcggtatttttactaccaacatctggcttaagttgagggattcctacacacaggtttgcgaccaccgtctcatgtcagctgcaataaaagatagtaaggccgtgcatgctgacatggggtattggattgaatctgagaaaaatgaaacgtggaagctggcccgggcatccttcatcgaggtaaagacctgtatttggccaaaatcccacactctatggtcaaacggagtcctggaaagcgagatgatcatacccaagatctacggcggtcctatttctcaacataattatcgaccaggctacttcacacagaccgcggggccgtggcacctcggaaaactggagcttgattttgacttgtgcgaaggcactacagtggtggtcgatgagcactgcgggaacagaggaccctccctgaggaccacgactgttaccggcaagatcattcatgaatggtgttgccgcagttgtacattacctccactccggttcaaaggtgaggacgggtgctggtacggaatggagatcagacccgtgaaggaaaaggaggaaaatctggtaaaaagcatggtgtctgccggctccggtgaggtcgactcatttagtcttggcctgttgtgtataagcattatgatcgaagaggtgatgaggtcgcgctggtcccgaaagatgctcatgaccgggactctggctgttttcctactgctcatcatgggacagctgacatggaacgatcttattcggttgtgcatcatggtgggcgccaatgcatctgaccgtatggggatgggaaccacatatctggctttaatggccacttttaaaatgagacctatgttcgcagtcggcctcctgtttaggcgccttaccagccgggaggtgctgctactcacgattggtctgtcattggttgccagtgtggaactgccaaactccttagaggaactcggggatggactggctatgggcataatgatccttaagctgttgacagacttccaatctcaccagctctgggcgaccctgctaagcctgacttttattaaaaccacactttccctccattacgcctggaagactatggcaatggtcctgtcaatcgtcagcttgttccccctgtgtttaagtaccacgtctcagaagacaacctggctcccggtgctgcttggctccctggggtgcaaacctttgactatgtttctcattacagagaataagatctggggaagaaaaagctggccactgaacgaaggtataatggctgttggcgtggtctcgatcctactgtcatctcttctcaagaacgatgtgcccctggccgggcctttgattgccggaggcatgttaatcgcttgttatgtaattagtggttccagcgcagacctgtctctcgagaaagccgcggaggtgagctgggaagaggaagctgagcactccggggcctcacataatatcctggtcgaagttcaggatgacggaaccatgaagataaaagatgaggagagggacgatactcttacaattctgttgaaggcaaccctactggccgtgagtggcgtgtaccccctcagcatcccagctacgctgttcgtctggtatttttggcaaaagaaaaagcagcgatctggcgtgctttgggacactccttcacccccagaagttgagcgcgcagtattagatgacgggatctaccggattatgcagagaggactgctcggtaggagccaggtgggcgtcggggtgttccaagaaaacgttttccacaccatgtggcacgtgacacgtggagccgtcttgatgtatcagggcaaacgcctggagccgagttgggcgagcgtgaagaaagacctcatatcctacggtgggggatggcggctgcagggctcttggaataccggcgaggaagtacaggtcatcgctgtggagcctgggaagaaccccaagaatgttcaaacagccccaggaacttttaaaacccccgaaggtgaggtgggcgcaattgcccttgatttcaagcctgggacgtcgggaagcccaatcgtcaacagagaaggcaaaattgtgggtctgtacgggaatggagttgtgacaacttcaggcacctatgtctccgctatcgcccaggcaaaggctagtcaggagggccccttgcctgagatagaagacgaggtgtttaggaaacgaaacctaacaatcatggatctgcatccggggtctggaaagacccggcgctacctcccagccattgtaagagaagcgatcaagaggaaattacggactctgattcttgcccccacccgagtggttgcaagcgagatggctgaagccctgaagggtatgcctatcagatatcaaacaacggctgtcaaatccgagcacactggcaaggagatagtggacctcatgtgccatgcaaccttcacaatgcgcttgctgtcaccagtgagggtccccaattacaacatgattatcatggatgaagcccactttaccgacccttctagcatcgccgctcgtgggtatattagtactcgggtaggaatgggcgaggcggcagccatcttcatgacagctaccccgcccggttccgtggaagcctttccacagagcaatgcagttatacaggatgaggaaagagacattcctgagaggtcttggaactcagggtacgagtggatcacggatttccccggaaaaactgtgtggtttgtcccatccattaagagtggcaatgacatcgccaactgtctccgcaagaatggcaaacgagtgatacagctgagcagaaagacattcgataccgaatatcagaaaaccaagaacaacgactgggactacgttgtgactacagatatttcggagatgggggctaattttcgggcggacagggtcatcgatcctcgccgttgccttaaacccgtgatcctaaaggacggaccagaaagagtaattctggccggtccgatgcctgtgaccgttgcatctgctgcccagcggaggggccgcatcgggcgaaaccataataaggagggagatcagtacatttatatgggccagcccttgaacaatgacgaggatcacgcacactggacagaagccaaaatgttactggacaacataaatactccagagggtatcattcccgctctcttcgaacctgagagagaaaagtccgccgcgatcgatggggagtaccggctgaggggcgaggcacgcaaaacgttcgtcgaacttatgagaaggggagacctgccagtgtggctcagctataaggtggcctcagagggctttcaatacagtgatcggcgttggtgcttcgacggggaacgcaacaatcaggtcttggaggaaaacatggatgttgagatctggaccaaagagggagaacgaaagaaactgagacccaggtggctagacgctcggacatattctgaccctctggccctccgcgagtttaaggagttcgctgcaggtagaaggtccgtgagcggcgatcttattctggagatagggaagttaccgcagcatttgactcagcgggcccaaaatgctctggacaacctcgtaatgctgcacaattcagaacagggaggccgagcctacagacatgcaatggaggagcttccagataccatcgaaacactgatgctcttggcgctgattgccgtgttaaccggtggggtcactctatttttcctgagtggccgcggactcggcaaaacgagcatcgggcttctgtgtgtgatggcttcctctgttttgctgtggatggccagcgtggagccccactggattgcagcttccatcatactcgaatttttcctgatggtccttctcatccctgagcccgacaggcagcggaccccacaggataaccaactggcctatgtagtgattggattgctgtttatgatcttaacagttgcagccaatgagatgggtctactggaaactaccaagaaagacctcggcattgggcacgtggctgtcgagaaccatcaccatgcgacaatgcttgatgtggacctgcaccctgcctcagcatggaccttgtacgctgtcgccactacaatcataacgcccatgatgcgtcataccattgaaaacactacagccaatatctctctgaccgcaattgctaaccaggccgcgatcctcatgggactggataagggctggccaataagtaaaatggacatcggtgtgcctcttttagctctggggtgctactcgcaggttaatccgctcaccttgacagccgcagtgctgatgctagtagcccactatgctattatcggccccggactgcaagcaaaggccactagagaggcgcagaagaggacggctgccggcattatgaaaaacccaaccgtggatgggatcgtcgcaatagacctcgatcctgttgtgtacgacgccaagttcgaaaaacagcttggacagattatgctgttgatcctgtgtacaagccaaatcctcctgatgcgcactacctgggctttatgcgagtccattacacttgccaccggccccctgactacgctctgggagggttctccagggaagttttggaatacaaccatcgcagtctcaatggctaacatattccggggaagctatctagccggcgcgggtctggccttttccttgatgaaaagtctgggcgggggacgaagaggcactggggcacagggagaaaccctcggcgagaagtggaagaggcagcttaatcagctgtctaaaagcgagttcaacatttacaagcgctcaggtatcatggaggtggaccggtccgaagctaaagaggggttgaagagaggagagacaactcgtcacgccgtaagtaggggcaccgcaaaactgcggtggttcgtggaacgcaatctcgttaagcctgagggtaaggtgattgatttaggctgtgggcgaggaggctggagctattactgcgctgggctgaaaaaggtcacagaagtgaaaggatatacgaagggcggtcccgggcatgaggaaccgatcccaatggccacctacggatggaaccttgtcaaactgcactctggcaaggacgtgtttttcactcctcccgagaaatgtgatacactactctgcgacataggcgagtcctcaccaaatcccaccatcgaagaggggagaactctgagggttttgaagatggtagaaccttggctgcggggaaaccaattttgtattaagatcctcaatccgtacatgcccagcgtggtcgagacacttgagcagatgcagcgcaaacatggtggcatgctggtgagaaacccattatcgagaaattctacccacgaaatgtattgggttagttgcgggacgggaaacattgtgtccgccgtcaatatgaccagccgaatgctgttgaaccggttcacaatggcgcaccgtaagcctacttacgagagagatgtggacctcggcgctggtacccgccatgtagcagtggaacccgaggttgccaacctggatatcattgggcagaggatcgaaaatataaaacacgagcataagtcaacatggcactatgacgaggataacccttacaaaacttgggcttatcatggatcctacgaagtcaagccatctggcagcgccagttccatggtgaatggcgtggtcaagctacttaccaaaccctgggacgttattcctatggtgacacaaatcgcaatgaccgatactacgccatttgggcagcagcgggtattcaaggagaaagtggacacaagaacccccaaggccaaacgcggaactgctcaaatcatggaagtcaccgcgaggtggctgtggggttttctcagccgaaacaagaagccgcggatttgtacaagagaggagttcacgaggaaagtgcgctctaatgccgcaataggcgctgtttttgtggacgagaaccagtggaactcagccaaggaggcagtcgaagatgagcgtttctgggacctggtgcagaaagaacgggagttgcacaagcaggggaaatgcgcaacctgcgtatataacatgatgggaaagagagaaaagaaactgggcgagtttggtaaggctaaagggagtagggccatctggtacatgtggctcggagcgcgcttccttgagtttgaagcactgggcttcatgaatgaggatcactggttctcccgagaaaacagcttatctggcgttgagggggagggactgcataagttgggttacattctccgggacatctcgaaaattcctggcgggaatatgtatgccgatgacactgctggatgggatacaagaatcaccgaagacgatctgcaaaacgaggccaagataactgacatcatggaaccagagcacgcactacttgctacatcaatttttaaactgacctaccagaataaggtggtcagggtgcagcgccccgccaagaacggcacagtgatggatgtcatcagcagacgggaccagaggggttccgggcaagttggaacttatggcctcaataccttcacgaacatggaagctcagctgattcgtcagatggagagtgagggcatctttttgccttctgaattagagaccccaaacctggccgaacgagtgctcgattggcttgagaaatacggggtagaacgcctgaagagaatggcaataagcggagacgactgtgtggtcaaacccattgatgaccggttcgcgacagccctaactgctctgaatgatatgggtaaggtgaggaaagacatcccgcagtgggagccttccaagggctggaacgattggcaacaggttcccttttgctcacatcacttccaccagctcatcatgaaggacgggcgcgagattgtggtcccatgtagaaatcaggatgaattggtgggacgggccagggtaagtcaaggcgcaggttggtctctgcgagagaccgcttgccttgggaaaagctatgcccagatgtggcagctgatgtactttcatcgtagagacctccgcttagcagccaacgcgatatgttccgctgttcctgtggattgggtccccacatcacggactacctggagcatccacgcccatcaccaatggatgacgacagaagacatgctgtctgtgtggaatagggtttggattgaggaaaacccatggatggaggataagacccatgtgtccagttggggagacgtcccctatttgggcaaaagagaggaccagtggtgcggcagcctgatcgggctcactgcacgcgccacatgggcttcgaatattcaggtggccatcaaccaggtacggaggcttataggaaatgaaaactacctggattacatgacctccatgaagcgattcaaaaatgagggtgaccctgaaggcgcactatggtga

SEQ ID NO: 13639 - RNA, 9879 nt, synthetic construct
  misc_feature 1..9879: note = derived and/or modified CDS sequence (opt3) from DENV-1__FJ410205__SS-prME
  source 1..9879: mol_type = other RNA
tccgtgaccatgctgctcatgcttatgcccacggccctggctttccacttgactacgagaggaggggaacctcatatgatcgtctccaagcaggaaagaggaaaatctttactgtttaagacctcagccggtgttaatatgtgcacgctgattgccatggacctcggcgagctgtgtgaagatactatgacctacaaatgcccacggattacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccggtagcttcaaactggagaaggaacttgccgagacgcagcacggaacagtcttggtgcagataaagtacgagggcaccgacgctccttgcaaaatcccattctcgactcaagatgaaaagggggttacacagaacggacgcctgattaccgcgaatcccatcgtgactgacaaagagaagcctgtaaacatagaagcagagccaccctttggcgagtcttatattgtcatcggtgccggggaaaaagctctcaagctgtcctggttcaagaaaggctcaagtatcggaaagatgtttgaggccaccgcaagaggcgccaggcggatggctattcttggggatacagcctgggacttcggaagcatcggtggcgtgtttacgtccgcagggaaactggttcatcagattttcggaaccgcgtacggcgtgttgttttctggtgtcagctggactatgaagatagggatcggcgtgctcctgacatggttaggactaaattcacgaagtacctccctaagcatgacatgtattgctgtaggcctcgtgactctgtaccttggggttatggtccaggccgattctggatgcgtgatcaactggaaaggccgcgaattgaagtgtggttcagggatcttcgtgaccaatgaggtccacacgtggacagaacaatataagtttcaggcagacagtccgaaaagactgagcgccgctattggaaaggcctgggaggagggcgtttgcggtataaggtccgcaacccggctcgaaaacatcatgtggaaacagatttctaacgagctgaatcatatcttactggaaaacgacatgaagttcactgtggtggtaggcgatgtcgctgggattcttgcccagggcaagaagatgatccgccctcaacccatggagtacaaatattcgtggaaaagctggggcaaggcgaagataatcggggccgacgtgcagaataccacatttattatcgatggaccaaacactcctgaatgtcccgacgatcagagagcttggaatatttgggaggttgaggactacggcttcggtatctttaccacaaacatatggttgaagctcagggattcctatacacaggtgtgcgaccaccgtctgatgtcagcagccattaaagatagtaaggctgtccacgccgacatggggtactggatcgaatctgagaaaaatgaaacctggaagctagcacgggcgagcttcattgaggtgaagacttgtatctggccaaaatcccatacactgtggtcaaacggagttctcgaaagcgagatgataatccccaagatttatggcggtcctatctctcaacacaattaccgaccaggctacttcacccagactgccgggccgtggcatctgggaaaacttgagttggattttgacctgtgcgaaggcacaaccgtggtagtcgatgagcactgcgggaacagaggaccctccttaaggacgactaccgtgacaggcaagattatccacgaatggtgttgccgcagttgtaccctccctccactgcggttcagaggtgaggacgggtgctggtatggaatggagataaggcccgtgaaagaaaaggaggaaaatcttgtcaagagcatggtttctgctggctccggtgaggtggactcatttagtctgggcttgctctgtattagcatcatgatcgaagaggtaatgcgctcgcgatggtcccggaaaatgctgatgactgggacactagccgtgttctttctgctcattatgggacagctgacctggaacgatcttatccgtttgtgcattatggtcggcgcaaatgcttctgacagaatggggatgggaacaacttacctggccttaatggcaaccttcaagatgaggcctatgtttgccgtgggcctcctgttccgccggcttacgagcagagaggttctgctactcacaataggtctgtcattggtggctagtgtcgaactgccaaactccttagaggaactcggggatggactggcgatgggcatcatgattcttaaactgttgaccgactttcaatctcatcagctctgggccactctgctaagcctgaccttcatcaagacaactttttcccttcactatgcatggaaaaccatggctatggtgctctcaattgttagcctgttccccttgtgtctgagtacgacatctcagaagaccacttggttaccggtgctcctgggctcccttgggtgcaagcctctgacaatgtttttgatcgccgagaataaaatatggggaaggcgaagctggccactcaacgaaggtatcatggccgtcggcattgtatcgatcctgctatcatctctgcttaagaacgatgtgcccctcgctgggcctctgattgcaggaggcatgttgatcgcctgttacgttataagtggttccagcgcggacttatctctggagaaagctgccgaggtgagctgggaagaggaagcagagcattccggggcctcacacaatattctcgtcgaagtgcaggatgacggaaccatgaagatcaaagatgaggagcgcgacgatactctgacaatccttctgaaggctaccttgctagcagtaagtggcgtgtatcccctgagcattccagccacactcttcgtctggtacttctggcagaagaagaagcagcggtctggcgttctgtgggacactccttcacccccagaagtggagagagcggtgcttgatgacgggatatataggatcatgcagcgtggattactgggtcgcagccaggtcggcgtgggggtttttcaagaaaacgtattccataccatgtggcacgtgacacggggagctgtcctcatgtaccagggcaaaagattggagccgagttgggccagcgtgaagaaagacctgatttcctacggtgggggatggaggctccagggctcttggaataccggcgaggaagttcaggtgatcgcagtcgagcctgggaagaaccccaaaaatgtgcaaacagccccaggaacttttaagacccccgaaggtgaggtaggcgctattgccctggatttcaagcctgggacgtcgggaagcccaatcgtcaaccgagaaggcaaaatagtgggtctttatgggaatggagttgtgacaacttcaggcacctacgtctccgcaatcgctcaggccaaggcgagtcaggagggccccctgcctgagattgaagacgaggtgtttcggaaacgcaacttgacaatcatggatctacacccggggtctggaaagaccagaaggtatctgccagccattgttcgggaagcaatcaaacgaaagctcagaactttaatactggctcccacccgcgtggtcgccagcgagatggctgaagcacttaagggtatgcctattaggtaccaaacaacggccgtgaaatccgagcatactggcaaggagatcgtagacctgatgtgccacgccaccttcacaatgcgtctcttgtcaccagtgcgggttcccaattataacatgatcattatggatgaagctcattttaccgacccttctagcatcgcggcaagagggtacataagtactagggtcggaatgggcgaggccgctgccattttcatgacagcaaccccgcccggttccgtggaagcctttccacagagcaatgctgtgatccaggatgaggaacgcgacattcctgagcgatcttggaactcagggtatgagtggatcacggatttccccggaaaaactgtctggtttgtaccatccataaagagtggcaatgacattgcgaactgtctgaggaaaaatggcaagcgggtgatccagctcagcaggaagacattcgataccgaataccagaaaaccaagaacaacgactgggactacgttgtgactacagatatctcggagatgggggccaatttccgcgcagaccgtgtcattgatcctagacggtgcctgaaacccgtgatccttaaggacggaccagaaagggttattctagctggtccgatgcctgtgaccgtcgcctctgcagcccagcgccgaggcagaatagggcggaaccacaataaagagggagatcagtatatctacatgggccagcccctgaacaatgacgaggatcatgctcactggacagaagccaagatgttgttagacaacattaatactccagagggtatcatccccgcgctgtttgaacctgagagggaaaagtccgcagccattgatggggagtatcgcctcagaggcgaggctaggaaaacgttcgtggaactgatgcggcgtggagaccttccagtatggctgagctacaaggtggcctcagagggctttcaatatagtgatcgccgatggtgcttcgacggggaaagaaacaatcaggttctcgaggaaaacatggatgtcgagatatggaccaaagagggagaaaggaagaaattgcggccccgctggctggacgctagaacatactctgaccctctagcactgagggagtttaaggagttcgccgctggtcggcgatccgtgagcggcgatctcatccttgagattgggaaactgccgcagcacttaactcagagagcccaaaatgcattggacaacctggtgatgctccataattcagaacagggaggccgcgcgtataggcacgccatggaggagctgccagataccatcgaaacacttatgctgctcgctttgattgccgtcctgaccggtggggttactttatttttcctaagtggccggggactgggcaagacgagcatcgggctcctttgtgtgatggcatcctctgtactgttgtggatggctagcgtggagccccattggatagccgcatccatcattctggaatttttcctcatggtcctgcttatccctgagcccgaccgtcagagaaccccacaggataaccaactcgcctacgtggttattggactgttgtttatgatcctgacagtggctgcgaatgagatgggtttactagaaactaccaagaaagacctgggcatagggcacgtcgccgtagagaaccaccatcacgcagctatgctcgatgtggaccttcatcctgcctcagcctggacactgtacgcagttgctaccactattatcacacccatgatgaggcacacgattgaaaacaccactgccaatatctctttgacagcgatagctaaccaggccgcaatcctgatgggactcgataagggctggccaattagtaaaatggacatcggtgtgcctctgcttgccttagggtgctattcgcaggtcaatccgctgaccctcaccgctgcagtgttgatgctggtcgcccattacgcgattatcggccccggactacaagctaaggccacacgcgaggcacagaaacggactgccgctggcataatgaagaacccaacggtggatgggattgttgccatcgacctggatcctgtggtatatgacgcaaagttcgaaaaacagctcggacagatcatgcttctgattttgtgtaccagccaaatcctgctcatgcgaacaacttgggctctgtgcgagtccataaccttagccacaggcccccttaccactctgtgggagggttctccagggaagttttggaatacgacaattgcggtgtcaatggccaacatcttcagaggaagctacctcgcaggcgctggtctagccttctccctgatgaaaagtttgggcgggggaaggcgcggcaccggggcacagggagaaactctgggcgagaagtggaaacggcagctcaatcagctttctaagagcgaatttaacacctataagagatcaggtattatggaggtcgaccgttccgaagctaaagaggggctgaagaggggagagacaactaaacacgccgttagtcggggcaccgccaagttgcgctggttcgtggaacgaaatctggtcaaacctgagggtaaggtgatcgatctcggctgtgggagaggaggctggagctactattgcgcggggttaaagaaagtaacagaagtgaagggatacacgaaaggcggtcccgggcacgaggaaccgataccaatggctacctacggatggaacctggttaaacttcattctggcaaagacgtgtttttcatccctcccgagaagtgtgatactctgctatgcgacattggcgagtcctcaccaaatcccacaatcgaagaggggaggaccctccgggtcctgaaaatggtggaaccttggttgcgcggaaaccaattttgtattaagatcctgaatccgtatatgcccagcgtcgtggagactctcgagcagatgcagagaaagcacggtggcatgcttgttaggaacccactgtcgcgaaattctacacatgaaatgtactgggtaagttgcgggaccggaaacattgtgtccgcagtcaatatgacgagccggatgttactgaaccgtttcaccatggcccacagaaaacctacatatgagcgcgatgtggacttgggcgctggtactaggcacgttgccgtggaacccgaggtcgcaaacctcgatatcatagggcagcggattgaaaatatcaagcatgagcacaaatcaacctggcattacgacgaggataacccttataagacatgggcctaccacggatcctatgaagtgaaaccatctggcagcgctagttccatggtaaatggcgtggttaagctgctaactaagccctgggacgtcatccctatggtgacccaaattgcgatgacagataccactccatttgggcagcagagagtgttcaaagagaaggtcgacacgcgcacacccaaagccaagaggggaaccgcacaaataatggaagttactgctaaatggctttggggttttctgagccgaaacaagaagccgcggatctgtaccagagaggagttcacaaggaaagtgcgctctaatgccgcaattggcgccgtatttgtggacgagaaccagtggaactcagctaaggaggccgtcgaagatgagcgtttctgggacctcgtgcatcgggaaagagagctgcacaaacaggggaagtgcgcgacgtgcgtttacaacatgatgggaaaaagggaaaagaagttgggcgagtttggtaaagcaaaggggagtcgcgccatctggtacatgtggctgggagctcgattcctcgagttcgaagcccttggctttatgaatgaggatcactggttctcccgggaaaacagcctgtctggcgtggagggggagggattacataaactgggttatattttgagagacatctcgaagatacctggcgggaatatgtacgcagatgacaccgctggatgggatactaggatcacagaagacgatctccagaacgaggcccgcattaccgacatcatggaaccagagcacgctctgctagccaaatcaatttttaaacttacttatcaaaataaagtcgtgagagtacagcggcccgcaaagaacggcacagttatggatgtgatcagcaggcgtgaccagcgaggttccgggcaggtcggaacctacggcctgaatacattcactaacatggaagcgcaactcatacgccagatggagagtgagggcatattttctcctagcgaactggagaccccaaacttggccgaaagagtgttagattggctggagaagtatggggtggaacggctcaaaaggatggctatctccggagacgactgtgtcgttaagcccatcgatgaccgcttcgccacggcacttaccgctctgaatgatatgggtaaagtgagaaaggacattccgcagtgggagccttcaaaaggctggaacgattggcagcaagtacccttttgcagtcatcacttccaccagctaataatgaaggacgggcgggagatcgtggtcccatgtaggaatcaggatgaactggtgggacgagcccgtgtttctcagggcgcaggttggagcctcagagagacagcctgcttggggaagtcctacgcgcaaatgtggcagctgatgtattttcatcgccgggaccttaggctggctgccaacgcaatttgttcagccgtgcctgtcgattggatccccactagcagaaccacatggtctattcacgctcatcaccagtggatgactaccgaagacatgctctccgtgtggaatcgcgtatggatcgaggaaaacccatggatggaggataaaacgcatataagtagctggggagacgttccctacttaggcaagcgggaggaccaatggtgcggctcgctgatcgggttgacagccagggcaacctgggctactaatattcaggtggccatcaaccaggtccgaagactgattggaaatgaaaactacctcgattatatgacatccatgaaacggttcaagaatgagtctgaccctgaaggtgcgctttggtga

SEQ ID NO: 13640 - RNA, 9879 nt, synthetic construct
  misc_feature 1..9879: note = derived and/or modified CDS sequence (opt3) from DENV-1__FJ410207__SS-prME
  source 1..9879: mol_type = other RNA
agcgtgaccatgctgctcatgcttatgcccacagcactggctttccacttgactacgaggggcggggaacctcatatgatcgtctccaagcaggaaagggggaagtctttactgtttaagacctcagccggtgttaatatgtgcacactaattgccatggacctcggcgagttctgtgaagatactatgacctacaaatgcccacggataacagaagcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttatggttattgcactcttcctggcccatgctatcggcacctcgattacacagaagggcatcatatttatcctgctcatgttagtgaccccatcaatggccatgcgctgcgtcgggattggaagcagagatttcgtggagggtctgagtggcgcgacgtgggtagacgttgtgcttgagcacgggtcctgtgtcactacaatggcaaaggataaacccaccttggacatcgaactgctaaagactgaggtgacaaaccctgccgtgctcaggaaactgtgcattgaagctaagatctctaataccacgaccgatagccggtgtccaacacaaggagaggccactcttgtcgaagaacaggacgcaaactttgtttgccgccgaaccttcgtggatagaggctggggtaatgggtgtggactgtttggcaaaggctccttgataacatgcgctaagttcaagtgcgtaactaaactcgaggggaagaccgtgcagtacgaaaacctgaaatattcagtcattgtgacagttcacaccggagaccagcatcaagtgggtaatgagagtactgaacacggcacgacagccaccatcactccccaggcgcctagcaccgagattcagttaacagactacggggccctgaccctcgattgttctccaaggactggacttgactttaacgaaatggtcctgttgacaatgaaggagaaatcctggctagtgcataagcagtggttcctggatctcccgctgccctggacgtcaggcgcaagcaccagtcaagagacttggaatcggaaagaccttctggtaacatttaagaccgctcacgccaagaaacaggaagttgtggtcttgggttctcaggagggggctatgcacacagccctcactggcgcaaccgaaatccaaacgtccggaaccacaactatcttcgccggccatctgaagtgccgtttaaaaatggataagctgaccctaaaagggatgagctatgtgatgtgtacaggatcgttcaagctcgagaaggaagtcgctgagactcagcacggtaccgtgctggttcagattaaatacgagggcacggacgcgccttgcaagataccattttctacacaggatgaaaaaggggtgacccaaaacggacgccttatcactgcaaatcccattgtaacagacaaggagaaattggtcaacatcgaagccgagcctccattcggcgagtcctatatagtgattggtgctggggaaaaggccctgaagctctcatggtttaaaaagggcagtagcatcggaaaaatgttcgaggcaaccgccagaggcgctaggcggatggccatcctgggggatactgcatgggactttggatccattggtggcgttttcacctctgtggggaaacttgtccatcagatctttggaacagcgtacggcgtgctgttcagcggtgtatcatggacgatgaaaattgggataggcgtgttgctcacctggctgggattaaatagtcgatccactagcctgtctatgacatgtatcgctgttggcctagtcaccctctacctgggggtgatggtgcaggccgattcaggatgcgtcattaactggaagggccgcgaacttaagtgtggtagtgggatctttgttacaaatgaggtgcacacttggaccgaacagtataaattccaagcagacagccccaagagattgtccgccgctatcggaaaagcctgggaggagggcgtgtgcggtattaggtctgcaacgcggctggaaaacataatgtggaagcagatctcgaacgagctcaatcatattctgttagaaaacgacatgaaatttacagtagtcgtgggcgatgttgctgggatcctggcccagggaaagaaaatgattcgcccgcagcctatggagtacaagtatagctggaagtcctggggcaaagcgaagatcataggggccgacgtgcaaaataccactttcatcattgatggacccaacaccccagaatgtcctgacgatcagagagcttggaatatctgggaggtcgaggactacggctttggtattttcacaactaacatctggcttaaattgagggattcatatacccaggtgtgcgaccaccgtctcatgagtgcagccataaaggattctaaagctgttcacgccgacatggggtactggattgaaagcgagaagaatgaaacatggaagctggcacgggcgtccttcatcgaggtgaaaacgtgtatttggcccaagtcacataccctatggagcaacggagtactggaatctgagatgatcataccaaaaatctatggcggtcccatttcccagcacaattaccgacctggctactttactcaaacagccgggccatggcatctcggaaagctggagcttgatttcgacttgtgcgaaggcaccactgtcgtggtggatgagcactgcgggaacagaggaccgagtctgaggacaaccacggtcactggcaaaatcattcacgaatggtgttgccgcagctgtaccttaccccctctccggtttaagggtgaggacgggtgctggtatggaatggagatcagaccagttaaggaaaaagaggaaaatctggtgaagtctatggtatccgctggctcaggtgaggtggacagtttcagccttggcctgttgtgtatatcgattatgatcgaagaggtcatgaggtcccgctggtctcgaaaaatgctcatgacagggaccctggccgtgtttttcctactgatcatgggacagctcacttggaacgatctgattcggctttgcatcatggttggcgcaaatgctagcgaccgtatggggatgggaacaacctacttggccctgatggcaacatttaagatgagacccatgttcgccgtgggcttactctttaggcgcctgacttcacgggaggtccttctgctaaccattggtctcagtctggtggcttccgttgaattgcctaactctctggaggaattaggggatggactcgcgatgggcataatgatcctgaaacttctgacggacttccagagccatcaattgtgggccacactcctgtccctaacctttattaagactaccttctcactgcactatgcatggaagacaatggctatggtgcttagcatcgtcagtctctttccactgtgtttgtctactacctcccagaaaacgacatggctgcccgtattactcggcagcctggggtgcaagccgcttaccatgttcctgattgccgagaatagaatctggggaaggaaatcgtggcctttgaacgaaggtataatggccgtgggcatcgtttcaattctcctgtctagtctactgaagaacgatgtgccacttgctgggcccctcatcgcaggaggcatgctgattgcctgttacgtcatctccggtagctctgcggacttgagcttagagaaagctgccgaggtgtcctgggaagaggaagcagagcattcaggggccagtcacaatatactggtagaagtgcaggatgacggaactatgaagattaaagatgaggagcgagacgatacactcaccatcctgcttaaggctactctgttggcagtcagcggcgtttatcctctatctatccccgccacactgttcgtgtggtacttttggcagaagaaaaagcaacgctccggcgtgctctgggacaccccatcacctcccgaagtcgagcgggcggtgctggatgacgggatttatagaataatgcagaggggacttttaggtcgtagtcaggttggcgtaggggtgttccaggaaaacgtctttcatacgatgtggcacgtgactcgcggagctgttctgatgtaccaaggcaaacggctcgagccaagctgggcctccgtgaagaaagacttgatctcttacggtgggggatggagactgcagggctcgtggaataccggcgaggaagtccaggtgattgcagtagagccggggaagaaccctaagaatgtccagacagcccccggaaccttcaaaacaagcgaaggtgaggtgggcgctatcgccctcgattttaagccagggacttcaggatcccccattgttaacagggaaggcaaaatcgtgggtctgtatgggaatggagtcgtgaccacgagtggcacatacgtttctgcaatagctcaagccaaggcgagccaggagggccctcttccagagatcgaagacgaggtgttccgaaaacggaacctgactattatggatttgcaccccgggtccggaaagacccgcagatatctacctgccatcgtcagggaagcaattaagcggaaactgcgaacactcatcttagctccgaccagagtggtagcctcagagatggctgaagcactgaagggtatgccaatacgctaccagactaccgccgtgaaatctgagcatacaggcaaggagattgttgaccttatgtgccacgccacgtttactatgaggctgctcagccccgtccgtgtgcctaattataacatgatcatcatggatgaagctcatttcaccgacccaagttccattgcggcacgggggtacatcagcacaagagtgggaatgggcgaggccgctgccatatttatgaccgcaactccccctggttctgtcgaagccttcccgcaatcaaatgctgtaattcaggatgaggaaagggacatccccgagcgctcctggaacagtgggtatgagtggattacagattttccaggaaaaaccgtgtggttcgttcctagcatcaagtcgggcaatgacatagcgaactgtttgcgaaagaatggcaaaagagtgattcagctgtctcggaagacgttcgatactgaataccagaaaacaaagaacaacgactgggactacgtcgtgaccaccgatatctccgagatgggggccaattttagggcagaccgcgttatcgatccccgtagatgcctcaaaccagtgattctgaaggacggacctgaacgggtcatccttgctggtcccatgccagtgactgtagccagcgcagcccaaaggcgcggccgaattgggagaaaccacaataaggagggagatcagtatatatacatgggccagccgctaaacaatgacgaggatcatgctcactggacagaagccaaaatgctgttggacaacatcaatacccctgagggtattatccccgcgttattcgaaccagagcgggaaaagtcagcagccatcgatggggagtataggctgcgcggcgaggctagaaaaacatttgtggaactcatgaggcggggagacctgcccgtttggcttagttacaaggtcgcctctgagggcttccagtattccgatcgtcgctggtgctttgacggggaacgaaacaatcaagtgctggaggaaaacatggatgtggagatttggactaaagagggagaaagaaagaaactcaggcctcggtggttggacgctcgcacgtacagcgacccactggcactaagagagttcaaggaatttgccgctggtaggcggtcagtcagtggcgatctgatactcgagatcgggaaacttccccagcacctgacccagcgagcccagaatgcattagacaacttggttatgctgcataatagcgaacaaggaggcagagcgtatcgccacgccatggaggagctccctgatacaattgaaactctgatgcttctggctctcatcgccgtgttgaccggtggggtaacactgttctttttatccggcaggggactaggcaaaacctctattgggctgctctgtgtgatggcaagctccgtccttctgtggatggcttcagtggagccgcattggatcgccgcatctataatcttggagttctttctgatggttctcctgattccagagcccgaccggcagcgtactcctcaggataaccagcttgcctacgtggtcatcggactcctgttcatgattttgacggtagctgcgaatgagatgggtctgttagaaaccacaaagaaagacctaggcatcgggcacgtggccgttgagaaccaccatcacgcagctatgctggatgtggacctccatcccgccagtgcctggactctttacgcagtcgctaccacaataattaccccaatgatgagacacactatcgaaaacacaacggccaatatttcgctgaccgcgatcgctaaccaagccgcaatattgatgggactggataagggctggcctatcagcaaaatggacattggtgtgcccctcctggcccttgggtgctattcccaggtcaatccattaactctgacagctgcagtgctcatgttggttgcccattacgcgatcattggccctggactgcaggctaaggccaccagggaggcacaaaagcgcaccgccgctggcatcatgaaaaacccgacagtggatgggatagtagccattgacctagatcccgtggtctatgacgcaaagtttgaaaaacagctgggacagatcatgctccttatcctgtgtacttctcagattttgctgatgcggacgacctgggctctctgcgagtcaatcacactggccactggcccattaaccacactttgggagggtagccctgggaagttctggaataccactatagcggtttccatggccaacattttccgaggaagttacctggcaggcgctggtctcgccttttctctaatgaaaagcctgggcgggggaagaaggggcacgggggcacaaggagaaacattgggcgagaagtggaagcgccagctgaatcagctctcaaaatccgagttcaacacctataagcggagtggtatcatggaggtggacagaagcgaagctaaagaggggcttaagcgtggagagactaccaaacacgccgtctctaggggcacagccaagctgcggtggtttgtggaacgcaatttggtaaagcccgagggtaaagtgattgatctgggctgtgggcgaggaggctggtcctactattgcgcggggctcaagaaagttactgaagtgaagggatacaccaaaggcggtccagggcacgaggaacctatccccatggctacatacggatggaacttagtcaagctgcattcaggcaaagacgtgttctttacgccgccagagaagtgtgatacccttctgtgcgacataggcgagagctcgcctaatcccactatcgaagaggggagaacactaagggtcctcaagatggtggaaccatggctgcggggaaaccagttctgtattaaaatcttgaatccctatatgccttctgttgtagagaccctggagcaaatgcagcgcaagcacggtggcatgctcgtgagaaacccgcttagtagaaattccactcatgaaatgtactgggtcagctgcgggacaggaaacattgtgtcagcagttaatatgacctcccgaatgctgttaaaccggtttacgatggcccaccgtaaacccacctatgagagagatgtggacctgggcgctggtacacgccacgtcgccgtggaaccagaggtagcaaacttggatatcattgggcagaggatcgaaaatataaagcatgagcacaaatctacttggcattacgacgaggataacccttataagacctgggcctaccacggaagctatgaagtgaagcccagtggctccgctagctctatggttaatggcgtcgtgaaactcctgacaaagccttgggacgtgattccaatggtcactcagatcgcgatgaccgatacaacccccttcgggcaacagcgggtttttaaagagaaggtggacactagaacgcctaaagccaagcgcggaacagcacagatcatggaagtaaccgctaagtggctatggggtttcctttcaaggaacaaaaagccacgaatttgtactcgggaggaatttaccagaaaagtgaggagtaatgccgcaataggcgccgtcttcgtggacgagaaccaatggaactccgctaaggaggccgttgaagatgagcgcttttgggacctggtgcatcgtgaacgggagctccacaaacaggggaagtgcgcgacatgcgtctacaacatgatgggaaagagagagaagaagctgggcgagttcggtaaagcaaaggggagcagggccatctggtacatgtggttgggagctcgcttcctggagtttgaagccctcggcttcatgaatgaggatcactggttttctcgagaaaactcgctttcaggcgtggagggggagggactgcataaattaggttatattctgcgggacatcagcaagattcccggcgggaatatgtacgcagatgacacggctggatgggataccagaatcactgaagacgatttgcagaacgaggccaaaataacagacatcatggaaccggagcacgctctcctggccaagtccattttcaagctaacctatcagaataaagtagttagggtgcaacgccctgcaaagaacggcactgtcatggatgtgatcagtagacgggaccagaggggttctggacaggtgggaacatacggccttaatacctttacaaacatggaagcgcagctgattcgtcaaatggagagcgagggcatcttctccccatcagaactcgagactcccaacctggccgggcgagtcttggattggttagaaaaacatggagttgagcgcctgaagagaatggctataagtggtgacgactgtgtggtaaaacctattgatgaccggtttgccaccgcactcacggctcttaatgatatgggcaaggtgaggaaggacatcccacagtgggaaccctctaaagggtggaacgattggcagcaggtcccgttctgcagccaccactttcatcaactgatcatgaaggacggacgcgagattgtggttccttgtagaaatcaggatgagctagtgggccgggccagggtctcccagggtgcagggtggtcactgcgagaaaccgcctgcctcggaaaaagctatgcgcagatgtggcaattgatgtacttccaccgtagagacctgcgccttgctgccaacgcaatatgttctgccgtgcccgtagattgggttccaacatcccggactacctggagtatccatgctcaccatcagtggatgacaactgaggacatgctgagcgtgtggaatagggtctggattgaagagaacccttggatggaagataagacccacatctcgtcctggggcgacgtgccctatctcggcaaaagagaggaccagtggtgcgggtctttaattggactgacggcccgcgcaacatgggctaccaatatccaagttgccataaaccaggtgcggaggttgatcggtaatgagaactacctggattacatgacttcaatgaagcgatttaagaatgaaagcgacccagagggcgcgctctggtga

SEQ ID NO: 13641 - RNA, 9879 nt, synthetic construct
  misc_feature 1..9879: note = derived and/or modified CDS sequence (opt3) from DENV-1__FJ432744__SS-prME
  source 1..9879: mol_type = other RNA
agcgtgaccatgctgctaatgcttatgcccaccgcactggctttccacttgactacgagaggcggggaacctcatatgatcgtctccaagcaggaaaggggaaaatctttactgtttaagacctcagccggtgttaacatgtgcaccctgattgccatggacctcggcgagttctgtgaagatactatgacctacaaatgcccacggataacagaagcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaggacgcaaactttgtttgccgccgaacattcgtggatagaggctggggtaatgggtgtggactgtttggcaaaggctccttgataacttgcgctaagttcaagtgcgtaaccaaactcgaggggaagacagtgcagtacgaaaacctgaaatattcagtcattgtgaccgttcacactggagaccagcatcaagtgggtaatgagagtacggaacacggcacaaccgccactatcacaccccaggcgcctagcacagagattcagttaaccgactacggggccctgactctcgattgttctccaaggacaggacttgactttaacgaaatggtcctgttgacgatgaaggagaaagcatggctagtgcataagcagtggttcctggatctcccgctgccctggacctccggcgcttcaactagccaagagacatggaatcggaaagaccttctggtaacctttaagacagcccacgctaagaaacaggaagttgtggtcttgggtagtcaggagggggccatgcacactgcactcaccggcgccacggaaatccaaacctctggaacaactaccatcttcgctggccatctgaagtgccgtttaaaaatggataagctgacactaaaagggatgtcctatgtgatgtgtactgggagcttcaagctcgagaaggaagtcgcggagacccagcacggtacggtgctggttcagattaaatacgagggcacagacgcaccttgcaagataccattttcgacccaggatgaaaaaggggtgactcaaaacggacgccttatcacagccaatcccattgtaaccgacaaggagaaacctgtcaacatcgaagctgagccacccttcggcgagtcttatatagtgattggtgccggggaaaaggcattgaagctgtcctggtttaaaaagggctcaagtatcggaaaaatgttcgaggccactgctagaggcgccaggcggatggcaatcctcggggataccgcgtgggactttggaagcattggtggcgttttcacatccgtggggaagctggtccatcagatctttggaacggcttacggcgtgcttttctctggtgtaagctggaccatgaaaattgggataggcgtgctgttgacttggctcggactaaattcacgaagtacatccttaagcatgacctgtatcgccgttggcctggtcacactatacctcggggtgatggtgcaggcagattctggatgcgtcattaactggaagggccgcgaactgaagtgtggttcagggatctttgttactaatgaggtgcacacctggacggaacagtataaattccaagccgacagtccgaagagacttagcgctgccatcggaaaagcatgggaggagggcgtgtgcggtattaggtccgctacacggttggaaaacataatgtggaagcagatctctaacgagctgaatcatattctcctggaaaacgacatgaaatttaccgtagtcgtgggcgatgttgccgggatcttagcgcagggaaagaaaatgattcgccctcagcccatggagtacaagtattcgtggaaaagctggggcaaagccaagatcataggggctgacgtgcaaaatgcaactttcatcattgatggaccaaacacccctgaatgtcccgacgatcagagagcctggaatatctgggaggtcgaggactacggctttggtattttcacaactaacatctggctgaaacttagggattcctatacccaggtgtgcgaccaccgtttgatgtcagctgccataaaggatagtaaagcagttcacgcggacatggggtactggattgaatctgagaagaatgaaacatggaagctcgcccgggctagcttcatcgaggtgaaaacgtgtatttggccaaagtcccataccctgtggtcaaacggagtactagaaagcgagatgatcatacccaaaatctatggcggtcctatttctcagcacaattaccgaccaggctactttactcaaacagccgggccgtggcatctgggaaagctcgagctggatttcgacctttgcgaaggcaccactgtcgtggtggatgagcactgcgggaacagaggaccctccttgaggacaaccacggtcactggcaaaatcattcacgaatggtgttgccgcagttgtaccctgcctccattacggtttaagggtgaggacgggtgctggtatggaatggagatcagacccgttaaggaaaaagaggaaaatctcgtgaagtccatggtatctgcaggctccggtgaggtggactcattcagtctgggccttctgtgtataagcattatgatcgaagaggtcatgaggtcgcgctggtcccgaaaaatgttgatgacagggatcctcgctgtgtttttcctgctaattatgggacagctgacctggaacgatctcatccggctgtgcattatggttggcgccaatgcatctgaccgtatggggatgggaactacataccttgccttgatggctacctttaagatgagacctatgttcgcggtgggcctgttatttaggcgcctcacaagccgggaggtcctgcttctgactataggtctatcactcgtggccagtgttgaactgccaaactccttggaggaactgggggatggattagcaatgggcatcatgattctcaaactgcttaccgacttccagtctcatcaactgtgggctacgttgctcagcctgacatttatcaagaccactttctccctacactatgcctggaagaccatggccatggtgctgtcaattgtcagcctttttcccctctgtctgagtacaacttctcagaaaaccacgtggttgccggtactgttaggctccctcgggtgcaagcctctgacaatgttccttatcgctgagaataaaatatggggaagaaagagctggccactgaacgaaggtatcatggcagtgggcattgtttcgatcttgctctcatctctgctcaagaacgatgtgcccctggccgggcctcttattgcgggaggcatgctcatcgcttgttacgtcataagtggttccagcgccgacctgtctttggagaaggcagccgaggtgagctgggaagaggaagctgagcattccggggcatcacacaatattttagtagaagtgcaggatgacggaaccatgaaaatcaaggatgaggagagggacgatactctgacaatcctcctgaaggccacccttctggcggtcagtggcgtttatcccttgagcattccagctactctattcgtgtggtacttttggcagaaaaagaaacgacgctctggcgtgctgtgggacacaccttcacccccagaagtcgagcgggccgtgctcgatgacgggatatatagaatcatgcaaaggggactgcttggtcgtagccaggttggcgtaggggtgttccaggaaaacgtctttcataccatgtggcacgtgacgcgcggagcagttttaatgtaccagggcaagcggctggagccgagttgggccagcgtgaaaaaggacctcatttcctacggtgggggatggagattgcaaggctcttggaatactggcgaggaagtccaggtgatcgctgtagagcctgggaagaaccccaaaaatgtccagaccgccccaggaacattcaagacctcggaaggtgaggtgggcgcaattgctctggattttaaacccgggacaagcggatcacctatcgttaacagggaaggcaagatagtgggtctctatgggaatggagtcgtgactacctccggcacgtacgttagtgccatcgcgcaggccaaagcatctcaagagggcccactgcccgagattgaagacgaggtgttccgaaagcggaaccttacaatcatggatctgcaccctgggagcggaaagactcgcagatatttgccggctattgtcagggaagccatcaaacggaagctacgaaccctgatactcgctccaacaagagtggtagcatccgagatggccgaagccttaaaaggtatgcccattcgctaccagaccactgctgtgaagtcagagcataccggcaaagagatcgttgacctgatgtgccacgcgacatttacgatgaggcttctgtctcctgtccgtgtgccaaattataacatgatcattatggatgaagcacatttcactgaccccagcagtatcgccgctcgggggtacatatccaccagagtgggaatgggcgaggccgcagccatttttatgacagctacccctccgggtagcgtcgaagcgttcccccagtctaatgccgtaatccaagatgaggaaagggacattccagagcgctcatggaactccgggtatgagtggatcactgattttcctggaaagacagtgtggttcgttcccagtataaagagcggcaatgacattgcaaactgtctcagaaagaatggcaagagagtgatccagttgtcgcggaaaaccttcgatacggaataccagaagactaaaaacaacgactgggactacgtcgtgacaaccgatatctctgagatgggggctaattttagggccgaccgcgttattgatccacgtagatgcctgaagcctgtgatcctcaaggacggacccgaacgggtcattctggcaggtccaatgccggtgaccgtagcctccgctgcccagaggcgcggccgaatagggagaaaccacaataaagagggagatcaatatatctacatgggccagcctcttaacaatgacgaggatcatgcgcactggactgaagcaaagatgctactggacaacattaatacacccgagggtatcatcccagccttgttcgaacccgagcgggagaaaagcgctgccattgatggggagtataggttacgcggcgaggctagaaagacctttgtggaactgatgaggcggggagacctccctgtttggctgtcatacaaagtcgcaagtgagggcttccagtattctgatcgtcgctggtgctttgacggggaacgaaacaatcaggtgcttgaggaaaacatggatgtggagatatggacaaaggagggagaaaggaaaaagctgcgaccacggtggctcgacgcccgcacttactccgaccccttggctctgagagagttcaaggaatttgccgcaggtaggcggagcgtctcaggcgatctaatcctggagattgggaaactccctcaacaccttacgcagcgagcgcagaatgccctggacaacttagttatgttgcataatagtgaacagggaggcagagcttatcgccacgccatggaggagctgccggataccatcgaaacactcatgctgcttgcactgattgctgtgctcactggtggggtaaccttgttctttctgagcggcaggggattaggcaagacatccatcgggctactgtgtgtgatggcctctagcgtcctcctttggatggcatccgtggagccacattggatagccgcttcaatcattctggagttctttttgatggttctgctcatccccgagcctgaccggcaacgtacaccccaggataaccagctggcgtacgtggtcattggacttctcttcatgatcctgactgtagccgcaaatgagatgggtttgctggaaacgaccaaaaaggacttaggcatagggcacgtggctgttgagaaccaccatcacgccgccatgctagatgtggacctgcatccagcatctgcttggacactctacgccgtcgcgactaccattatcacacctatgatgagacacaccattgaaaacactacagctaatatcagtcttacggccatagcaaaccaggccgctatcctgatgggattggataaaggctggcccatttcgaagatggacatcggtgtgccactgctcgcactggggtgctatagccaagtcaatcctcttaccttaactgccgcggtgctgatgctcgttgctcattacgccattatcggcccgggattgcaggcaaaggccacaagggaggctcagaaacgcaccgccgcaggcataatgaagaaccccaccgtggatgggattgtagctatcgacctggatccagtggtctatgacacaaaatttgaaaagcaactaggacagatcatgctgctcattctttgtacttcccagatcctgttgatgcggacgacctgggccctgtgcgagtctataacactcgcgactggccctctgaccacattatgggagggttcacccgggaaattctggaataccactattgccgttagcatggcaaacatcttccgaggatcctaccttgctggcgccggtctggcatttagtctcatgaagtctctaggcgggggaagaaggggcacgggggctcagggagaaacactgggcgagaagtggaaacgccaattgaatcagctgagcaagtcagagttcaacacctataaacggtccggtattatggaggtggacagaagtgaagccaaggaggggctcaaacgtggagagactaccaagcacgccgtcagcaggggcacagcgaaacttcggtggtttgtggaacgcaatctggtaaaaccagagggtaaggtgatcgatttgggctgtgggcgaggaggctggtcttactattgcgctgggctgaaaaaggttactgaagtgaaaggatacaccaagggcggtcctgggcacgaggaacccataccgatggcaacatacggatggaacctcgtcaaattacattccggcaaggacgtgttctttatcccacctgagaagtgtgatacgctgctttgcgacattggcgagtcaagccccaatccaaccatcgaagaggggagaactctgagggtcctaaaaatggtggaaccctggctccggggaaaccagttctgtattaagatcctgaatccttatatgccgtcggttgtagagacattggagcagatgcaacgcaaacacggtggcatgctggtgagaaaccccctctctaggaatagtacccatgaaatgtactgggtctcctgcgggactggaaacattgtgagcgccgttaatatgacatcacgaatgcttctgaaccggtttaccatggctcaccgtaagccaacgtatgagagagatgtggacttaggcgccggtacccgccacgtcgcagtggaacctgaggtagccaacctggatatcatagggcagaggattgaaaatatcaaacatgagcacaagtccacatggcattacgacgaggataacccctataagacttgggcttaccacggatcttatgaagtgaaacctagcggcagtgcgtccagcatggttaatggcgtcgtgaagttgctcaccaaaccatgggacgtgatccccatggtcacacagattgccatgactgataccacacctttcgggcagcaacgggtttttaaggagaaagtggacaccagaactccaaaggcaaagcgcggaacggctcagataatggaagtaacagccaaatggctgtggggtttcctatctaggaacaagaaaccccgaatctgtacccgggaggaatttactagaaaggtgaggtcaaatgcagccattggcgctgtcttcgtggacgagaaccagtggaatagtgccaaagaggcggttgaagatgagcgcttttgggaccttgtgcatcgtgaacgggagctgcacaagcaagggaagtgcgcaacctgcgtctacaacatgatgggaaaaagagaaaagaaactcggcgagttcggtaaggccaaagggtccagggctatctggtacatgtggctgggagcccgcttcttggagtttgaagcactgggcttcatgaatgaggatcactggtttagccgagaaaactctctctcgggcgtggagggggagggacttcataagctgggttatattttacgggacatctcaaaaataccgggcgggaatatgtacgctgatgacacagccggatgggatacgagaatcaccgaagacgatctgcagaacgaggctaagattactgacatcatggaacctgagcacgccttgctcgcaaagagcattttcaaactgacatatcagaataaggtagttagggtgcagcgcccagcgaaaaacggcaccgtcatggatgtgatctccagacgggaccaaaggggtagtggacaggtgggaacttacggcctaaatacatttaccaacatggaagcccagcttatacgtcagatggagtctgagggcattttcagcccctccgaactggagacacctaacctcgctgggcgagtcctggattggttggaaaagcatggagttgagcgcttaaaaagaatggccatctcaggtgacgactgtgtggtaaagccaatcgatgaccggtttgcaactgctctgaccgccctcaatgatatgggcaaggtgaggaaagacattccccaatgggaaccgagtaaggggtggaacgattggcagcaggtccctttctgctctcaccactttcatcagcttataatgaaagacggacgcgagatcgtggttccctgtagaaatcaagatgagctggtgggccgggcaagggtcagccagggtgccgggtggtccctacgagaaacggcgtgcctgggaaagtcatatgctcagatgtggcagctcatgtacttccaccgtagagacttgcgcctggccgcaaacgccatttgtagcgctgtgccagtagattgggttcctacctctcggacaacttggtccatccatgcccaccatcaatggatgaccacagaggacatgcttagtgtgtggaatagggtctggattgaagagaacccctggatggaagataaaactcacatcagctcgtggggcgacgtgccatatctgggcaagagagaggaccagtggtgcgggtccctcataggattaaccgcacgcgctacgtgggccacaaatatccaggttgcgattaaccaagtgcggaggctgatcggtaatgagaactacttggattacatgacctctatgaagcgatttaaaaatgaaattgaccccgagggcgctctgtggtga

SEQ ID NO: 13642 - RNA, 9879 nt, synthetic construct
  misc_feature 1..9879: note = derived and/or modified CDS sequence (opt3) from DENV-1__FJ547060__SS-prME
  source 1..9879: mol_type = other RNA
agcgtgaccatgctgctcatgcttatgcccaccgccctggctttccacttgactacgaggggaggggaacctcatatgatcgtcaccaagcaggaaaggggaaaatccttactgtttaagacatctgccggtgttaatatgtgcactctaattgccatggacctcggcgaactgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggatcgttcaaactggagaaggaagtggctgagacccagcacggtacggtccttgtgcagataaagtacgagggcacagacgcgccttgcaaaatcccattctcgacccaagatgaaaagggggttactcagaacggacgcttgattacagcaaatcccatcgtgaccgacaaagagaagcctgtaaacatagaagccgagccaccctttggcgagtcttatattgtcatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtgtttacatccgttgggaaacttgtgcatcagattttcggaacggcgtacggcgtcctgttttctggtgtgagctggaccatgaagatagggatcggcgtattgctcacttggctgggattaaattcacgaagtacatccctgagcatgacctgtattgctgtgggcctagttacactctacctgggggtcatggtgcaggccgattctggatgcgtgatcaactggaaaggccgcgaacttaagtgtggttcagggatcttcgtcactaatgaggttcacacctggacggaacaatataagtttcaggcagacagtccgaaaagattgagcgccgctattggaaaggcctgggaggagggcgtgtgcggtataaggtccgcaacacggctggaaaacatcatgtggaaacagatttctaacgagctcaatcatatcctgttagaaaacgacatgaagttcaccgtggtagtcggcgatgtggttgggattctggctcagggcaaaaagatgatccgccctcaacccatggagcacaaatactcgtggaaaagctggggcaaggccaagataatcggggcggacgtgcagaatactacctttattatcgatggaccaaacacacctgaatgtcccgacgatcagagagcctggaatatttgggaggtcgaggactatggcttcggtatctttactaccaacatatggcttaagttgagggattcctacacacaggtgtgcgaccaccgtctcatgtcagctgcaattaaagatagtaaggccgttcatgctgacatggggtattggatcgaatctgagaaaaatgaaacgtggaagctggcccgggcatccttcattgaggtgaagacctgtatctggccaaaatcccacactctatggtcaaacggagtactggaaagcgagatgataatccccaagatttacggcggtcctatctctcaacataattatcgaccaggctacttcacacagaccgcggggccgtggcacctcggaaaactggagcttgattttgacttgtgcgaaggcactacagtcgtggtggatgagcactgcgggaacagaggaccctccctgaggaccacgactgtcaccggcaagattatccatgaatggtgttgccgcagttgtacattacctccactccggttcaaaggtgaggacgggtgctggtacggaatggagataagacccgttaaggaaaaggaggaaaatctggtgaaaagcatggtatctgccggctccggtgaggtggactcatttagtcttggcctgttgtgtattagcatcatgatcgaagaggtcatgaggtcgcgctggtcccgaaagatgctcatgaccgggactctggctgtgttcctactgctcattatgggacagctgacatggaacgatcttatccggttgtgcattatggttggcgccaatgcatctgaccgtatggggatgggaaccacatatctggctttaatggccacttttaaaatgagacctatgttcgcagtgggcctcctgtttaggcgccttaccagccgggaggtcctgctactcacgataggtctgtcattggtggccagtgttgaactgccaaactccttagaggaactcggggatggactggctatgggcatcatgattcttaagctgttgacagacttccaatctcaccagctctgggcgaccctgctaagcctgacttttatcaaaaccacactttccctccattacgcctggaagactatggcaatggtgctgtcaattgtcagcttgttccccctgtgtttaagtaccacgtctcagaagacaacctggctcccggtactgcttggctccctggggtgcaaacctttgactatgtttctcatcgctgagaataagatatggggaagaaaaagctggccactgaacgaaggtatcatggccgtgggcgttgtgtcgattctactgtcatctcttctcaagaacgatgtccccctggccgggcctttgatcgctggaggcatgttaattgcatgttatgtgatcagtggttccagcgccgacctgtctctcgagaaagcggctgaggtaagctgggaagaggaagccgagcactccggggcatcacataatatactggtggaagtccaggatgacggaacaatgaagattaaagatgaggagagggacgatacccttactatcctgttgaaggccacactactggctgttagtggcgtgtaccccctcagcatcccagcaaccctgttcgtgtggtatttttggcaaaagaaaaagcagcgatctggcgtcctttgggacacgccttcacccccagaagtggagcgcgccgttttagatgacgggatttaccggataatgcagagaggactgctcggtaggagccaggtaggcgtgggggtcttccaagaaaacgtgttccacactatgtggcacgttacccgtggagcggtgttgatgtatcagggcaaacgcctggagccgagttgggctagcgtcaagaaagacctcatctcctacggtgggggatggcggctgcagggctcttggaatacaggcgaggaagtgcaggtaattgccgtcgagcctgggaagaaccccaagaatgtgcaaaccgcaccaggaacatttaaaactcccgaaggtgaggttggcgccatcgctcttgatttcaagcctgggacctcgggaagcccaattgtgaacagagaaggcaaaatcgtcggtctgtacgggaatggagtggttacgacatcaggcacttatgtgtccgccatagcacagaccaaggctagtcaggagggccccttgcctgagatcgaagacgaggtctttaggaaacgaaacctaacaattatggatctgcatccggggtctggaaagacccggcgctacctcccagccatcgtgagagaagcgattaagaggaaattacggactctgatccttgcccccacccgagtagtggcaagcgagatggctgaagccctgaagggtatgcctataagatatcaaacaacggctgttaaatccgagcacactggcaaggagattgtcgacctcatgtgccatgcaaccttcacaatgcgcttgctgtcaccagtgagggtgcccaattacaacatgatcatcatggatgaagcccactttaccgacccttctagcattgccgctcgtgggtatatcagtactcgggtcggaatgggcgaggcggcagccatattcatgacagctaccccgcccggttccgtagaagcctttccacagagcaatgcagtgattcaggatgaggaaagagacatccctgagaggtcttggaactcagggtacgagtggattacggatttccccggaaaaactgtttggtttgtgccatccatcaagagtggcaatgacatagccaactgtctccgcaagaatggcaaacgagtcattcagctgagcagaaagacattcgataccgaatatcagaaaaccaagaacaacgactgggactacgtggttactacagatatctcggagatgggggctaattttcgggcggacagggtgatcgatcctcgccgttgccttaaacccgtcattctaaaggacggaccagaaagagtgatcctggccggtccgatgcctgtaaccgtggcatctgctgcccagcggaggggccgcattgggcgaaaccataataaggagggagatcagtacatatatatgggccagcccttgaacaatgacgaggatcacgcacactggacagaagccaaaatgttactggacaacatcaatactccagagggtattatccccgctctcttcgaacctgagagagaaaagtccgccgcgatcgatggggagtaccggctgaggggcgaggcacgcaaaacgttcgttgaacttatgagaaggggagacctgccagtctggctcagctataaggtggcctcagagggctttcaatacagtgatcggcgttggtgcttcgacggggaacgcaacaatcaggtgttggaggaaaacatggatgtcgagatttggaccaaagagggagaacgaaagaaactgagacccaggtggctagacgctcggacatattctgaccctctggccctccgcgagtttaaggagttcgctgcaggtagaaggtccgttagcggcgatcttatactggagatcgggaagttaccgcagcatttgactcagcgggcccaaaatgctctggacaacctcgtgatgctgcacaattcagaacagggaggccgagcctacagacatgcaatggaggagcttccagataccattgaaacactgatgctcttggcgctgatcgccgtattaaccggtggggtgactctatttttcctgagtggccgcggactcggcaaaacgagcattgggcttctgtgtgtcatggcttcctctgtgttgctgtggatggccagcgttgagccccactggatcgcagcttccataatcctcgaatttttcctgatggtgcttctcattcctgagcccgacaggcagcggaccccacaggataaccaactggcctatgtcgtaatcggattgctgtttatgattttaacagtggcagccaatgagatgggtctactggaaactaccaagaaagacctcggcatcgggcacgttgctgtggagaaccatcaccatgcgacaatgcttgatgtcgacctgcaccctgcctcagcatggaccttgtacgctgtggccactacaataattacgcccatgatgcgtcataccatcgaaaacactacagccaatatttctctgaccgcaatcgctaaccaggccgcgatactcatgggactggataagggctggccaatcagtaaaatggacattggtgtccctcttttagctctggggtgctacagccaggtgaatccgctcaccttgacagccgcagttctgatgctagtggcccactatgctatcattggccccggactgcaagcaaaggccactagagaggcgcagaagaggacggctgccggcatcatgaaaaacccaaccgtagatgggatagtggcaattgacctcgatcctgtcgtttacgacgccaagttcgaaaaacagcttggacagatcatgctgttgatcctgtgtacaagccaaattctcctgatgcgcactacctgggctttatgcgagtccatcacacttgccaccggccccctgactacgctctgggagggttctccagggaagttttggaatacaaccatagcagtgtcaatggctaacattttccggggaagctatctagccggcgcgggtctggccttttccttgatgaaaagtctgggcgggggacgaagaggcactggggcacagggagaaaccctcggcgagaagtggaagaggcagcttaatcagctgtctaaaagcgagttcaacatctacaagcgctcaggtattatggaggtcgaccggtccgaagctaaagaggggttgaagagaggagagacaactcgtcacgccgtgagtaggggcaccgcaaaactgcggtggttcgtagaacgcaatctcgtgaagcctgagggtaaggttatcgatttaggctgtgggcgaggaggctggagctattactgcgctgggctgaaaaaggtgacagaagtcaaaggatatacgaagggcggtcccgggcatgaggaaccgataccaatggccacctacggatggaaccttgtgaaactgcactctggcaaggacgtctttttcactcctcccgagaaatgtgatacactactctgcgacatcggcgagtcctcaccaaatcccaccattgaagaggggagaactctgagggtgttgaagatggttgaaccttggctgcggggaaaccaattttgtatcaagattctcaatccgtacatgcccagcgtagtggagacacttgagcagatgcagcgcaaacatggtggcatgctggtcagaaacccattatcgagaaattctacccacgaaatgtattgggtgagttgcgggacgggaaacatcgtttccgccgtgaatatgaccagccgaatgctgttgaaccggttcacaatggcgcaccgtaagcctacttacgagagagatgtcgacctcggcgctggtacccgccatgtggcagtagaacccgaggtggccaacctggatattatcgggcagaggatagaaaatattaaacacgagcataagtcaacatggcactatgacgaggataacccttacaaaacttgggcttatcatggatcctacgaagttaagccatctggcagcgccagttccatggtcaatggcgtggtgaagctacttaccaaaccctgggacgtcatccctatggttacacaaatcgcaatgaccgatactacgccatttgggcagcagcgggtgttcaaggagaaagtagacacaagaacccccaaggccaaacgcggaactgctcaaattatggaagtgaccgcgaggtggctgtggggttttctcagccgaaacaagaagccgcggatatgtacaagagaggagttcacgaggaaagtccgctctaatgccgcaatcggcgctgtgtttgttgacgagaaccagtggaactcagccaaggaggcagtggaagatgagcgtttctgggacctggtccagaaagaacgggagttgcacaagcaggggaaatgcgcaacctgcgtgtataacatgatgggaaagagagaaaagaaactgggcgagtttggtaaggctaaagggagtagggccatttggtacatgtggctcggagcgcgcttccttgagtttgaagcactgggcttcatgaatgaggatcactggttctcccgagaaaacagcttatctggcgtagagggggagggactgcataagttgggttacatcctccgggacatttcgaaaatccctggcgggaatatgtatgccgatgacactgctggatgggatacaagaataaccgaagacgatctgcaaaacgaggccaagatcactgacattatggaaccagagcacgcactacttgctacatcaatctttaaactgacctaccagaataaggttgtgagggtccagcgccccgccaagaacggcacagtgatggatgtgattagcagacgggaccagaggggttccgggcaagtcggaacttatggcctcaataccttcacgaacatggaagctcagctggttcgtcagatggagagtgagggcatcttttctccttgtgaattggagataccaaacttagccgaacgagtgctggattggctcgagaaatacggggtagaacgccttaagagaatggcaattagcggagacgactgcgtggtcaaacccatcgatgaccggttcgcgaccgccctgacagctctaaatgatatgggtaaggtgaggaaagacgttccgcagtgggagccttccaagggctggaacgattggcaacaggtgcccttttgttcacatcacttccaccagctgatcatgaaggacgggcgcgagattgtcgtgccatgcagaaatcaggatgaactcgtaggacgggccagggttagtcaaggcgcaggttggtctttgcgagagactgcttgtctggggaaaagctatgcccagatgtggcagcttatgtactttcatcgtagagacctgcgcctcgcagccaacgcgatatgctccgctgtgcctgtcgattgggtgcccacctcacggacaacttggagcatccacgcccatcaccaatggatgaccacggaagacatgttatctgtttggaatagggtgtggattgaggaaaacccatggatggaggataagacacatgtctccagttggggagacgtgccctatctgggcaaaagagaggaccagtggtgtggcagcttgatcgggctgaccgcacgcgccacttgggcttcgaatattcaggtagccatcaaccaggtgcggaggctcataggaaatgaaaactaccttgattacatgacatccatgaagcgattcaaaaatgagggtgaccctgaaggcgcactgtggtga

SEQ ID NO: 13643 - RNA, 9879 nt, synthetic construct
  misc_feature 1..9879: note = derived and/or modified CDS sequence (opt3) from DENV-1__FJ432745__SS-prME
  source 1..9879: mol_type = other RNA
agcgtgaccatgctgctcatgcttatgcccacagccctggctttccacttgactacgagaggaggggagcctcatatggtcgtttccaagcaagaaagaggaaaatctttactgtttaagacctcagcgggtgtgaatatgtgcacactgatcgccatggacctcggcgagctgtgtgaagatactatgacctacaaatgcccacggattacagaggcggaaccggacgatgtagactgttggtgcaatgctaccgatacttgggtgacatatgggacctgtagtcaaacgggagagcaccgccgagacaagcgtagcgtcgcccttgcaccccatgtgggcctgggtttggagactagaaccgaaacatggatgtcctctgagggggcctggaaacagatacagagggttgaaacttgggctctccggcaccctggattcaccgtgatcgcactgtttctggcccatgctattggcacatcgatcacccagaagggcattatcttcatactcttaatgctggtcacgccatcaatggccatgcgctgcgtggggatcggaagcagagattttgtagagggtcttagtggcgcgacttgggttgacgtggtcttggagcacgggtcctgtgtgacaaccatggcaaaggataaacccactctggacattgaactgctcaagacagaggtgaccaaccctgccatcctgaggaaactttgcattgaagctaagatctctaatacgaccacagatagccggtgtccaactcaaggagaggccaccctggtcgaagaacaagacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatgtgtactggtagcttcaaactggagaaggaagtcgctgagacccagcacggaacggtgcttgttcagataaagtacgagggcacagacgcgccttgcaaaatcccattctcgacccaagatgaaaagggggtgactcagaacggacgcttgattacagcaaatcccatcgtaaccgacaaagagaagcctgtcaacatagaagccgagccaccctttggcgagtcttatattgtgatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtttttacatccgtggggaaacttgtccatcagattttcggaacggcgtacggcgtgctgttttctggtgtaagctggaccatgaagatagggttgggcgtgctcctgacttggttaggactaaattcacgaagtacatccctaagcatgacctgtatcgctgttggcctcgtcacactgtaccttggggtgatggtgcaggccgattctggatgcgtcattaactggaaaggccgcgaattgaagtgtggttcagggatcttcgttactaatgaggtgcacacctggacggaacaatataagtttcaggcagacagtccgaaaagactgagcgccgctatcggaaaggcctgggaggagggcgtgtgcggtattaggtccgcaacacggctcgaaaacgtaatgtggaaacagatatctaacgagctgaatcatatcttactggaaaacgacatgaagttcaccgtcgtggttggcgatgtggctgggattcttgcccagggcaaaaagatgatccgccctcaacccatggagtacaaatattcgtggaaaagctggggcaaggcgaagattatcggggccgacgtccagaatactacctttataatcgatggaccaaacacacctgaatgtcccgacgatcagagagcttggaatatttgggaggtggaggactacggcttcggtatctttactaccaacatttggttgaagctcagggattcctatacacaggtttgcgaccaccgtctgatgtcagcagccatcaaagatagtaaggctgtgcacgccgacatggggtactggatagaatctgagaaaaatgaaacgtggaagctagcacgggcgagcttcattgaggtaaagacctgtatctggccaaaatcccatactctgtggtcaaacggagtcctcgaaagcgagatgattatccccaagatatatggcggtcctatctctcaacacaattaccgaccaggctacttcacacagaccgccgggccgtggcatctgggaaaacttgagttggattttgacctgtgcgaaggcactacagtggtggtcgatgagcactgcgggaacagaggaccctccttaaggaccacgactgttaccggcaagattatccacgaatggtgttgccgcagttgtacactccctccactgcggttcagaggtgaggacgggtgctggtatggaatggagattaggcccgtgaaagaaaaggaggaaaatcttgtaaagagcatggtgtctgctggctccggtgaggtcgactcatttagtctgggcttgctctgtatcagcataatgattgaagaggtgatgcgctcgcgatggtcccggaaaatgctgatgaccgggactctagccgttttcctgctcctgatcatgggacagcttacatggaacgatttgatccgtctgtgcattatggtgggcgcaaatgcttctgacagaatggggatgggaaccacatacttagccctcatggcaacttttaagatgaggcctatgttcgccgtcggcctgctttttcgccggctgaccagcagagaggtgctactcctgacgatcggtttgtcactggttgctagtgtggaattaccaaactccctcgaggaactgggggatggacttgcgatgggcattatgatactgaaattgctcacagacttccaatctcatcagctgtgggccaccctactgagccttacttttatcaagaccacattctccctccactatgcatggaaaactatggctatggtcctgtcaattgtatccttgtttcccctgtgtttaagtaccacgtctcagaagacaacctggctcccggtgctgcttggctccctggggtgcaagcctttgactatgttcctcatcgccgagaataaaatttggggaaggcgaagctggccactgaacgaaggtatcatggccgttggcatagtgtcgatcctactgtcatctcttctcaagaacgatgtccccctggctgggcctttgattgcaggaggcatgttaatcgcctgttacgtgattagtggttccagcgcggacctgtctctcgagaaagctgccgaggtaagctgggaagaggaagcagagcattccggggcctcacacaatatcctggtggaagtccaggatgacggaacaatgaagataaaagatgaggagcgcgacgatacccttactattctgttgaaggctacactactggcagttagtggcgtgtatcccctcagcatcccagccaccctgtttgtgtggtacttctggcagaaaaagaagcagcggtctggcgtcctttgggacacgccttcacccccagaagtggagagagcggttttagatgacgggatctataggattatgcagcgtggactgctcggtcgcagccaggtaggcgtgggggtcttccaagaaaacgtgtttcatactatgtggcacgttacccggggagctgtgttgatgtaccagggcaaaagactggagccgagttgggccagcgtcaagaaagacctcatatcctacggtgggggatggaggctgcagggctcttggaatacaggcgaggaagtgcaggtaatcgcagtcgagcctgggaagaaccccaaaaatgtgcaaaccgccccaggaacattcaagactcccgaaggtgaggttggcgctattgcccttgattttaagcctgggacctcgggaagcccaatcgtgaaccgagaaggcaaaattgtcggtctgtatgggaatggagtggttacgacatcaggcacttacgtgtccgcaatcgctcaggccaaggcgagtcaggagggccccttgcctgagatagaagacgaggtcttccggaaacgcaacctaaccatcatggatctgcacccggggtctggaaagacaagaaggtatctcccagccattgtgcgggaagcaatcaaacgaaagttaagaaccctgattcttgctcccactcgcgtagtggccagcgagatggctgaagcactgaagggtatgcctatcaggtaccaaaccacagccgttaaatccgagcatacgggcaaggagatagtcgacctcatgtgccacgccacttttaccatgcgtttgctgtcaccagtgcgggtgcccaattataacatgattatcatggatgaagctcatttcacagacccttctagcatcgcggcaagagggtacattagtaccagggtcggaatgggcgaggccgctgccatctttatgactgcaacaccgcccggttccgtagaagccttcccacagagcaatgctgtgatacaggatgaggaacgcgacattcctgagcgatcttggaactcagggtatgagtggatcaccgattttcccggaaaaacggtttggttcgtgccatccattaagagtggcaatgacatcgcgaactgtctcaggaaaaatggcaagcgggtcatacagctgagcaggaagacttttgatacagaataccagaaaaccaagaacaacgactgggactacgtggttaccactgatatttcggagatgggggccaatttccgcgcagaccgtgtgatcgatcctagacggtgccttaaacccgtcatcctaaaggacggaccagaaagggtgattctggctggtccgatgcctgtaacagtggcctctgcagcccagcgccgaggcagaatcgggcggaaccacaataaagagggagatcagtatatttacatgggccagcccttgaacaatgacgaggatcatgctcactggaccgaagccaagatgttactggacaacataaatacaccagagggtatcattcccgcactcttcgaacctgagagggaaaagtccgcagccatcgatggggagtatcgcctgagaggcgaggctaggaaaacttttgttgaacttatgcggcgtggagacctgccagtctggctcagctacaaggtggcctcagagggcttccaatatagtgatcgccgatggtgctttgacggggaaagaaacaatcaggtgttggaggaaaacatggatgtcgagatctggacgaaagagggagaaaggaagaaactgcggccccgctggctagacgctagaacctactctgaccctctggcactcagggagttcaaggaatttgccgctggtcggcgatccgttagcggcgatcttattctggagatagggaaattaccgcagcacttgacacagagagcccaaaatgcactggacaacctcgtgatgctgcataattcagaacagggaggccgcgcgtataggcacgccatggaggagcttccagatactatcgaaaccctgatgctcttggctctgattgccgtattaacaggtggggtgaccctattctttctgagtggccggggactcggcaagactagcatcgggcttctgtgtgtcatggcatcctctgtgttgctgtggatggctagcgttgagccccattggattgccgcatccatcatactcgagttctttctgatggtgcttctcatccctgagcccgaccgtcagagaacgccacaggataaccaactggcctacgtcgtaattggattgctgttcatgatcttaaccgtggctgcgaatgagatgggtctactggaaacaactaagaaagacctcggcattgggcacgccgcagttggaaaccaccatcacgctgccatgcttgatgtggacctgcatcctgcctcagcatggaccttgtacgctgtcgccacaaccatcataactcccatgatgaggcacacaattgagaacacgaccgcgaatatctctctgactgctattgccaaccaggcagccatcctcatgggcctggataagggttggccaataagtaaaatggacatcggggtgcctcttttagctctgggctgctattcgcaggtcaatccgctcacattgaccgcagccgtgctgatgctagttgcgcattacgctattatcggacccggcctgcaagccaaggcaacccgcgaagcccagaaacggacagctgccgggattatgaagaacccaactgtggatggaatcgtagcaatagacctcgatcctgtggtctatgacgctaagtttgagaaacagcttggccagattatgctgttgatcctgtgtacgagccaaatcctcctgatgcgaaccacatgggccttatgcgaatccattactcttgcgaccggtcccctgacaaccctctgggaggggtctccaggaaagttctggaatactacgatcgccgtttcaatggcaaacatatttagaggcagctacctagctggtgccggcctggcattctccttgatgaaaagtctagggggaggcaggcgcgggacaggagctcagggcgagaccctcggtgaaaagtggaaacggcagcttaatcagctgtctaagagcgagttcaacacttataagagatcagggattatggaagtggaccgttccgaggccaaagaaggattgaagaggggcgagaccacaaaacacgccgtcagtcggggtactgcgaagctgcgctggtttgtggagcgaaatctcgtaaaacctgaaggcaaggtgatcgatttagggtgtggaagaggcgggtggagctactattgcgctggactgaagaaagttaccgaggtgaagggctacacaaaaggtgggcccggacacgaagaaccgattccaatggcaacgtacggctggaaccttgtcaagctgcattctggcaaagacgtgttctttatccctcccgaaaagtgtgataccctactctgcgacataggggagtcctcaccaaatcccactatcgaggaaggaaggacactgcgggtcttgaaaatggtggagccttggctgcgcggtaaccaattctgtattaagatcctcaatccgtatatgcccagcgttgtagaaacccttgagcagatgcagagaaagcacggcgggatgctggtgaggaacccattatcgcgaaattctactcatgagatgtactgggtcagttgcggaacaggcaacattgtgtccgccgttaatatgaccagccggatgctgttgaaccgttttacgatggctcacagaaaacctacctatgaacgcgatgtggacctcggtgccgggacaaggcacgtcgcagtggagcccgaagtagccaacctggatatcattggacagcggatcgagaatataaagcatgaacacaaatcaacttggcattacgacgaggataacccttataagacctgggcttaccacggctcctatgaggtgaaaccatctggcagcgcgagttccatggttaatggggtcgtgaagctacttacaaagccctgggacgtgattcctatggtcactcaaatcgccatgaccgatacaaccccattcggacagcagagagtttttaaagaaaaggtggacactcgcacgcccaaagcaaagaggggtacagctcaaatcatggaggtaaccgccaaatggctgtggggcttcctcagccgaaacaagaagccgcggatttgtactagagaagagtttaccaggaaagtgcgctctaatgcagccataggggctgtcttcgtggacgaaaaccagtggaactcagccaaggaggcggttgaggatgaacgtttttgggacctggtgcatcgggagagagaattgcacaaacagggaaagtgcgcaacatgcgtctacaacatgatgggcaaaagggagaagaagctgggtgagttcgggaaagccaagggaagtcgcgctatctggtacatgtggctcggcgcccgatttcttgagttcgaggcactgggcttcatgaatgaagatcactggttttcccgggagaacagcttatctggggtggaaggagagggtctgcataaattgggctatattctcagagacatctcgaagattcctgggggaaatatgtacgctgatgacacggccggctgggataccaggatcactgaggacgatctgcagaacgaagctcgcataacagacatcatggagccagaacacgccctacttgcaaaatcaattttcaagctgacctatcaaaataaagtagttagagtgcagcggcccgcgaagaacggtactgtcatggatgtgatcagcaggcgtgaccagcgagggtccggacaggtgggcacatacggcctcaatacctttacaaacatggaggcccaactgattcgccagatggaaagtgaggggatcttctctcctagcgagttggaaactccaaacttagctgagagagtcctggattggctcgaaaagtatggagttgagcggcttaaaaggatggccatatccggtgacgactgtgtggtaaagcccattgatgaccgctttgcaaccgctctgacggccctaaatgatatgggcaaagtgagaaaggacatcccgcagtgggaaccttcaaaagggtggaacgattggcagcaagtccccttctgcagtcatcactttcaccagctgatcatgaaggacggacgggagattgtggttccatgtaggaatcaggatgagctcgtgggccgagcacgtgtctctcagggtgccgggtggagcttgagagaaaccgcgtgcctgggaaagtcctacgctcaaatgtggcagcttatgtatttccatcgccgggacctgaggctcgccgcaaacgccatatgttcagctgtgcctgtagattggatccccacaagcagaactacctggtctattcacgcccatcaccagtggatgacaactgaggacatgttatccgtttggaatcgcgtgtggatcgaagagaacccatggatggaagataaaacccatattagtagctggggcgacgtcccctacctgggcaagcgggaggaccaatggtgcgggtcgttgatcggactgacggcaagggctacatgggccaccaatatacaggtggcgatcaaccaggttcgaagactcattggtaatgagaactaccttgattatatgacttccatgaaacggtttaagaatgaatctgaccctgagggcgctctgtggtga

SEQ ID NO: 13644 - RNA, 9879 nt, synthetic construct
  misc_feature 1..9879: note = derived and/or modified CDS sequence (opt3) from DENV-1__FJ432746__SS-prME
  source 1..9879: mol_type = other RNA
tccgtgaccatgctgctcatgcttatgcccacagcactggctttccacttgactacgagaggaggggagcctcatatgatcgtctccaagcaggaaaggggaaaatctttactgtttaagacctcagccggtgttaacatgtgcacactaattgcaatggacctcggcgagttctgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaggaacaggacgcaaactttgtttgccgccgaacattcgtggatagaggctggggtaatgggtgtggactgtttggcaaaggctccttgataacttgcgctaagttcaagtgcgtaaccaaactcgaggggaagattgtgcagtacgaaaacctgaaatattcagtcatcgtgacagttcacaccggagaccagcatcaagtgggtaatgagagtactgaacacggcacgacagccaccattactccccaggcgcctagcaccgagatccagttaacagactacggggccctgaccctcgattgttctccaaggactggacttgactttaacgaaatggtcctgttgacaatgaaggagaaatcctggctagtgcataagcagtggttcctggatctcccgctgccctggacgtcaggcgcaagcaccagtcaagagacttggaatcggcaggaccttctggtaacatttaaaaccgctcacgccaagaagcaggaagttgtggtcttgggttctcaagagggggctatgcacacagccctcactggcgcaaccgaaatccagacgtccggaaccacaactattttcgccggccatctgaaatgccgtttaaagatggataaactgaccctaaaggggatgagctatgtgatgtgtacaggatcgttcaaactcgagaaggaagtcgctgagactcagcacggtaccgtgctggttcagataaagtacgagggcacggacgcgccttgcaaaatcccattttctacacaagatgaaaagggggtgacccagaacggacgccttattactgcaaatcccatcgtaacagacaaagagaagcctgtcaacatagaagccgagccacccttcggcgagtcctatattgtgatcggtgctggggaaaaagccttgaagctgtcatggtttaagaaaggcagtagcatcggaaagatgttcgaggcaaccgccagaggcgctaggcggatggccattctcggggatactgcatgggactttggatccatcggtggcgttttcacctctgtggggaaactggtccatcagatttttggaacagcgtacggcgtgcttttcagcggtgtatcatggacgatgaagatagggatcggcgtgctgttgacctggctcggactgaatagtcgatccactagcttatctatgacatgtattgctgttggcctggtcaccctatacctcggggtgatggtgcaggccgattcaggatgcgtcatcaactggaaaggccgcgaactgaagtgtggtagtgggatctttgttacaaatgaggtgcacacttggaccgaacaatataagttccaggcagacagcccgaaaagactttccgccgctattggaaaggcctgggaggagggcgtgtgcggtataaggtctgcaacgcggttggaaaacatcatgtggaaacagatttcgaacgagctgaattacatcctcctggaaaacgacatgaagttaacagtagtcgtgggcgatgttgctgggattctggcccagggcaagaagatgatccgccctcaacccatggagtataaatacagctggaagtcctggggcaaggcgaaaataatcggggccgacgtgcagaataccacttttattatcgatggaccaaacacccctgaatgtcccgacgatcagagagcttggaatatttgggaggtcgaggactatggcttcggtatctttacaactaacatatggcttaagttgagggattcatacacccaggtgtgcgaccatcgtctcatgagtgcagccattaaagatacaaaggctgttcacgccgacatggggtattggatcgaatctgagaaaaatgaaacgtggaagctggcacgggcgagcttcattgaggtgaagacctgtatctggccaaaatcccacactctatggtcaaacggagtactggaaagcgagatgataatccccaagatttacggcggtcctatctctcaacataattaccgaccaggctatttcacacagaccgccgggccgtggcacctcggaaaactggagcttgattttgacttgtgcgaaggcactacagtcgtggtggatgagcattgcgggaacagaggaccctccctgaggaccacgactgtcaccggcaagattatccacgaatggtgttgccgcagttgtacattacctccactccggttcaaaggtgaggacgggtgctggtacggaatggagataagacccgttaaggaaaaggaggaaaatctggtgaaaagcatggtatctgctggctccggtgaggtggactcatttagtcttggcctgttgtgtattagcatcatgatcgaagaggtcatgaggtcgcgctggtcccgaaagatgctcatgaccgggactctggccgtgttctttctactgattatgggacagctcacatggaacgatctgatccggctttgcattatggttggcgcaaatgcttctgaccgtatggggatgggaaccacatatttggccctgatggcaactttcaaaatgagacctatgtttgccgtgggcttactcttcaggcgcctgaccagccgggaggtccttctgctaacgataggtctctcactggtggctagtgttgaattgccaaactccctggaggaattaggggatggactcgcgatgggcatcatgattctgaaacttctgacagactttcaatctcaccagttgtgggccaccctcctgagcctaactttcgtgagaaccacattttccctgcattacgcatggaaaactatggctatggtcctttcaatcgtaagcctcttccccctgtgtttgagtaccacgtctcagaagacaacctggctgccggtgttactcggctccctggggtgcaagcctcttactatgtttctgattgccgagaataaaatctggggaagaaagagctggccattgaacgaaggtataatggccgttggcatcgtgtcgattctcctgtcatctctactgaaaaacgatgtcccccttgctgggcctctcatcgcaggaggcatgctgattgcctgttatgtgatcagtggttccagcgcggacttgtctttagagaaggctgccgtagtgagctgggaggaagaggcagaacactccggggcctcacataatatactggtcgaggttcaggatgacggaacaatgaaaattaaggatgaggaacgagacgataccctcactatcctgcttaaagctacactgttggcagtgagtggcgtgtaccccctaagcatcccagccaccctgttcgtctggtatttctggcaaaagaagaaacagcgctctggcgtgctctgggacacgccttcacccccagaggttgaacgggcggtactggatgacgggatttacagaataatgcagaggggacttttaggtcgtagccaggtgggcgtcggggtgtttcaagagaacgttttccacactatgtggcatgtgacccgcggagctgtcctgatgtaccagggcaagcggctcgaaccgagttgggccagcgtgaaaaaggacttgatctcctatggtgggggatggagactgcagggctcttggaatacaggcgaggaggtacaggtcattgcagtggaacctgggaaaaaccccaagaatgttcaaaccgccccaggaacatttaagacttcggagggtgaagtgggcgctatcgccctcgatttcaaacccgggaccagcggatcacctattgtcaacagggagggcaagatcgtgggtctgtacgggaatggagttgtgacgacatccggcacttatgtcagtgcaatagctcaggccaaagcgtctcaggaaggcccacttcccgagatcgaggacgaagtgtttcgaaagcggaacctgaccattatggatttgcaccctgggagcggaaaaacacgcagatacctaccggccatcgtaagggaggcaattaagcggaagctgcgaaccctcatcttagctccaactagagtggttgcctccgaaatggctgaggcactgaaaggtatgcccatacgctatcaaaccacagccgtcaagtcagaacacacgggcaaagagattgtggaccttatgtgccatgccactttcaccatgaggctgctctctcctgtgcgtgtcccaaattacaacatgatcatcatggatgaggctcactttacagaccccagcagtattgcggcacgggggtatatctccaccagagtaggaatgggcgaagccgctgccatattcatgactgcaacacctccgggtagcgtggaggcctttccccagtctaatgctgttattcaggatgaagagagggacatcccagaacgctcatggaactccgggtacgagtggattaccgatttccctggaaagacggtgtggtttgtccccagtatcaaaagcggcaatgacatagcgaactgtttgcgaaagaatggcaagagagtgattcagctgtcgcggaaaactttcgatacagagtaccaaaagaccaaaaacaacgactgggactatgttgtgaccactgatatctctgaaatgggggccaatttcagggcagaccgcgtcatcgatccacgtagatgcctcaagcctgtgattctgaaagacggacccgagcgggtaatccttgctggtccaatgccggtgacagttgcctccgcagcccagaggcgcggccgaattgggagaaaccataataaggaaggagatcagtacatatatatgggccagcctctaaacaatgacgaggatcacgctcattggaccgaggccaagatgctgttggacaacatcaatacacccgaaggtattatcccagcgttatttgagcccgaacgggagaaaagcgcagccatcgatggggaatacaggctgcgcggcgaggctagaaagactttcgtcgagctcatgaggcggggagacctgcctgtgtggctttcatataaagtggccagtgaaggctttcaatactctgatcgtcgctggtgcttcgacggggagcgaaacaatcaggtcctggaagagaacatggatgttgaaatttggacgaaggagggagagaggaagaagctcaggccacggtggttggacgctcgcacctattccgaccccctggcactaagagaatttaaagagttcgccgctggtaggcggagcgtgtcaggcgatctgatactcgaaatcgggaaacttcctcagcacctgacacagcgagcccaaaatgcattagacaacttggtaatgctgcacaatagtgagcagggaggcagagcgtaccgccatgccatggaggaactcccggatactattgagaccctgatgcttctggctctcatcgccgtgttgacaggtggggtcaccctgtttttcttaagcggcaggggactaggcaagacttccattgggctgctctgtgtgatggcatctagcgttcttctgtggatggcttccgtggaaccacactggatcgccgcatcaataatcttggagtttttcctgatggtcctcctgattcccgaacctgaccggcagcgtacgccccaggataaccaacttgcctacgtagtgatcggactcctgtttatgattttgaccgttgctgcgaatgagatgggtctgttagagacaactaaaaaggacctaggcatcgggcatgtggccgtcgaaaaccaccaccatgcagctatgctggatgtggacctccacccagcctctgcctggaccctttatgcagtcgctacaaccataattactcctatgatgagacatacaatcgagaacacgaccgccaatattagtctgactgcgatcgctaaccaggccgcaatattgatgggactggataaaggctggcccatctcgaagatggacattggtgtgccactcctggcccttgggtgctacagccaggttaatcctttaacactgaccgctgcagtgctcatgttggtagcccactatgcgatcattggcccgggactgcaagctaaagccaccagggaagcacagaagcgcacagccgctggcatcatgaagaaccccactgtggatgggatagtcgccattgacctagatccagttgtgtacgacgcaaaattcgagaagcagctgggacagatcatgctccttatcctgtgtacgtcccaaattttgctgatgcggaccacatgggctctctgcgaatctatcactctggccaccggccctttaacaaccctttgggagggttcacccgggaaattttggaatactacgatagcggtcagcatggccaacattttccgaggatcctatctggcaggcgctggtctcgccttcagtctaatgaagtctctgggcgggggaagaaggggcacaggggcacagggagagaccttgggcgaaaaatggaagcgccagctgaatcagctcagcaagtcagagtttaacacttacaaacggtccggtatcatggaagtggacagaagtgaggctaaggaagggcttaaacgtggagagaccacaaagcatgccgtaagcaggggcactgccaaactgcggtggttcgtggagcgcaatttggttaagccagaaggtaaggtgattgatctgggctgtgggcgaggaggctggtcttattactgcgcggggctcaaaaaggtcaccgaggtgaaaggatacacaaagggcggtcctgggcacgaggaacccatcccgatggctacgtatggatggaacttagtcaaactgcactccggcaaggacgtgtttttcataccacctgaaaaatgtgatacccttctgtgcgacatcggcgagtcaagccccaatccaactattgaggaagggagaacactaagggttctcaagatggtagagccctggctgcggggaaaccaattttgtatcaagattttgaatccttacatgccgtcggtggtcgaaaccctggagcagatgcagcgcaaacatggtggcatgctcgtgagaaaccccctttctaggaatagtactcacgagatgtattgggtttcctgcgggacaggaaacatcgtgagcgcagtcaatatgacctcacgaatgctgttaaaccggttcacgatggcccatcgtaagccaacctacgaaagagatgtggacctgggcgctggtacacgccacgtagccgtggagcctgaagttgcaaacttggatattatcgggcagaggatagagaatattaaacacgaacataagtccacttggcactatgacgaggataacccctacaaaacctgggcctatcatggatcttacgaggtcaagcctagcggcagtgcttccagcatggtgaatggcgtggtcaagctcctgacaaaaccatgggacgttatccccatggtgactcaaatcgcgatgaccgatacaaccccttttgggcagcagcgggtattcaaggaaaaagtggacactagaacgccaaaggccaaacgcggaacagcacaaattatggaggtcaccgctaagtggctatggggttttctttctaggaacaagaaaccccgaatatgtactcgggaagagttcaccagaaaggtgaggtcaaatgccgcaatcggcgccgtttttgtggacgaaaaccagtggaatagtgctaaagaggccgtcgaggatgaacgcttctgggacctggtgcaccgtgagcgggaactccataagcaggggaaatgcgcgacatgcgtatacaacatgatgggaaagagagagaagaaactgggcgaatttggtaaggcaaaagggtccagggccatttggtatatgtggttgggagctcgcttcctggagttcgaggccctcggctttatgaatgaagatcactggttcagccgagagaactctctttcgggcgttgaaggggagggactgcacaagttaggttacatcctgcgggacatttcaaaaatcccgggcgggaatatgtatgcagatgacacggctggatgggataccagaataactgaggacgatttgcagaacgaagccaagatcacagacattatggagcctgaacatgctctcctggccaaaagcatctttaagctaacctaccaaaataaggtggtcagggtgcagcgcccagccaaaaacggcactgtgatggatgtcatttccagacgggaccagaggggtagtgggcaggttggaacatatggccttaataccttcacaaacatggaggcgcaactgatccgtcagatggaatctgagggcatatttagcccctccgagctcgaaactcctaacctggccgggcgagtgttggattggttagagaagcacggagtagaacgcctgaaaagaatggctatttcaggtgacgactgtgtggtcaagccaatcgatgaccggttcgccaccgcactcacggctcttaatgatatgggcaaagtgaggaaggacatcccccagtgggagccgagtaaggggtggaacgattggcagcaagttcctttttgctctcatcacttccaccagctgattatgaaagacggacgcgaaatagtggtcccctgtagaaatcaggatgagctagtgggccgggccagggtaagccagggtgcagggtggtccctgcgagagaccgcctgcctcggaaagtcatacgcgcaaatgtggcagttgatgtattttcatcgtagagacctgcgccttgctgccaacgcaatctgtagcgccgttccagtggattgggtccctacatctcggactacctggtccattcacgctcatcaccagtggatgacaactgaagacatgctgagtgtgtggaatagggtttggatcgaggaaaacccctggatggaggataaaacccatattagctcgtggggcgacgtgccatacctcggcaagagagaagaccaatggtgcgggtccttaatcggactgacggcccgcgcaacatgggctaccaatatacaggtcgccatcaaccaggtgcggaggttgctgggtaatgagaactacctcgattatatgacttctatgaaacgattcaagaatgagtcagaccccgaaggcgcgctttggtga

SEQ ID NO: 13645 - RNA, 9879 nt, synthetic construct
  misc_feature 1..9879: note = derived and/or modified CDS sequence (opt3) from DENV-1__FJ432748__SS-prME
  source 1..9879: mol_type = other RNA
agcgtgaccatgctgctcatgcttatgcccacagccctggctttccacttgactacgagaggaggggaacctcatatgatcgtctccaagcaggaaagaggaaaatctttactgtttaagacctcagccggtgttaatatgtgcacactaattgccatggacctcggcgaactgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccggatcgttcaaactggagaaggaagtcgccgagacgcagcacggtacagtgcttgttcagataaagtacgagggcaccgacgctccttgcaaagtgccattctcgactcaagatgaaaagggggtaacacagaacggacgcttgatcaccgcgaatcccattgtcactgacaaagagaagcctgtgaacatcgaagcagagccaccctttggcgagtcttatatagttattggtgccggggaaaaagctctgaagctctcctggttcaagaaaggctcaagtatcggaaagatgtttgaggccaccgcaagaggcgccaggcggatggctatcctgggggatacagcctgggacttcggaagcattggtggcgtgtttacgtccgtcgggaaacttgtgcatcagatcttcggaaccgcatacggcgtactgttttctggtgtgagctggactatgaagattgggataggcgttttgctcacatggctgggattaaattcacgaagtacctccctgagcatgacatgtatcgcggtcggcctagtgactctctacctgggggtgatggtccaggctgattctggatgcgttattaactggaaaggccgcgaacttaagtgtggttcagggatcttcgtgaccaatgaggtgcacacgtggacagaacaatataagtttcaggccgacagtccgaaaagattgagcgcagccatcggaaaggcttgggaggagggcgtatgcggtattaggtccgccacccggctggaaaacataatgtggaaacagatctctaacgagctcaatcatattctgttagaaaacgacatgaagttcactgtcgtggttggcgatgtggcagggatcctggctcagggcaaaaagatgattcgccctcaacccatggagtacaaatattcgtggaaaagctggggcaaggccaagatcataggggcggacgtccagaataccacatttatcattgatggaccaaacactcctgaatgtcccgacgatcagagagcctggaatatctgggaggtggaggactacggcttcggtatttttaccacaaacatctggcttaagttgagggattcctatacgcaggtttgcgaccaccgtctcatgtcagctgcaataaaagatagtaaggccgtgcacgctgacatggggtactggattgaatctgagaaaaatgaaacctggaagctggcccgggcatccttcatcgaggtaaagacttgtatttggccaaaatcccatacactatggtcaaacggagtcctggaaagcgagatgatcatacccaagatctatggcggtcctatttctcaacacaattaccgaccaggctacttcacccaggcggccgggccgtggcatctcggaaaactggagcttgattttgacttgtgcgaaggcactacagtggtggtcgatgagcactgcgggaacagaggaccctccctgaggaccacgactgttaccggcaagatcattcacgaatggtgttgccgcagttgtacattacctccactccggttcaaaggtgaggacgggtgctggtatggaatggagatcagacccgtgaaggaaaaggaggaaaatctggtaaaaagcatggtgtctgctggctccggtgaggtcgactcatttagtcttggcctgttgtgtataagcattatgatcgaagaggtgatgaggtcgcgctggtcccgacggatgctcatgaccgggactctggccgttttctttctactgatcatgggacagctcacatggaacgatctgattcgtctttgcatcatggtgggcgcaaatgcttctgacagaatggggatgggaaccacatacttggccctgatggcaactttcaagatgaggcctatgtttgccgtcggcttactcttccgccggctgaccagcagagaggtgcttctgctaacgattggtctctcactggttgctagtgtggaattgccaaactccctggaggaattaggggatggactcgcgatgggcataatgatcctgaaacttctgacagactttcaatctcatcagttgtgggccaccctcctgagcctaactttcattaagaccacattttccctgcactatgcatggaaaactatggctatggtcctttcaatcgtaagcctcttccccctgtgtttgagtaccacgtctcagaagacaacctggctgccggtgttactcggctccctggggtgcaagcctcttactatgtttctgattgccgagaataaaatctggggaaggcgaagctggccattgaacgaaggtataatggccgttggcatcgtgtcgattctcctgtcatctctactgaagaacgatgtcccccttgctgggcctctcatcgcaggaggcatgctgattgcctgttacgtgatcagtggttccagcgcggacttgtctttagagaaagctgccgaggtaagctgggaagaggaagcagagcattccggggcctcacacaatatactggtggaagtccaggatgacggaacaatgaagattaaagatgaggagcgcgacgataccctcactatcctgcttaaggctacactgttggcagttagtggcgtgtatcccctaagcatcccagccaccctgttcgtgtggtacttctggcagaaaaagaagcagcggtctggcgtcctctgggacacgccttcacccccagaagtggagagagcggttctggatgacgggatttataggataatgcagcgtggacttttaggtcgcagccaggtaggcgtgggggtctttcaagaaaacgtgttccatactatgtggcacgttacccggggagctgtgctgatgtaccagggcaaaagactcgagccgagttgggccagcgtcaagaaagacttgatctcctacggtgggggatggaggctgcagggctcttggaatacaggcgaggaagtgcaggtaattgcagtcgagcctgggaagaaccccaaaaatgtgcaaaccgccccaggaacatttaagactcccgaaggtgaggttggcgctatcgccctcgatttcaagcctgggacctcgggaagcccaattgtgaaccgagaaggcaaaatcgtcggtctgtatgggaatggagtggttacgacatcaggcacttacgtgtccgcaatagctcaggccaaggcgagtcaggagggcccccttcctgagatcgaagacgaggtctttcggaaacgcaacctgaccattatggatttgcacccggggtctggaaagacaagaaggtatctaccagccatcgtgcgggaagcaattaaacgaaagctgagaaccctcatcttagctcccactcgcgtagtggccagcgagatggctgaagcactgaagggtatgcctataaggtaccaaaccacagccgttaaatccgagcatacgggcaaggagattgtcgaccttatgtgccacgccactttcaccatgcgtctgctctcaccagtgcgggtgcccaattataacatgatcatcatggatgaagctcattttacagacccttctagcattgcggcaagagggtacatcagtaccagggtcggaatgggcgaggccgctgccatattcatgactgcaacaccgcccggttccgtagaagcctttccacagagcaatgctgtgattcaggatgaggaacgcgacatccctgagcgatcttggaactcagggtatgagtggattaccgatttccccggaaaaacggtttggtttgtgccatccatcaagagtggcaatgacatagcgaactgtttgaggaaaaatggcaagcgggtcattcagctgagcaggaagactttcgatacagaataccagaaaaccaagaacaacgactgggactacgtggttaccactgatatctcggagatgggggccaatttccgcgcagaccgtgtgatcgatcctagacggtgcctcaaacccgtcattctgaaggacggaccagaaagggtgatccttgctggtccgatgcctgtaacagtggcctctgcagcccagcgccgaggcagaattgggcggaaccacaataaagagggagatcagtatatatacatgggccagcccctaaacaatgacgaggatcatgctcactggaccgaagccaagatgctgttggacaacatcaatacaccagagggtattatccccgcgttatttgaacctgagagggaaaagtccgcagccatcgatggggagtatcgcctgagaggcgaggctaggaaaactttcgttgaactcatgcggcgtggagacctgccagtctggcttagctacaaggtggcctcagagggctttcaatatagtgatcgccgatggtgcttcgacggggaaagaaacaatcaggtgctggaggaaaacatggatgtcgagatttggacgaaagagggagaaaggaagaaactccggccccgctggttggacgctagaacctactctgaccctctggcactaagggagtttaaggagttcgccgctggtcggcgatccgttagcggcgatctgatactcgagatcgggaaacttccgcagcacctgacacagagagcccaaaatgcattagacaacttggtgatgctgcataattcagaacagggaggccgcgcgtataggcacgccatggaggagctcccagatactattgaaaccctgatgcttctggctctcatcgccgtattgacaggtggggtgaccctgtttttcttaagtggccggggactaggcaagactagcattgggctgctctgtgtcatggcatcctctgtgcttctgtggatggctagcgttgagccccattggatcgccgcatccataatcttggaatttttcctgatggtgctcctgattcctgagcccgaccgtcagagaacgccacaggataaccaacttgcctacgtcgtaatcggactcctgtttatgattttgaccgtggctgcgaatgagatgggtctgttagaaacaactaagaaagacctaggcatcgggcacgttgccgtggagaaccaccatcacgcagctatgctggatgtcgacctccatcctgcctcagcctggaccctttacgcagtggctacaaccataattactcccatgatgaggcacacaatcgaaaacacgaccgccaatatttctctgactgcgatcgctaaccaggccgcaatattgatgggactggataagggctggccaatcagtaaaatggacattggtgtccctctcctggcccttgggtgctatagccaggtgaatccgttaacactgaccgctgcagttctcatgttggtggcccattacgcgatcattggccccggactgcaagctaaggccacccgcgaggcacagaaacggacagccgctggcatcatgaagaacccaactgtagatgggatagtggccattgacctagatcctgtcgtttatgacgcaaagttcgaaaaacagctgggacagatcatgctccttatcctgtgtacgagccaaattttgctgatgcgaaccacatgggctctctgcgagtccatcactctggccaccggccccttaacaaccctttgggagggttctccagggaagttttggaatactacgatagcggtgtcaatggccaacattttcagaggaagctacctggcaggcgctggtctcgccttctccctaatgaaaagtctgggcgggggaaggcgcggcacaggggcacagggagaaaccttgggcgagaagtggaaacggcagctgaatcagctctctaagagcgaatttaacacttataagagatcaggtatcatggaggtcgaccgttccgaagctaaagaggggcttaagaggggagagaccacaaaacacgccgtgagtcggggcactgccaagctgcgctggttcgtagaacgaaatttggtgaaacctgagggtaaggttattgatctgggctgtgggagaggaggctggagctactattgcgcggggctcaagaaagtgaccgaagtcaagggatacacaaaaggcggtcccgggcacgaggaaccgatcccaatggctacgtacggatggaacttagtgaagctgcattctggcaaagacgtctttttcatacctcccgagaagtgtgatacccttctgtgcgacatcggcgagtcctcaccaaatcccactattgaagaggggaggacactacgggtgctcaaaatggttgaaccttggctgcgcggaaaccaattttgtatcaagattttgaatccgtatatgcccagcgtagtggagaccctggagcagatgcagagaaagcacggtggcatgctcgtcaggaacccactttcgcgaaattctactcatgaaatgtactgggtgagttgcgggacaggaaacatcgtttccgcagtgaatatgaccagccggatgctgttaaaccgtttcacgatggcccacagaaaacctacctatgagcgcgatgtcgacctgggcgctggtacaaggcacgtggccgtagaacccgaggtggcaaacttggatattatcgggcagcggatagaaaatattaagcatgagcacaaatcaacttggcattacgacgaggataacccttataagacctgggcctaccacggatcctatgaagttaaaccatctggcagcgctagttccatggtcaatggcgtggtgaagctcctgacaaagccctgggacgtcatccctatggttactcaaatcgcgatgaccgatacaaccccatttgggcagcagagagtgttcaaagagaaggtagacactcgcacgcccaaagccaagaggggaacagcacaaattatggaagtgaccgctaaatggctatggggttttcttagccgaaacaagaagccgcggatatgtactagagaggagttcaccaggaaagtccgctctaatgccgcaatcggcgccgtgtttgttgacgagaaccagtggaactcagctaaggaggccgtggaagatgagcgtttctgggacctggtccatcgggaaagagagctccacaaacaggggaagtgcgcgacatgcgtgtacaacatgatgggaaaaagggaaaagaagctgggcgagtttggtaaagcaaaggggagtcgcgccatttggtacatgtggttgggagctcgattcctggagttcgaagccctcggctttatgaatgaggatcactggttctcccgggaaaacagcctttctggcgtagagggggagggactgcataaattaggttatatcctgagagacatttcgaagatccctggcgggaatatgtacgcagatgacacggctggatgggataccaggataactgaagacgatttgcagaacgaggcccgcatcacagacattatggaaccagagcacgctctcctggccaaatcaatctttaagctaacctatcaaaataaagttgtgagagtccagcggcccgcaaagaacggcactgtgatggatgtgattagcaggcgtgaccagcgaggttccgggcaggtcggaacatacggccttaataccttcacaaacatggaagcgcaactgatccgccagatggagagtgagggcatattttctcctagcgaactcgagactccaaacctggccgaaagagttttggattggttagagaagtatggggtggaacggctgaaaaggatggctatttccggagacgactgtgtagtgaagcccatcgatgaccgcttcgccaccgcactcacggctcttaatgatatgggtaaagtcagaaaggacatcccgcagtgggagccttcaaaaggctggaacgattggcagcaagtgcccttttgcagtcatcacttccaccagctgattatgaaggacgggcgggagatagttgtgccatgtaggaatcaggatgagctagtcggacgagcccgtgtgtctcagggcgcaggttggagcctgagagagaccgcctgcctcgggaagtcctacgcgcaaatgtggcagttgatgtattttcatcgccgggacctgaggcttgctgccaacgcaatctgttcagccgtacctgttgattggattcccacaagcagaactacctggtctatccacgctcatcaccagtggatgacaactgaagacatgctgtccgtgtggaatcgcgtctggattgaggaaaacccatggatggaggataaaacccatatcagtagctggggagacgtgccctacctcggcaagcgggaggaccaatggtgcggctcgttaatagggctgacggccagggcaacatgggctaccaatatccaggttgccattaaccaggtgcgaagattgatcggaaatgaaaactacctggattatatgacttccatgaaacggttcaagaatgagtctgaccctgaaggtgcgctctggtga

SEQ ID NO: 13646 - RNA, 9879 nt, synthetic construct
  misc_feature 1..9879: note = derived and/or modified CDS sequence (opt3) from DENV-1__FJ432749__SS-prME
  source 1..9879: mol_type = other RNA
agcgtgaccatgctgctcatgcttatgcccacagccctggctttccacttgactacgagaggcggggagcctcatatgatcgtcaccaagcaggaaaggggaaaatccttactgtttaagacatctgcaggtgttaacatgtgcactctaattgccatggacctcggcgagctgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagagcaggacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattaccccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggaagcttcaaactggagaaggaagtggctgagacccagcacggtacggtccttgtgcagataaagtacgagggcacagacgcgccttgcaaaatcccattcttgacccaagatgaaaagggggttactcagaacggacgcctgattacagcaaatcccatcgtgaccgacaaagagaagcctgtaaacatagaagccgagccaccctttggcgagtcgtatattgtcatcggtgctggggaaaaagccctcaagctgtcttggttcaagaaaggctcctcaatcggaaagatgtttgaggcaactgccagaggcgctaggcggatggccattcttggggataccgcatgggacttcggaagtatcggtggcgtgtttacaagcgttgggaaactggtgcatcagattttcggaacggcgtacggcgtcttgttttccggtgtgtcttggaccatgaagatagggatcggcgtactcctgacttggttaggactgaatagccgatcaacaagtctatccatgacctgtattgctgtgggcctcgttacactgtaccttggggtcatggtgcaggccgatagcggatgcgtgatcaactggaaaggccgcgaattgaagtgtggttctgggatcttcgtcactaatgaggttcacacctggacggaacaatataagtttcaggcagactcaccgaaaagactgagtgccgctattggaaaggcctgggaggagggcgtgtgcggtataaggagcgcaacacggctcgaaaacatcatgtggaaacagatttccaacgagctgaatcatatcttactggaaaacgacatgaagttcaccgtggtagtcggcgatgtggttgggattcttgctcagggaaaaaagatgatccgccctcaacccatggagcacaaatactcttggaagtcgtggggcaaggccaaaataatcggggcggacgtgcagaatactacctttattatcgatggaccaaacacacctgaatgtcccgacgatcagagagcctggaatatttgggaggtcgaggactatggcttcggtatctttactaccaacatatggttgaagctcagggatagctacacacaggtgtgcgaccaccgtctgatgtccgctgcaattaaagattcaaaggccgttcatgctgacatggggtattggatcgaaagtgagaaaaatgaaacgtggaagctagcccgggcatctttcattgaggtgaagacctgtatctggccaaaaagccacactctgtggtccaacggagtactcgaatcagagatgataatccccaagatttacggcggtcctatcagccaacataattatcgaccaggctacttcacacagaccgcggggccgtggcacctgggaaaacttgagttggattttgacctgtgcgaaggcactacagtcgtggtggatgagcactgcgggaacagaggaccctctttaaggaccacgactgtcaccggcaagattatccatgaatggtgttgccgctcctgtacactccctccactgcggttcaaaggtgaggacgggtgctggtacggaatggagataagacccgttaaggaaaaggaggaaaatcttgtgaaaagtatggtaagcgccggctctggtgaggtggactccttttcactgggcttgctctgtattagtatcatgatcgaagaggtcatgaggagccgctggtcgcgaaagatgctgatgaccgggactctagctgtgttcctgctcctgattatgggacagcttacatggaacgatttgatccggctgtgcattatggttggcgccaatgcatccgaccgtatggggatgggaaccacatatttagctctcatggccacttttaaaatgagacctatgttcgcagtgggcctgctttttaggcgcctgacctctcgggaggtcctactcctgacgataggtttgagcctggtggcctcagttgaattaccaaacagtctcgaggaactgggggatggacttgctatgggcatcatgattctgaagttgctcacagacttccaatcccaccagctgtgggcgaccctactgtctcttacttttatcaaaaccacactcagcctgcattacgcctggaagactatggcaatggtgttgtccattgtctcactgttccccttatgtctcagcaccacgagtcagaagacaacctggctgccggtacttctgggctctttggggtgcaaacctctcactatgtttctgatcgctgagaataagatatggggaagaaaatcctggccactaaacgaaggtatcatggccgtgggcgttgtgagcattctgctttcgtcactcctgaagaacgatgtccccttggccgggcctttaatcgctggaggcatgctgattgcatgttatgtgatctctggtagttccgccgacctcagcctggagaaagcggctgaggtatcttgggaagaggaagccgagcacagcggggcatcccataatatacttgtggaagtccaggatgacggaacaatgaagattaaagatgaggagagggacgataccctgactatcttgctaaaggccacactgctcgctgtttcaggcgtgtaccccctgagtatcccagcaacccttttcgtgtggtatttttggcaaaagaaaaagcagcgaagcggcgtcttatgggacacgccttctcccccagaagtggagaaagccgttctggatgacgggatttaccgcataatgcagcggggactcttgggtagatcccaggtaggcgtgggggtcttccaagaaaacgtgttccacactatgtggcacgttaccaggggagcggtgctgatgtatcagggcaagcgtctcgagccgtcatgggctagtgtcaaaaaggacctgatcagctacggtgggggatggcgccttcagggctcctggaatacaggcgaggaagtgcaggtaattgccgtcgagcctgggaagaaccccaaaaatgtgcaaaccgcaccaggaacatttaagactcccgaaggtgaggttggcgccatcgctctggatttcaaacctgggacctctggatcgccaattgtgaaccgggaaggcaagatcgtcggtttgtacgggaatggagtggttacgacaagcggcacttatgtgtcagccatagcacaggctaaagcctcccaggagggccccctacctgagatcgaagacgaggtctttagaaagaggaacctgaccattatggatctccatccggggagtggaaagacacgacggtacttaccagcgatcgtgcgcgaagccattaaaagaaagctgaggacccttatcctggcacccactcgggtagtggcttctgagatggccgaagctctcaaaggtatgcctatacgatatcaaaccacagcagttaagagcgagcacacgggcaaagagattgtcgacttgatgtgccatgccactttcaccatgagactgctctccccagtgcgcgtgcccaattacaacatgatcatcatggatgaagcccactttacagacccttcatctattgctgcgagggggtatatcagcacccgtgtcggaatgggcgaggcagccgctatattcatgactgccacaccgcccggtagtgtagaagcatttccacagtccaatgccgtgattcaggatgaggaacgggacatccctgagagaagctggaactctgggtacgagtggattaccgatttccccggaaagacggtttggtttgtgccatcaatcaagtccggcaatgacatagctaactgtctgaggaaaaatggcaagcgcgtcattcagcttagtcgaaaaactttcgatacagaatatcaaaagaccaaaaacaacgactgggactacgtggttaccactgatatcagcgagatgggggcgaattttagagccgaccgggtgatcgatcctaggcgctgcctaaagcccgtcattctgaaggacggaccagaacgtgtgatcttggcaggtccgatgcctgtaacagtggcttcggccgcacagagacggggcaggattgggcgcaaccataataaagagggagatcagtacatatatatgggccagcccttaaacaatgacgaggatcacgcccactggaccgaagctaagatgctgctcgacaacatcaatacaccagagggtattatccccgccctgttcgaacctgagcgagaaaaatctgcggcaatcgatggggagtacagacttcggggcgaggccaggaagactttcgttgaactgatgcgcagaggagacctcccagtctggttgtcctataaagtggctagcgagggctttcaatactcagataggcggtggtgcttcgacggggaacgtaacaatcaggtgctggaggaaaacatggatgtcgagatttggacgaaggagggagaacgcaaaaagctacgacccagatggctggacgccaggacctatagtgaccctctcgctcttcgggagtttaaggaattcgcagccggtcgcagatctgtttccggcgatctgatattagagatcgggaaattgccgcagcatctgacacagagggctcaaaatgccctcgacaacctggtgatgcttcacaatagcgaacagggaggccgggcataccgacatgcgatggaggagctgccagatactattgaaaccctcatgttgctggccttaatcgctgtactaacaggtggggtgaccctgtttttcctctcaggcagaggacttggcaagactagtattggggtcctgtgtgtgatggccagctccgttttgctgtggatggcatctgtggagccccactggatcgctgccagcataatcctcgaatttttcctgatggtccttctcattcctgagcccgaccgccagaggacgccacaggataaccaactggcatatgtagtgatcggattgctgtttatgattttaaccgttgccgctaatgagatgggtctactggaaacaactaaaaaggacctcggcatcgggcacgtggcggtcgagaaccatcaccatgccaccatgcttgatgtggacctgcaccctgcatccgcttggacattgtacgccgtcgccaccactataattacacccatgatgcggcatacgatcgaaaacaccactgcaaatatttcactgacagctatcgccaaccaggcggctatactcatgggactggataaaggctggccaatctctaagatggacattggtgtgcctcttttagccctggggtgctacagtcaggttaatccgctcaccttgaccgcagccgtgctgatgctagtagctcactatgcaatcattggccccggactgcaagccaaggcgacacgtgaggctcagaaaagaactgccgcaggcatcatgaagaacccaacggtggatgggatagtcgccattgacctcgatcctgttgtgtacgacgctaaattcgaaaagcagcttggacagatcatgctgttgatcctgtgtacctcgcaaattctcctgatgaggacaacttgggccttatgcgagagcatcacccttgcaacaggccccctgaccactctctgggagggttccccagggaaattttggaatacgacaatagctgtctctatggccaacattttccgcggatcatatctagcgggcgccggtctggcatttagcttgatgaagtccctgggcgggggacggcgaggcaccggggctcagggagaaactctcggcgagaagtggaaaagacagcttaatcagctgagtaagtctgaattcaacatctacaaaaggagcggtattatggaggtggaccgctcagaagccaaggaggggttgaaacggggagagaccacaagacacgcagtatcccgtggcactgctaagctgaggtggttcgtggaacggaatctcgttaagcctgagggtaaagtgatcgatttaggctgtgggcgcggaggctggagttattactgcgccgggctgaagaaagtcaccgaagtgaagggatatacaaaaggcggtcccgggcatgaggaaccgataccaatggccacgtacggatggaaccttgtcaagctgcacagcggcaaagacgtgtttttcacccctcccgagaagtgtgatactctactctgcgacatcggcgagtcttccccaaatcccacaattgaagaggggcgaaccctgagagttttgaagatggtagaaccttggctgaggggaaaccaattttgtatcaaaattctcaatccgtacatgccctcagtggtcgagactcttgagcagatgcagcggaagcatggtggcatgctggtgcgcaacccattaagcagaaattcgacacacgaaatgtattgggtttcttgcgggaccggaaacatcgtgagtgcggtcaatatgacgtccaggatgctgttgaaccgattcaccatggctcaccggaaacctacatacgagcgtgatgtggacctcggcgcaggtactagacatgtagccgtggaacccgaggttgctaacctggatattatcgggcagcgcatagaaaatattaagcacgagcataaaagcacctggcactatgacgaggataacccttacaagacatgggcctatcatggatcatacgaagtcaagccatccggctctgcaagcagtatggtgaatggcgtggtcaaactacttactaagccctgggacgttatccctatggtgacccaaatcgccatgacagataccactccatttgggcagcagagggtattcaaagagaaggtggacacgcggacacccaaagctaagagaggaaccgcgcaaattatggaagtcactgcccgctggctgtggggttttctctccaggaacaagaaaccgcgaatatgtacccgggaggaattcacaagaaaggtgaggagcaatgcagctatcggcgccgtttttgtggacgagaaccagtggaattctgcaaaagaggccgtcgaagatgagcgcttctgggacctggtgcagaaggaacgtgagttgcacaaacaggggaagtgcgctacgtgcgtatataacatgatgggaaagcgggaaaaaaagctgggcgagtttggtaaagccaaggggtcaagagcgatttggtacatgtggctcggagcaaggttccttgagtttgaagccctgggcttcatgaatgaggatcactggttcagtcgcgaaaactccttaagcggcgttgagggggagggactgcataaattgggttacatcctccgagacatttctaagatccctggcgggaatatgtatgctgatgacaccgccggatgggatactcggataacagaagacgatctgcaaaacgaggcaaaaatcaccgacattatggaaccagagcacgctctacttgccacttcgatctttaagctgacataccagaataaggtggtcagagtgcagaggcccgctaaaaacggcaccgtgatggatgtcatttcacgcagagaccagcggggtagcgggcaagttggaacatatggcctcaatactttcaccaacatggaagcccagctgatcaggcagatggagtccgagggcatatttttgcctagtgaattagagacgccaaacctggcagaacgtgtgctcgattggcttgagaagtacggggtagaacgactgaaacgcatggcgatttctggagacgactgtgtggtcaagcccatcgatgacagattcgccaccgctctaacagccctgaatgatatgggtaaagtgcggaaggacatcccgcagtgggagcctagcaagggctggaacgattggcaacaggttcccttttgctcccatcacttccaccagctcattatgaaagacgggagggagatagtggtcccatgtcgcaatcaggatgaattggtgggaagagcacgggtatcacaaggcgctggttggagtctgagggagactgcctgccttgggaagtcttatgcacagatgtggcagctgatgtactttcatcgacgtgacctcagattagccgcgaacgctatctgtagcgccgttcctgtggattgggtccccacctcccgcacaacttggtcaattcacgcacatcaccaatggatgaccacggaagacatgctgagcgtgtggaatcgggtttggatcgaggaaaacccatggatggaggataaaacacatgtgtcttcctggggagacgtcccctatttgggcaagagggaggaccagtggtgcggcagtctgattgggctcaccgccagagctacttgggccagcaatatccaggtggcaataaaccaggtacgccggcttatcggaaatgaaaactacctggattacatgacatcgatgaaaaggttcaagaatgagggtgaccctgaaggcgctttttggtga

SEQ ID NO: 13647 - RNA, 9879 nt, synthetic construct
  misc_feature 1..9879: note = derived and/or modified CDS sequence (opt3) from DENV-1__FJ410212__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagctgtgtgaagatactatgacctacaaatgcccacggataacagaggcggaaccggacgatgtggactgttggtgcaatgctaccgatacttgggtaacatatgggacctgtagtcaaacgggagagcaccgccgagagaagcgtagcgtggcccttgcaccccatgtcggcctgggtttggaaactagaaccgagacatggatgtcctctgaaggggcctggaaacagatccagagggtggagacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagactttgtggagggtcttagtggcgcgacttgggtagatgttgtgttggaacacgggtcctgtgtcacaaccatggcaaaggacaaacccactctggatatcgagctactcaagacagaagtgaccaaccctgccgtgctgaggaaactttgcattgaggctaagatctctaatacgaccacagacagccggtgtccaactcaaggagaagccaccctggtcgaggagcaggatgcaaacttcgtttgccgccgaacatttgtggacagaggctggggtaatgggtgtggattgttcggcaaaggctccctcctgacttgcgctaagtttaagtgcgtaaccaaattagaagggaagatagtgcagtacgagaacctgaaatattcagtcattgtgacagttcacaccggagatcagcatcaagtgggtaatgaaagtactgagcacggcacgacagccaccatcactccccaggcgcctaccacagaaattcagctcaccgactacggggcccttactctggactgtagcccaaggacaggattggatttcaacgagatggtcctactgacgatgaaggagaaatcttggctcgtgcataagcagtggtttctggaccttccgctgccctggacctccggcgcatcaactagccaagaaacatggaatcggcaggatttgctcgtaaccttcaaaacagctcacgccaagaagcaggaggttgtggtcctgggtagtcaagaaggggctatgcacactgccttaaccggcgcaacggagatccagacctctggaacaactaccatctttgccggccatctgaaatgccgtctaaagatggacaaactcacactgaaggggatgtcctatgtgatgtgtactggaagcttcaaacttgaaaaggaggtcgctgagacccagcacggtacggtgttggttcagattaagtacgaaggcacagatgcgccttgcaaaataccattctcgacccaagacgagaagggggtgactcagaacggacgcctgatcacagcaaatcccattgtaaccgataaagaaaagcctgtcaacatcgaggccgagccaccctttggcgaatcttatatagtgattggtgctggggagaaagccctcaagctgtcctggttcaagaaaggctcaagtatcggaaagatgtttgaagcaactgccagaggcgctaggcggatggccatccttggggacaccgcatgggatttcggaagcattggtggcgtttttacatccgtggggaaactggtccatcagatcttcggaacggcgtacggcgtgttgttttctggtgtaagctggaccatgaagattgggataggcgctctcctgacttggttaggactgaattcacgaagtacatccctaagcatgacctgtatcgccgtgggcctcgttacactgtaccttggggtcatggtgcaggcagactctggatgcgtgattaactggaaaggccgcgagttgaagtgtggttcagggatcttcgtcactaatgaagttcacacctggacggagcaatataagtttcaggccgatagtccgaaaagactgagcgctgccatcggaaaggcatgggaggaaggcgtgtgcggtattaggtccgctacacggctcgagaacataatgtggaaacagatctctaacgaactgaatcatattttactggagaacgacatgaagttcaccgtggtagtcggcgacgtggccgggatccttgttcagggaaaaaagatgattcgccctcaacccatggaatacaaatattcgtggaagagctggggcaaggcgaaaatcataggggccgatgtgcagaattccacttttatcattgacggaccaaacacccctgagtgtcccgatgaccagagagcttggaatatctgggaggtcgaagattacggcttcggtatttttacaactaacatctggttgaagctcagggactcatatacccaggtgtgcgatcaccgtctgatgagtgcagccataaaagactctaaggctgttcacgccgatatggggtactggattgagagcgaaaaaaatgagacatggaagctagcacgggcgtccttcatcgaagtgaagacgtgtatttggccaaaatcacataccctgtggagcaacggagtactcgagtctgagatgatcatacccaagatccacggcggtcctatttcccaacataattatcgaccaggctacttcactcagacagccgggccgtggcacctgggaaaacttgaattggactttgatctgtgcgagggcaccactgtcgtggtggacgaacactgcgggaacagaggacccagtttaaggacaaccacggtcactggcaagatcattcatgagtggtgttgccgcagctgtaccctccctccactgcggttcagaggtgaggatgggtgctggtacggaatggaaatcaggcccgttaaagagaaggaagagaatcttgtgaagtctatggtatccgctggctcaggtgaagtggacagttttagcctgggcttgctctgtatatcgattatgatcgaggaggtcatgcgctcccgatggtctcggaaaatgctgatgacagggaccctagccgtgttctttctgctcatcatgggacagctgacttggaacgaccttattcgtttgtgcatcatggttggcgcaaatgctagcgatagaatggggatgggaacaacctatctggccttaatggcaacattcaagatgaggcctatgtttgccgtgggcctcctgttccgccggcttacttcaagagaagtcctgctactcaccattggtctgagtttggtggcttccgttgagctgccaaactctttagaagagctcggggacggactggcgatgggcataatgatccttaaactgttgacggattttcaaagctaccagctctgggccacactgctatccctgaccttcattaagactaccttttcacttcactatgcatggaaaacaatggctatggtgctcagcatcgtcagtctgttccccttgtgtctgtctactacctcccagaagacgacatggttaccggtactcctgggcagccttgggtgcaagcctctgaccatgtttttgattgccgaaaataaaatctggggaaggaagtcgtggccactcaacgagggtataatggccgtgggcatcgtttcaattctgctatctagtctgcttaaaaacgacgtgcccctcgctgggcctctgatcgcaggaggcatgttgattgcctgttacgtcatctccggtagctctgcggatttaagcctggagaaggctgccgaagtgtcctgggaggaagaggcagaacattcaggggccagtcacaatatactcgtagaggtgcaggacgatggaactatgaaaattaaggacgaggaacgagatgacacactgaccatccttctgaaagctactttgctagcagtcagcggcgtttatcccctgtctatcccagccacactcttcgtgtggcatttctggcaaaagaagaaacagcgctccggcgtgctgtgggataccccttcacccccagaggtcgaacgggcggtgcttgacgatgggatttacagaataatgcagaggggattactgggtcgtagtcaggttggcgtaggggtgtttcaagagaacgtcttccacacgatgtggcacgtgactcgcggagctgttctcatgtatcagggcaagcggttggagccgagctgggcctccgtgaaaaaggacctgatctcttacggtgggggatggagatttcagggctcgtggaataccggcgaagaggtccaggtgattgcagtagaacctgggaaaaaccccaagaatgtccaaacagccccaggaaccttcaagacacccgagggtgaagtgggcgctatcgccctcgactttaaacctgggactagcggatcaccaattgttaacagggagggcaagatcgtgggtctgtacgggaatggagtcgtgaccacgtccggcacatatgttagtgcaatagctcaggccaaagcgtctcaggagggcccccttcctgaaatcgaggatgaagtgttccgaaagcggaacctgactattatggacttgcatccggggagcggaaaaacccgcagatacctaccagccatcgtcagggaggcaattaagcggaagctgcgaacactcatcttagctcccaccagagtggtagcctccgaaatggctgaggcactgaaaggtatgcctatacgctatcaaactaccgccgtgaagtcagagcacacaggcaaagaaattgttgatcttatgtgccatgccacgtttactatgaggctgctctctccagtccgtgtgcccaattacaacatgatcatcatggacgaggctcacttcaccgatcctagcagtattgcggcacgggggtatatctccacaagagtgggaatgggcgaagccgctgccatatttatgaccgcaactccgcccggtagcatggaggccttcccacagtctaatgctgtcattcaggacgaagagagggatatccctgagcgctcatggaactccgggtacgaatggattacagactttcccggaaagaccgtatggttcgtgccaagtatcaaagcgggcaatgatatagccaactgtttgcgaaagaatggcaagagagttattcagctgagccggaaaacgttcgacactgagtatcaaaagacaaaaaacaacgattgggactacgtggtcaccaccgacatctcggaaatgggggcaaattttagggctgatcgcgtgatcgaccctcgtagatgcctcaagcccgttattctgaaagatggaccagagcgggtgatccttgccggtccgatgcctgtcactgtggcatctgccgctcagaggcgcggccgaattgggagaaaccataataaggagggagaccagtacatatatatgggccagcccctaaacaatgatgaagaccacgcccactggacagaggcgaagatgctgttggataacatcaataccccagaaggtattatccccgcattattcgagcctgaacgggagaaatccgccgctatcgacggggagtacaggctgcgcggcgaagccagaaagacatttgtagagctcatgaggcggggagatctgccagtgtggcttagctataaagttgcttcagaaggcttccaatacagtgaccgtcgctggtgctttgatggggagcgaaacaatcaggtcctggaagagaacatggacgtggagatttggactaaggaaggagagagaaaaaagctcaggccccggtggttggatgcacgcacgtattctgaccctctggccctaagagaattcaaagagtttgctgccggtaggcggtccgtgagcggcgacctgatactcgaaatcgggaagcttccgcagcatctgacccagcgagcacaaaatgcgttagataacttggtcatgctgcacaattcagagcagggaggcagagcctaccgccatgctatggaggaactcccagacacaattgagactctgatgcttctggccctcatcgcagttttgaccggtggggtgacactgttctttttaagtggcaagggactaggcaaaaccagcattgggctgctctgtgtaatggcttcctctgtgcttctgtggatggccagcgtcgaaccccactggatcgcagcctccataatcttggagttctttctgatggtgctcctgattcctgagcccgataggcagcggactccacaggacaaccaacttgcttatgttgtgatcggactcctgttcatgattttgacggtcgcggccaatgaaatgggtctgttagagaccacaaagaaagatctaggcatcgggcacgtagcagtggaaaaccatcaccatgctgccatgctggacgttgatctccaccctgcctcagcatggactctttacgctgtggccaccacaatagtcacccccatgatgcgtcatactattgagaacacaacggcgaatatctctctgaccgctattgccaaccaggcagccatcttgatgggactggacaagggctggccaataagtaaaatggatatcggtgtgcctctcctggctcttgggtgctactcgcaggtcaatccgttaactctgacagcagccgtgctcatgttggttgcgcactatgctattatcggccccggactgcaagccaaggcaaccagagaagcccagaagaggaccgctgccggcattatgaaaaacccaacaatcgacgggatagtggcaattgatctagaccctgtagtgtacgatgctaagtttgagaaacagctgggacagatcatgctccttatcctgtgtactagccaaattttgctgatgcgcacgacctgggccctctgcgagtccatcacactggcgactggccccttaaccacactttgggaaggttctccagggaagttctggaataccactatagccgtctcaatggcaaacattttccggggaagctatctggctggcgccggtctcgcattttccctaatgaaaagtctgggcgggggacgaagaggcacgggggctcagggagagacattgggcgaaaagtggaagaggcagctgaatcagctctctaaaagcgagttcaacacctacaagcgctcaggtatcatggaagttgaccggtccgaggccaaagaggggcttaagagaggagaaactaccaaacacgccgtgagtcgtggcacagcgaagctgaggtggtttgtcgagcggaatttggtgaagcctgaaggtaaagtaattgacctgggctgtgggcgcggaggctggagctattactgcgctgggctcaagaaagtgactgaggttaagggatataccaaaggcggtcccgggcatgaagagccgatcccaatggcaacatacggatggaacttagtgaagctgcactctggcaaagatgtcttctttatacctcccgagaagtgtgacacgcttctgtgcgatatcggcgaatcctcaccaaatcccaccattgaggaagggcgaactctaagagtgctcaagatggtcgagccttggctgaggggaaaccaattctgtatcaaaattttgaatccgtacatgcccagcgtggttgagacactggaacagatgcagcggaagcatggtggcatgctcgtacgcaacccactttcgagaaattctacccacgagatgtattgggtgagttgcgggactggaaacatcgtctccgccgtgaatatgacaagcaggatgctgttaaaccgatttaccatggctcaccggaaacctacgtacgaacgtgacgttgatctgggcgccggtaccagacatgtggcagtcgagcccgaagtggccaacttggacattatcgggcagcgcatagagaatattaagcacgagcataaatcaacatggcactatgatgaagacaacccttacaagacttgggcttatcatggatcctacgaggtaaagccatctggcagcgcgagttccatggtgaatggcgttgtcaaactcctgaccaagccctgggatgtgatccctatggtgacacaaatcgccatgactgacaccacaccattcgggcagcagagggtctttaaagaaaaggttgatacccggactcccaaagcaaagagaggaacggctcaaattatggaggtgacagcccgctggctatggggtttccttagcaggaacaagaaaccgcgaatatgtacccgggaagagtttactagaaaggtaaggtctaatgcagccatcggcgctgtgttcgtcgacgagaaccagtggaattcagccaaagaagcggtggaggacgatcgcttttgggacctggttcaccgtgaacgggagctccacaagcaggggaaatgcgcaacctgcgtgtataacatgatgggaaagagagaaaagaaactgggcgagttcggtaaggccaaagggagtagggctatttggtacatgtggttgggagcccgcttcctggagtttgaagcactcggcttcatgaatgaggatcattggttttcccgagaaaacagcctttctggcgtcgagggggagggactgcacaagttaggttacatcctgcgggacatttcgaaaatccctggcgggaatatgtatgctgatgacacagccggatgggatacgagaataaccgaagacgatttgcagaacgaggctaagatcactgacattatggaaccagagcatgccctcctggcaaaatcaatcttcaagctaacataccaaaataaggtggtaagggttcagcgccccgcgaaaaacggcaccgtgatggatgtcattagcagacgggaccagaggggttccgggcaggtgggaacttatggccttaatacatttaccaacatggaagcccaactgatccgtcagatggagagtgagggcatattcctccctaacgaactggagacaccaaatttggctgggcgagtgttagattggctggaaaagtacggagtcgagcgcctcaaaagaatggccatttctggtgacgactgtgttgtgaagcccatcgatgaccggtttgcaactgctcttaccgccctgaacgatatgggcaaagtaaggaaggacatcccgcagtgggaacctagcaaggggtggaatgattggcagcaagtgcccttctgctcccaccactttcatcagctaattatgaaagacggacgcgagatagtcgtgccatgtagaaaccaggatgagctggttggccgggcaagggtgtcacagggtgccgggtggagtctccgagaaacggcgtgcttgggaaagtcttatgctcaaatgtggcagctgatgtacttccaccgtagagaccttcgcctggccgcaaatgccatctgtagcgctgtccctgtggattgggtacccacctcccggacaacttggtcaattcatgcccaccatcagtggatgaccacagaggacatgctcagcgtttggaacagggtgtggatcgaagagaatccatggatggaagataaaactagaatttcttcctgggaggacgtcccctatttaggcaagcgcgaggaccaatggtgcggcagtctgatcgggttgaccgcacgggctacgtgggccacaaacatacaggtggcgatcaatcaggttaggcgactgattggaaacgaaaattacagcgattacatgacctcgatgaaaagatttaagaacgagtccgaacctgagggtgctctctggtga

SEQ ID NO: 13648 - RNA, 9879 nt, synthetic construct
  misc_feature 1..9879: note = derived and/or modified CDS sequence (opt3) from DENV-1__FJ461307__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagctgtgtgaagatactatgacctacaaatgcccacggataacagaggcggaaccggacgatgtggactgttggtgcaatgctaccgatacttgggtaacatatgggacctgtagtcaaacgggagagcaccgccgagagaagcgtagcgtggcccttgcaccccatgtcggcctgggtttggaaactagaaccgagacatggatgtcctctgaaggggcctggaaacagatccagagggtggagacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagactttgtggagggtcttagtggcgcgacttgggtagatgttgtgttggaacacgggtcctgtgtcacaaccatggcaaaggacaaacccactctggatatcgagctactcaagacagaagtgaccaaccctgccgtgctgaggaaactttgcattgaggctaagatctctaatacgaccacagacagccggtgtccaactcaaggagaagccaccctggtcgaggagcaggatgcaaacttcgtttgccgccgaacatttgtggacagaggctggggtaatgggtgtggattgttcggcaaaggctccctcctgacttgcgctaagtttaagtgcgtaaccaaattagaagggaagatagtgcagtacgagaacctgaaatattcagtcattgtgacagttcacaccggagatcagcatcaagtgggtaatgaaagtactgagcacggcacgacagccaccatcactccccaggcgcctaccacagaaattcagctcaccgactacggggcccttactctggactgtagcccaaggacaggattggatttcaacgagatggtcctactgacgatgaaggagaaatcttggctcgtgcataagcagtggtttctggaccttccgctgccctggacctccggcgcatcaactagccaagaaacatggaatcggcaggatttgctcgtaaccttcaaaacagctcacgccaagaagcaggaggttgtggtcctgggtagtcaagaaggggctatgcacactgccttaaccggcgcaacggagatccagacctctggaacaactaccatctttgccggccatctgaaatgccgtctaaagatggacaaactcacactgaaggggatgtcctatgtgatgtgtactggaagcttcaaacttgaaaaggaggtcgctgagacccagcacggtacggtgttggttcagattaagtacgaaggcacagatgcgccttgcaaaataccattctcgacccaagacgagaagggggtgactcagaacggacgcctgatcacagcaaatcccattgtaaccgataaagaaaagcctgtcaacatcgaggccgagccaccctttggcgaatcttatatagtgattggtgctggggagaaagccctcaagctgtcctggttcaagaaaggctcaagtatcggaaagatgtttgaagcaactgccagaggcgctaggcggatggccatccttggggacaccgcatgggatttcggaagcattggtggcgtttttacatccgtggggaaactggtccatcagatcttcggaacggcgtacggcgtgttgttttctggtgtaagctggaccatgaagattgggataggcgtgctcctgacttggttaggactgaattcacgaagtacatccctaagcatgacctgtatcgctgttggcctcgtcacactgtaccttggggtgatggtgcaggccgactctggatgcgtcattaactggaaaggccgcgagttgaagtgtggttcagggatcttcgttactaatgaagtgcacacctggacggagcaatataagtttcaggcagatagtccgaaaagactgagcgccgctatcggaaaggcctgggaggaaggcgtgtgcggtattaggtccgcaacacggctcgagaacataatgtggaaacagatctctaacgaactgaatcatattttactggagaacgacatgaagttcaccgtagtcgtgggcgacgttgctgggatccttgtgcagggaaaaaagatgattcgccctcaacccatggaatacaaatattcgtggaagagctggggcaaggccaaaatcataggggcggatgtccagaattccacttttatcattgacggaccaaacacccctgagtgtcccgatgaccagagagcctggaatatctgggaggtggaagattacggcttcggtatttttacaactaacatctggttgaagctcagggactcatatacccaggtttgcgatcaccgtctgatgagtgctgcaataaaagactctaaggccgtgcacgctgatatggggtactggattgagagcgaaaaaaatgagacatggaagctagcccgggcatccttcatcgaagtaaagacgtgtatttggccaaaatcacataccctgtggagcaacggagtcctcgagtctgagatgatcatacccaagatccacggcggtcctatttcccaacataattatcgaccaggctacttcactcagacagcggggccgtggcacctgggaaaacttgaattggactttgatctgtgcgagggcaccactgtggtggtcgacgaacactgcgggaacagaggacccagtttaaggacaaccacggttactggcaagatcattcatgagtggtgttgccgcagctgtaccctccctccactgcggttcagaggtgaggatgggtgctggtacggaatggaaatcaggcccgtgaaagagaaggaagagaatcttgtaaagtctatggtgtccgccggctcaggtgaagtcgacagttttagcctgggcttgctctgtatatcgattatgatcgaggaggtgatgcgctcccgatggtctcggaaaatgctgatgacagggaccctagctgttttctttctgctcatcatgggacagctgacttggaacgaccttattcgtttgtgcatcatggtgggcgccaatgcaagcgatagaatggggatgggaacaacctatctggctttaatggccacattcaagatgaggcctatgtttgcagtcggcctcctgttccgccggcttacttcaagagaagtgctgctactcaccattggtctgagtttggttgcctccgtggagctgccaaactctttagaagagctcggggacggactggctatgggcataatgatccttaaactgttgacggattttcaaagctaccagctctgggcgacactgctatccctgaccttcattaagactaccttttcacttcactatgcctggaaaacaatggcaatggtcctcagcatcgtaagtctgttccccttgtgtctgtctactacctcccagaagacgacatggttaccggtgctcctgggcagccttgggtgcaagcctctgaccatgtttttgattgctgaaaataaaatctggggaaggaagtcgtggccactcaacgagggtataatggccgttggcatcgtgtcaattctgctatctagtctgcttaaaaacgacgtccccctcgccgggcctctgatcgctggaggcatgttgattgcatgttacgtgatctccggtagctctgccgatttaagcctggagaaggcggctgaagtatcctgggaggaagaggccgaacattcaggggcaagtcacaatatactcgtggaggtccaggacgatggaactatgaaaattaaggacgaggaacgagatgacacactgaccatccttctgaaagccactttgctagctgttagcggcgtgtatcccctgtctatcccagcaacactcttcgtgtggcatttctggcaaaagaagaaacagcgctccggcgtcctgtgggataccccttcacccccagaggtggaacgggccgttcttgacgatgggatttacagaataatgcagaggggattactgggtcgtagtcaggtaggcgtgggggtctttcaagagaacgtgttccacacgatgtggcacgttactcgcggagcggtgctcatgtatcagggcaagcggttggagccgagctgggcttccgtcaaaaaggacctgatctcttacggtgggggatggagatttcagggctcgtggaataccggcgaagaggtgcaggtaattgccgtcgaacctgggaaaaaccccaagaatgtgcaaacagcaccaggaaccttcaagacacccgagggtgaagttggcgccatcgctctcgactttaaacctgggactagcggatcaccaattgtgaacagggagggcaagatcgtcggtctgtacgggaatggagtggttaccacgtccggcacatatgtgagtgccatagcacaggctaaagcctctcaggagggcccccttcctgaaatcgaggatgaagtcttccgaaagcggaacctgactattatggacttgcatccggggagcggaaaaacccgcagatacctaccagcgatcgtgagggaggccattaagcggaagctgcgaacactcatcttagcacccaccagagtagtggcttccgaaatggccgaggctctgaaaggtatgcctatacgctatcaaactaccgcagttaagtcagagcacacaggcaaagaaattgtcgatcttatgtgccatgccacgtttactatgaggctgctctctccagtgcgtgtgcccaattacaacatgatcatcatggacgaggcccacttcaccgatcctagcagtattgctgcgcgggggtatatctccacaagagtcggaatgggcgaagcagccgctatatttatgaccgccactccgcccggtagcatggaggcattcccacagtctaatgccgtaattcaggacgaagagagggatatccctgagcgctcatggaactccgggtacgaatggattacagactttcccggaaagaccgtgtggttcgttccaagtatcaaagctggcaatgatatagcgaactgtttgcgaaagaatggcaagagagtgattcagctgagccggaaaacgttcgacactgagtatcaaaagacaaaaaacaacgattgggactacgtcgtgaccaccgacatctcggaaatgggggccaattttagggcagatcgcgttatcgaccctcgtagatgcctcaagcccgtgattctgaaagatggaccagagcgggtcatccttgctggtccgatgcctgtgactgtagcctctgcagcccagaggcgcggccgaattgggagaaaccataataaggagggagaccagtacatatatatgggccagcccctaaacaatgatgaagaccacgctcactggacagaggccaagatgctgttggataacatcaataccccagaaggtattatccccgcgttattcgagcctgaacgggagaaatccgcagccatcgacggggagtacaggctgcgcggcgaagctagaaagacatttgtggagctcatgaggcggggagatctgccagtttggcttagctataaagtcgcctcagaaggcttccaatacagtgaccgtcgctggtgctttgatggggagcgaaacaatcaggtgctggaagagaacatggacgtggagatttggactaaggaaggagagagaaaaaagctcaggccccggtggttggatgctcgcacgtattctgaccctctggcactaagagaattcaaagagtttgccgctggtaggcggtccgtcagcggcgacctgatactcgaaatcgggaagcttccgcagcatctgacccagcgagcccaaaatgcattagataacttggttatgctgcacaattcagagcagggaggcagagcgtaccgccatgccatggaggaactcccagacacaattgagactctgatgcttctggctctcatcgccgtgttgaccggtggggtaacactgttctttttaagtggcaagggactaggcaaaaccagcattgggctgctctgtgtgatggcatcctctgtccttctgtggatggctagcgtggaaccccactggatcgccgcatccataatcttggagttctttctgatggttctcctgattcctgagcccgataggcagcggactccacaggacaaccaacttgcctatgtggtcatcggactcctgttcatgattttgacggtagctgcgaatgaaatgggtctgttagagaccacaaagaaagatctaggcatcgggcacgtggccgttgaaaaccatcaccatgcagctatgctggacgtggatctccaccctgcctcagcctggactctttacgcagtcgctaccacaataattacccccatgatgcgtcatactatcgagaacacaacggccaatatttctctgaccgcgatcgctaaccaggccgcaatattgatgggactggacaagggctggccaatcagtaaaatggatattggtgtgcctctcctggcccttgggtgctactcgcaggtcaatccgttaactctgacagctgcagtgctcatgttggttgcccactatgcgatcattggccccggactgcaagctaaggccaccagagaagcacagaagaggaccgccgctggcatcatgaaaaacccaacaatagacgggattgtggccatcgatctagaccctgtagtgtacgatgcaaagtttgagaaacagctgggacagatcatgctccttattctgtgtactagccaaatcttgctgatgcgcacgacctgggctctctgcgagtccataacactggccactggccccttaaccacactttgggaaggttctccagggaagttctggaataccactattgcggtctcaatggccaacatcttccggggaagctatctggcaggcgctggtctcgccttttccctaatgaaaagtctgggcgggggacgaagaggcacgggggcacagggagagacattgggcgaaaagtggaagaggcagctgaatcagctctctaaaagcgagttcaacacctacaagcgctcaggtattatggaagttgaccggtccgaggctaaagaggggcttaagagaggagaaactaccaaacacgccgtgagtcgtggcacagccaagctgaggtggtttgtcgagcggaatttggtgaagcctgaaggtaaagtaatcgacctgggctgtgggcgcggaggctggagctattactgcgcggggctcaagaaagtgactgaggttaagggatataccaaaggcggtcccgggcatgaagagccgataccaatggctacatacggatggaacttagtgaagctgcactctggcaaagatgtcttctttatccctcccgagaagtgtgacacgcttctgtgcgatattggcgaatcctcaccaaatcccaccatcgaggaagggcgaactctaagagtgctcaagatggtcgagccttggctgaggggaaaccaattctgtattaaaatcttgaatccgtacatgcccagcgtggttgagacactggaacagatgcagcggaagcatggtggcatgctcgtacgcaacccactttcgagaaattctacccacgagatgtattgggtgagttgcgggactggaaacattgtctccgcagtgaatatgacaagcaggatgctgttaaaccgatttaccatggcccaccggaaacctacgtacgaacgtgacgttgatctgggcgctggtaccagacatgtggccgtcgagcccgaagtggcaaacttggacatcatagggcagcgcattgagaatatcaagcacgagcataaatcaacatggcactatgatgaagacaacccttacaagacttgggcctatcatggatcctacgaggtaaagccatctggcagcgctagttccatggtgaatggcgttgtcaaactcctgaccaagccctgggatgtgatccctatggtgacacaaattgcgatgactgacaccacaccattcgggcagcagagggtctttaaagaaaaggttgatacccggactcccaaagccaagagaggaacggcacaaataatggaggtgacagctcgctggctatggggtttccttagcaggaacaagaaaccgcgaatctgtacccgggaagagtttactagaaaggtaaggtctaatgccgcaattggcgccgtgttcgtcgacgagaaccagtggaattcagctaaagaagccgtggaggacgatcgcttttgggacctggttcaccgtgaacgggagctccacaagcaggggaaatgcgcgacctgcgtgtataacatgatgggaaagagagaaaagaaactgggcgagttcggtaaggcaaaagggagtagggccatctggtacatgtggttgggagctcgcttcctggagtttgaagccctcggcttcatgaatgaggatcattggttttcccgagaaaacagcctttctggcgtcgagggggagggactgcacaagttaggttacattctgcgggacatctcgaaaatacctggcgggaatatgtatgcagatgacacagctggatgggatacgagaatcaccgaagacgatttgcagaacgaggccaagattactgacatcatggaaccagagcatgctctcctggccaaatcaattttcaagctaacataccaaaataaggtggtaagggttcagcgccccgcaaaaaacggcaccgtgatggatgtcatcagcagacgggaccagaggggttccgggcaggtgggaacttatggccttaatacatttaccaacatggaagcgcaactgatacgtcagatggagagtgagggcattttcctccctaacgaactggagacaccaaatttggccgggcgagtgttagattggctggaaaagtacggagtcgagcgcctcaaaagaatggctatctctggtgacgactgtgttgtgaagcccatcgatgaccggtttgccactgcacttaccgctctgaacgatatgggcaaagtaaggaaggacattccgcagtgggaacctagcaaggggtggaatgattggcagcaagtgcccttctgctcccaccactttcatcagctaataatgaaagacggacgcgagatcgtcgtgccatgtagaaaccaggatgagctggttggccgggccagggtgtcacagggtgcagggtggagtctccgagaaacggcctgcttgggaaagtcttatgcgcaaatgtggcagctgatgtacttccaccgtagagaccttcgcctggctgccaatgcaatttgtagcgccgtccctgtggattgggtacccacctcccggacaacttggtcaatccatgctcaccatcagtggatgaccacagaggacatgctcagcgtttggaacagggtgtggattgaagagaatccatggatggaagataaaactagaatctcttcctgggaggacgtcccctatttaggcaagcgcgaggaccaatggtgcggcagtctgatagggttgaccgcccgggcaacgtgggctacaaacatccaggtggccattaatcaggttaggcgactgatcggaaacgaaaattacagcgattacatgatttcgatgaaaagatttaagaacgagtccgaacctgagggtgcgctctggtga

SEQ ID NO: 13649 - RNA, 9879 nt, synthetic construct
  misc_feature 1..9879: note = derived and/or modified CDS sequence (opt3) from DENV-1__FJ410213__SS-prME
  source 1..9879: mol_type = other RNA
agcgtgaccatgctgctcatgcttatgcccaccgccctggctttccacttgactacgagaggaggggaacctcatatgatcgtaaccaagcaggaaaggggaaaatccttactgtttaagacatctgccggtgttaatatgtgcactctaattgccatggacctcggcgaactgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggtagcttcaaactggagaaggaagtggctgagacccagcacggaacggtccttgtgcagataaagtacgagggcacagacgcgccttgcaaaatcccattctcgacccaagatgaaaagggggttactcagaacggacgcttgattacagcaaatcccatcgtgaccgacaaagagaagcctgtaaacatagaagccgagccaccctttggcgagtcttatattgtcatcggtgctggggaaaaagccctgaagctctcctggttcaagaaaggctcaagtatcggaaagatgtttgaggcaactgccagaggcgctaggcggatggccattctgggggataccgcatgggacttcggaagcgtgggtggcgtttttacatccgtggggaaacttgtccatcagatcttcggaacggcgtacggcgtgctgttttctggtgtaagctggaccatgaagattgggataggcgtgttgctcacttggctgggattaaattcacgaagtacatccctgagcatgacctgtatcgctgttggcctagtcacactctacctgggggtgatggtgcaggccgattctggatgcgtcattaactggaaaggccgcgaacttaagtgtggttcagggatcttcgttactaatgaggtgcacacctggacggaacaatataagtttcaggcagacagtccgaaaagattgagcgccgctatcggaaaggcctgggaggagggcgtgtgcggtattaggtccgcaacacggctggaaaacataatgtggaaacagatctctaacgagctcaatcatattctgttagaaaacgacatgaagttcaccgtagtcgtgggcgatgttgtggggatcctggctcagggcaaaaagatgattcgccctcaacccatggagcacaaatactcgtggaaaagctggggcaaggccaagatcataggggcggacgtccagaatactacctttatcattgatggaccaaacacacctgaatgtcccgacgatcagagagcctggaatatctgggaggtggaggactatggcttcggtatttttactaccaacatctggcttaagttgagggattcctacacacaggtttgcgaccaccgtctcatgtcagctgcaataaaagatagtaaggccgtgcatgctgacatggggtattggattgaatctgagaaaaatgaaacgtggaagctggcccgggcatccttcatcgaggtaaagacctgtatttggccaaaatcccacactctatggtcaaacggagtcctggaaagcgagatgatcatacccaagatctacggcggtcctatttctcaacataattatcgaccaggctacttcacacagaccgcggggccgtggcacctcggaaaactggagcttgattttgacttgtgcgaaggcactacagtggtggtcgatgagcactgcgggaacagaggaccctccctgaggaccacgactgttaccggcaagatcattcatgaatggtgttgccgcagttgtacattacctccactccggttcaaaggtgaggacgggtgctggtacggaatggagatcagacccgtgaaggaaaaggaggaaaatctggtaaaaagcatggtgtctgccggctccggtgaggtcgactcatttagtcttggcctgttgtgtataagcattatgatcgaagaggtgatgaggtcgcgctggtcccgaaagatgctcatgaccgggactctggctgttttcctactgctcatcatgggacagctgacatggaacgatcttattcggttgtgcatcatggtgggcgccaatgcatctgaccgtatggggatgggaaccacatatctggctttaatggccacttttaaaatgagacctatgttcgcagtcggcctcctgtttaggcgccttaccagccgggaggtgctgctactcacgattggtctgtcattggttgccagtgtggaactgccaaactccttagaggaactcggggatggactggctatgggcataatgatccttaagctgttgacagacttccaatctcaccagctctgggcgaccctgctaagcctgacttttattaaaaccacactttccctccattacgcctggaagactatggcaatggtcctgtcaatcgtcagcttgttccccctgtgtttaagtaccacgtctcagaagacaacctggctcccggtgctgcttggctccctggggtgcaaacctttgactatgtttctcattacagagaataagatctggggaagaaaaagctggccactgaacgaaggtataatggctgttggcgtggtctcgatcctactgtcatctcttctcaaggatgacgtgcccctggccgggcctttgattgccggaggcatgttaatcgcttgttatgtaattagtggttccagcgcagatctgtctctcgagaaagccgcggaggtgagctgggaagaggaagctgagcactccggggcctcacataacatcctggtcgaagttcaggacgatggaaccatgaagataaaagacgaggagagggatgacactcttacaattctgttgaaggcaaccctactggccgtgagtggcgtgtaccccctcagcatcccagctacgctgttcgtctggtatttttggcaaaagaaaaagcagcgatctggcgtgctttgggatactccttcacccccagaagttgagcgcgcagtattagacgacgggatctaccggattatgcagagaggactgctcggtaggagccaggtgggcgtcggggtgttccaagaaaatgttttccacaccatgtggcacgtgacacgtggagccgtcttgatgtatcagggcaaacgcctggagccgagttgggcgagcgtgaagaaagatctcatatcctacggtgggggatggcggctgcagggctcttggaacaccggcgaggaagtacaggtcatcgctgtggagcctgggaagaatcccaagaacgttcaaacagccccaggaacttttaaaacccccgaaggtgaggtgggcgcaattgcccttgacttcaagcctgggacgtcgggaagcccaatcgtcaatagagaaggcaaaattgtgggtctgtacgggaacggagttgtgacaacttcaggcacctatgtctccgctatcgcccaggcaaaggctagtcaggagggccccttgcctgagatagaagatgaggtgtttaggaaacgaaatctaacaatcatggacctgcatccggggtctggaaagacccggcgctacctcccagccattgtaagagaagcgatcaagaggaaattacggactctgattcttgcccccacccgagtggttgcaagcgagatggctgaagccctgaagggtatgcctatcagatatcaaacaacggctgtcaaatccgagcacactggcaaggagatagtggatctcatgtgccatgcaaccttcacaatgcgcttgctgtcaccagtgagggtccccaactacaatatgattatcatggacgaagcccactttaccgatccttctagcatcgccgctcgtgggtatattagtactcgggtaggaatgggcgaggcggcagccatcttcatgacagctaccccgcccggttccgtggaagcctttccacagagcaacgcagttatacaggacgaggaaagagatattcctgagaggtcttggaactcagggtacgagtggatcacggacttccccggaaaaactgtgtggtttgtcccatccattaagagtggcaacgatatcgccaattgtctccgcaagaacggcaaacgagtgatacagctgagcagaaagacattcgacaccgaatatcagaaaaccaagaataacgactgggattacgttgtgactacagacatttcggagatgggggctaactttcgggcggatagggtcatcgaccctcgccgttgccttaaacccgtgatcctaaaggatggaccagaaagagtaattctggccggtccgatgcctgtgaccgttgcatctgctgcccagcggaggggccgcatcgggcgaaatcataacaaggagggagaccagtacatttatatgggccagcccttgaataacgatgaggaccacgcacactggacagaagccaaaatgttactggataatataaacactccagagggtatcattcccgctctcttcgaacctgagagagaaaagtccgccgcgatcgacggggagtaccggctgaggggcgaggcacgcaaaacgttcgtcgaacttatgagaaggggagatctgccagtgtggctcagctataaggtggcctcagagggctttcaatacagtgaccggcgttggtgcttcgatggggaacgcaataaccaggtcttggaggaaaatatggacgttgagatctggaccaaagagggagaacgaaagaaactgagacccaggtggctagacgctcggacatattctgatcctctggccctccgcgagtttaaggagttcgctgcaggtagaaggtccgtgagcggcgaccttattctggagatagggaagttaccgcagcatttgactcagcgggcccaaaacgctctggataatctcgtaatgctgcacaactcagaacagggaggccgagcctacagacatgcaatggaggagcttccagacaccatcgaaacactgatgctcttggcgctgattgccgtgttaaccggtggggtcactctatttttcctgagtggccgcggactcggcaaaacgagcatcgggcttctgtgtgtgatggcttcctctgttttgctgtggatggccagcgtggagccccactggattgcagcttccatcatactcgaatttttcctgatggtccttctcatccctgagcccgataggcagcggaccccacaggacaatcaactggcctatgtagtgattggattgctgtttatgatcttaacagttgcagccaacgagatgggtctactggaaactaccaagaaagatctcggcattgggcacgtggctgtcgagaatcatcaccatgcgacaatgcttgacgtggatctgcaccctgcctcagcatggaccttgtacgctgtcgccactacaatcataacgcccatgatgcgtcataccattgaaaacactacagccaacatctctctgaccgcaattgctaatcaggccgcgatcctcatgggactggacaagggctggccaataagtaaaatggatatcggtgtgcctcttttagctctggggtgctactcgcaggttaacccgctcaccttgacagccgcagtgctgatgctagtagcccactatgctattatcggccccggactgcaagcaaaggccactagagaggcgcagaagaggacggctgccggcattatgaaaaatccaaccgtggacgggatcgtcgcaatagatctcgaccctgttgtgtacgacgccaagttcgaaaaacagcttggacagattatgctgttgatcctgtgtacaagccaaatcctcctgatgcgcactacctgggctttatgcgagtccattacacttgccaccggccccctgactacgctctgggagggttctccagggaagttttggaacacaaccatcgcagtctcaatggctaatatattccggggaagctatctagccggcgcgggtctggccttttccttgatgaaaagtctgggcgggggacgaagaggcactggggcacagggagaaaccctcggcgagaagtggaagaggcagcttaaccagctgtctaaaagcgagttcaatatttacaagcgctcaggtatcatggaggtggatcggtccgaagctaaagaggggttgaagagaggagagacaactcgtcacgccgtaagtaggggcaccgcaaaactgcggtggttcgtggaacgcaacctcgttaagcctgagggtaaggtgattgacttaggctgtgggcgaggaggctggagctattactgcgctgggctgaaaaaggtcacagaagtgaaaggatatacgaagggcggtcccgggcatgaggaaccgatcccaatggccacctacggatggaatcttgtcaaactgcactctggcaaggatgtgtttttcactcctcccgagaaatgtgacacactactctgcgatataggcgagtcctcaccaaaccccaccatcgaagaggggagaactctgagggttttgaagatggtagaaccttggctgcggggaaatcaattttgtattaagatcctcaacccgtacatgcccagcgtggtcgagacacttgagcagatgcagcgcaaacatggtggcatgctggtgagaaatccattatcgaggaactctacccacgaaatgtattgggttagttgcgggacgggaaatattgtgtccgccgtcaacatgaccagccgaatgctgttgaatcggttcacaatggcgcaccgtaagcctacttacgagagagacgtggatctcggcgctggtacccgccatgtagcagtggaacccgaggttgccaacctggacatcattgggcagaggatcgaaaacataaaacacgagcataagtcaacatggcactatgatgaggacaatccttacaaaacttgggcttatcatggatcctacgaagtcaagccatctggcagcgccagttccatggtgaacggcgtggtcaagctacttaccaaaccctgggatgttattcctatggtgacacaaatcgcaatgaccgacactacgccatttgggcagcagcgggtattcaaggagaaagtggacacaagaacccccaaggccaaacgcggaactgctcaaatcatggaagtcaccgcgaggtggctgtggggttttctcagccgaaataagaagccgcggatttgtacaagagaggagttcacgaggaaagtgcgctctaacgccgcaataggcgctgtttttgtggatgagaatcagtggaactcagccaaggaggcagtcgaagacgagcgtttctgggatctggtgcagaaagaacgggagttgcacaagcaggggaaatgcgcaacctgcgtatataatatgatgggaaagagagaaaagaaactgggcgagtttggtaaggctaaagggagtagggccatctggtacatgtggctcggagcgcgcttccttgagtttgaagcactgggcttcatgaacgaggaccactggttctcccgagaaaatagcttatctggcgttgagggggagggactgcataagttgggttacattctccgggatatctcgaaaattcctggcgggaacatgtatgccgacgatactgctggatgggacacaagaatcaccgaagatgacctgcaaaatgaggccaagataactgatatcatggaaccagagcacgcactacttgctacatcaatttttaaactgacctaccagaacaaggtggtcagggtgcagcgccccgccaagaatggcacagtgatggacgtcatcagcagacgggatcagaggggttccgggcaagttggaacttatggcctcaacaccttcacgaatatggaagctcagctgattcgtcagatggagagtgagggcatctttttgccttctgaattagagaccccaaacctggccgaacgagtgctcgactggcttgagaaatacggggtagaacgcctgaagagaatggcaataagcggagacgattgtgtggtcaaacccattgacgatcggttcgcgacagccctaactgctctgaacgacatgggtaaggtgaggaaagatatcccgcagtgggagccttccaagggctggaatgactggcaacaggttcccttttgctcacatcacttccaccagctcatcatgaaggatgggcgcgagattgtggtcccatgtagaaaccaggacgaattggtgggacgggccagggtaagtcaaggcgcaggttggtctctgcgagagaccgcttgccttgggaaaagctatgcccagatgtggcagctgatgtactttcatcgtagagatctccgcttagcagccaatgcgatatgttccgctgttcctgtggactgggtccccacatcacggactacctggagcatccacgcccatcaccaatggatgacgacagaagatatgctgtctgtgtggaacagggtttggattgaggaaaatccatggatggaggacaagacccatgtgtccagttggggagacgtcccctatttgggcaaaagagaggatcagtggtgcggcagcctgatcgggctcactgcacgcgccacatgggcttcgaacattcaggtggccatcaatcaggtacggaggcttataggaaacgaaaattacctggactacatgacctccatgaagcgattcaaaaacgagggtgatcctgaaggcgcactatggtga

SEQ ID NO: 13650 - RNA, 9879 nt, synthetic construct
  misc_feature 1..9879: note = derived and/or modified CDS sequence (opt3) from DENV-1__FJ461308__SS-prME
  source 1..9879: mol_type = other RNA
agcgtgacaatgctgctaatgcttatgcccacagcactggctttccacttgactacgcgaggcggggaacctcatatgatcgtctccaagcaggaaagggggaaatctttactgtttaagacatcagccggtgttaacatgtgcacactaattgccatggacctcggcgagttctgtgaagatactatgacctacaaatgcccacggataacagaagcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagagccgaaacctggatgtcctctgagggggcttggaaacagatccagagggtggaaacatgggcattgcggcaccctggatttactgttattgccctcttcctggctcatgccatcggcacctcgattacacagaagggcatcatatttatcctgctcatgttagtgaccccatcaatggcgatgcgctgcgtcgggattggaagcagagatttcgtggagggtctgagtggcgcaacgtgggtagacgttgtgcttgagcacgggtcctgtgtcactacaatggccaaggataaacccaccttggacatcgaactgctaaagactgaggtgacaaaccctgctgtgctcaggaaactgtgcattgaagccaagatctctaataccacgaccgatagccggtgtccaacacaaggagaggcaactcttgtcgaagaacaagacgctaactttgtttgccgccgaaccttcgtggatagaggctggggtaatgggtgtggactgtttggcaaaggctccttgataacatgcgccaagttcaagtgcgtaactaaactcgaggggaagaccgtgcagtacgaaaacctgaaatattcagtcattgtgacagttcacaccggagaccagcatcaagtgggtaatgagagtactgaacacggcacgacagcgaccatcactccccaggcccctagcaccgagattcagttaacagactacggggcactgaccctcgattgttctccaaggactggacttgactttaacgaaatggtcctgttgacaatgaaggagaaatcctggctagtgcataagcagtggttcctggatctcccgctgccctggacgtcaggcgctagcaccagtcaagagacttggaatcggaaagaccttctggtaacatttaagaccgcccacgctaagaaacaggaagttgtggtcttgggttctcaggagggggccatgcacacagcactcactggcgccaccgaaatccaaacgtccggaaccacaactatcttcgctggccatctgaagtgccgtttaaaaatggataagctgaccctaaaagggatgagctatgtgatgtgtacaggatcgttcaagctcgagaaggaagtcgcggagactcagcacggtaccgtgctggttcagattaaatacgagggcacggacgcaccttgcaagataccattttctacacaggatgaaaaaggggtgacccaaaacggacgccttatcactgccaatcccattgtaacagacaaggagaaacctgtcaacatcgaagctgagccacccttcggcgagtcctgtatagtgattggtgccggggaaaaggcattgaagctgtcatggtttaaaaagggcagtagcatcggaaaaatgttcgaggccaccgctagaggcgccaggcggatggcaatcctcggggatactgcgtgggactttggatccattggtggcgttttcacctctgtggggaagctggtccatcagatctttggaacagcttatggcgtgcttttcagcggtgtatcatggacgatgaaaattgggataggcgtgctgttgacctggctcggactgaatagtcgatccactagcttatctatgacatgcatcgccgttggcctggtcaccctatacctcggggtgatggtgcaggcagattcaggatgtgtcattaactggaagggccgcgaactgaagtgcggtagtgggatctttgttacaaatgaggtgcacacttggaccgaacagtacaaattccaagccgacagcccgaagagactttccgctgccatcggaaaagcatgggaggagggcgtgtgtggtattaggtctgctacgcggttggaaaacataatgtggaagcagatctcgaacgagctgaatcatattctcctggaaaacgacatgaaatttacagtagtcgtgggcgatgttgccgggatcttagcgcagggaaagaaaatgattcgccctcagcccatggagcacaagtatagctggaagtcctggggcaaagccaagatcataggggctgacgtgcaaaataccactttcatcattgatggaccaaacacccctgaatgccccgacgatcagagagcatggaatatctgggaggtcgaggactacggctttggtattttcacaactaacatctggctgaaacttagggattcatatacccaggtgtgtgaccaccgtttgatgagtgccgctataaaggattctaaagccgttcatgcagacatggggtactggattgaaagcgagaagaatgaaacatggaagctcgcgcgggcctccttcatcgaggtgaaaacgtgcatttggccaaagtcacacaccctgtggagcaacggagtactagaatctgagatgatcatacccaaaatctatggcggtcctatttcccagcataattaccgaccaggctattttactcaaacagctgggccgtggcacctgggaaagctcgagctggatttcgacctttgcgaaggcaccactgtcgtggtggatgagcactgtgggaacagaggacccagtttgaggacaaccacggtcactggcaaaatcattcatgaatggtgctgtcgcagctgcaccctgcctccattacggtttaagggtgaggacgggtgttggtacggaatggagatcagacccgttaaggaaaaagaggaaaatctcgtgaagtctatggtatccgccggctcaggtgaggtggacagtttcagcctgggccttctgtgcatatcgattatgatcgaagaggtcatgaggtcccgctggtctcgaaaaatgttgatgacagggaccctcgcagtgtttttcctgctaatcatgggacagctgacttggaacgatctcattcggctgtgtatcatggttggcgctaatgccagcgaccgtatggggatgggaacaacctaccttgcattgatggccacatttaagatgagacctatgttcgctgtgggcctgttatttaggcgcctcacttcacgggaggtcctgcttctgaccattggtctaagtctcgtggcgtccgttgaactgccaaactctttggaggaactgggggatggattagccatgggcataatgatcctcaaactgcttacggacttccagagccaccaactgtgggcaacattgctctccctgacctttattaagactaccttctcactacattatgcttggaagacaatggccatggtgctgagcatcgtcagtctttttcccctctgcctgtctactacctcccagaaaacgacatggttgccggtactgttaggcagcctcgggtgtaagcctctgaccatgttccttattgccgagaataaaatctggggaagaaagtcgtggccactgaacgaaggtataatggctgtgggcatcgtttcaattttgctctctagtctgctcaagaatgatgtgcccctggcagggcctcttatcgccggaggcatgctcattgcgtgctacgtcatctccggtagctctgctgacctgagcttggagaaggccgcagaggtgtcctgggaagaggaagccgagcactcaggggctagtcataatatattagtagaagtgcaggatgacggaactatgaaaattaaggatgaggagagggacgatacactgaccatcctcctgaaggcaactcttctggccgtcagcggcgtttatcccttgtctatcccagcgacactattcgtgtggtacttttggcagaaaaagaaacaacgatccggcgtgctgtgggacaccccttcacccccagaagtcgagcgcgctgtgctcgatgacgggatttatcggataatgcagagaggactgcttggtaggagtcaggttggcgtaggggtgttccaggaaaacgtctttcacacgatgtggcacgtgactcgtggagccgttttaatgtaccaaggcaagcgcctggagccgagctgggcatccgtgaaaaaggacctcatctcttatggtgggggatggcggttgcagggctcgtggaataccggcgaggaagtccaggtgattgccgtagagcctgggaagaaccccaaaaatgtccagacagctccaggaaccttcaagacaagcgaaggtgaggtgggcgccatcgcactggattttaaacccgggacttcaggatcccctattgttaacagagaaggcaagatcgtgggtctctacgggaatggagtcgtgaccacgagtggcacatacgtttctgctatagcccaagcgaaagccagccaggagggcccactgcccgagatcgaagacgaggtgttcaggaagcgaaaccttactattatggatctgcatcctgggtccggaaagacccggcgctatttgccggcaatcgtcagagaagctattaaaaggaagctacggacactgatcctcgccccaacccgagtggtagcttcagagatggcagaagccttaaaaggtatgcccataagataccagactaccgccgtgaagtctgagcacacaggcaaagagattgttgacctgatgtgtcatgctacgtttactatgcgccttctgagccctgtcagggtgccaaattataacatgatcatcatggatgaagcgcacttcaccgaccccagttccattgcagcccgtgggtacatcagcacacgggtgggaatgggcgaggctgccgcaatatttatgaccgccactcctccgggttctgtcgaggctttcccccaatcaaatgcggtaattcaggatgaggaaagagacatcccagagaggtcctggaacagtgggtatgagtggattacagattttcctggaaagaccgtgtggttcgttcccagcatcaagtcgggcaatgacatagccaactgcctccgcaaaaatggcaagcgagtgattcagttgtctagaaaaacgttcgatactgaataccagaagaccaagaacaacgactgggactatgtcgtgaccaccgatatctccgagatgggggcaaattttcgggctgacagggttatcgatccacgccgttgcctgaagcctgtgattctcaaggacggacccgaaagagtcatcctggccggtccaatgccggtgactgtagcaagcgccgctcaacggaggggccgcattgggcgaaaccataataaagagggagatcagtacatatacatgggccagcctcttaacaatgacgaggatcacgcccactggacagaagcgaagatgctactggacaacatcaatacccccgagggtattatcccagcattgttcgaacccgagagagaaaaatcagccgctatcgatggggagtatcggttaaggggcgaggcccgcaagacatttgtggaactgatgagaaggggagacctccctgtttggctgagttacaaagtcgcttctgagggcttccagtattccgatcggcgttggtgttttgacggggaacgcaacaatcaagtgcttgaggaaaacatggatgtggagatttggactaaggagggagaaaggaaaaagctgagaccaagatggctcgacgcacggacgtacagcgaccccttggccctgcgcgagttcaaggaatttgctgccggtagaaggtcagtcagtggcgatctaatactggagatcgggaaactccctcagcatcttacccagcgggcacagaatgcgctggacaacttagttatgttgcacaatagcgaacaaggaggccgagcctatagacatgctatggaggagctgccggatacaattgaaactctcatgctgcttgccctgatcgcagtgctcaccggtggggtaacattgttctttctgtccggccgcggattaggcaagacctctattgggctactgtgcgtgatggctagctccgtcctcctttggatggcctcagtggagccacactggatcgcagcctctataatcctggagttctttttgatggttctgctcattcccgagcctgacaggcagcggactccccaggataaccagctggcttacgtggtcatcggacttctcttcatgattctgacggtagcggccaatgagatgggtttgctggaaaccaccaaaaaggacttaggcatcgggcacgtggcagttgagaaccatcaccatgctgccatgctagatgtggacctgcacccagccagtgcatggactctctatgctgtcgccaccacaataattacccctatgatgcgtcatactatcgaaaacacaacggcgaatatttcgcttaccgctatcgccaaccaagcagccatactgatgggattggataaaggctggcccatcagcaagatggacattggtgtgccactgctcgctctggggtgttactcccaggtcaatcctcttactttaacagcagccgtgctgatgctcgttgcgcactacgctatcattggcccgggattgcaggccaaggcaaccagagaggcccagaaaaggaccgctgccggcatcatgaagaaccccacagtggatgggatagtagcaattgacctggatccagtggtctatgacgctaaatttgaaaagcagctaggacagatcatgctgctcatcctttgcacttctcagattctgttgatgcgcacgacctgggccctgtgtgagtcaatcacactcgcgactggccctctgaccacattatgggagggtagccccgggaaattctggaataccactatagccgtttccatggcaaacattttccggggaagttaccttgctggcgccggtctggcattttctctcatgaaaagcctaggcgggggacgaagaggcacgggggctcaaggagaaacactgggcgagaagtggaaaaggcagttgaatcagctgtcaaagtccgagttcaacacctataaacgcagtggtatcatggaggtggaccggagcgaagccaaggaggggctcaaaagaggagagactaccaagcacgccgtctctcgtggcacagcgaaacttaggtggtttgtggaacggaatctggtaaaaccagagggtaaggtgattgatttgggctgcgggcgcggaggctggtcctactattgtgctgggctgaaaaaggttactgaagtgaaaggatacaccaagggcggtcctgggcatgaggaacccatcccgatggcaacatatggatggaacctcgtcaaattacactcaggcaaggacgtgttctttataccacctgagaagtgcgatacgctgctttgtgacatcggcgagagctcgcccaatccaaccattgaagaggggcgaactctgagagtcctaaaaatggtggaaccctggctcaggggaaaccagttctgcatcaagattctgaatccttacatgccgtctgttgtagagacattggagcaaatgcagcggaaacatggtggcatgctggtgcgcaaccccctcagtagaaattccacccacgaaatgtactgggtcagctgtgggactggaaacatcgtgtcagccgttaatatgacatccaggatgcttctgaaccgatttaccatggctcaccggaagccaacgtatgagcgtgatgtggacttaggcgccggtaccagacatgtcgcagtggaacctgaggtagccaacctggatattatcgggcagcgcatagaaaatattaaacacgagcataagtctacatggcactacgacgaggataacccctataagacttgggcttaccatggaagctatgaagtgaaacctagtggctccgcgagctctatggttaatggcgtcgtgaagttgctcaccaaaccatgggacgtgatccccatggtcacacagatcgccatgactgataccacacctttcgggcaacagagggtttttaaggagaaagtggacacccggactccaaaggcaaagagaggaacggctcagattatggaagtaacagccaaatggctgtggggtttcctatcacgcaacaagaaacccaggatatgcacccgagaggaatttactcggaaggtgagaagtaatgcagccatcggcgctgtcttcgtggacgagaaccaatggaactccgccaaagaggcggttgaagatgagaggttttgggaccttgtgcaccgcgaacgtgagctgcacaagcaggggaagtgcgcaacctgtgtctacaacatgatgggaaaacgggaaaagaaactcggcgagttcggtaaggccaaagggagcagagctatttggtatatgtggctgggagccaggttcttggagtttgaagcactgggcttcatgaatgaggatcattggttttctcgcgaaaactcgctctcaggcgtggagggggagggacttcacaagctgggttacatcttacgagacattagcaaaatcccgggcgggaatatgtacgctgatgacacagccggatgggatacgcggataaccgaagacgatctgcagaacgaggctaagatcactgacattatggaacctgagcatgccttgctcgcaaagtccatcttcaaactgacatatcagaataaggtagttagagtgcaaaggccagcgaaaaacggcaccgtcatggatgtgattagtcgcagagaccagcggggttctggacaggtgggaacttacggcctaaatacatttaccaacatggaagcccagcttatcaggcaaatggagagcgagggcatattctccccctcagaactggagacacctaacctcgctgggcgtgtcctggattggttggaaaagcacggagttgagcgattaaaacgcatggccattagtggtgacgactgcgtggtaaagccaatcgatgacagatttgcaactgctctgaccgccctcaatgatatgggcaaggtgcggaaagacatcccccagtgggaaccgtctaaggggtggaacgattggcagcaggtccctttctgtagccaccattttcaccaacttattatgaaagacggaagggagatagtggttccctgccgcaatcaggatgagctggtgggcagagcacgggtctcccagggtgccgggtggtcactaagggaaacggcgtgtctgggaaagagctatgctcagatgtggcaactcatgtacttccatcgacgtgacttgagactggccgcaaacgccatctgctctgctgtgccagtagattgggttcctacctcccgcacaacttggagtattcacgcccatcaccagtggatgaccacagaggacatgcttagcgtgtggaatcgggtctggatcgaagagaacccctggatggaagataaaactcacatttcgtcctggggcgacgtgccatatctgggcaagagggaggaccagtggtgtgggtctctcatcggattaaccgcaagagctacgtgggccacaaatatacaagttgcgatcaaccaggtgcgccggctgattggtaatgagaactacttggattatatgacctcaatgaagaggtttaaaaatgaaagcgaccccgagggcgctctgtggtga

SEQ ID NO: 13651 - RNA, 9879 nt, synthetic construct
  misc_feature 1..9879: note = derived and/or modified CDS sequence (opt3) from DENV-1__FJ461310__SS-prME
  source 1..9879: mol_type = other RNA
tccgtgacaatgctgctcatgcttatgcccacagcactggctttccacttgactacgagaggaggggaacctcatatgatcgtctccaagcaggaaaggggaaaatctttactgtttaagacctcagccggtgttaatatgtgcacactaattgccatggacctcggagaactgtgtgaagatactatgacctacaaatgcccacggataacagaagcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccgtgctgaggaaactttgcattgaagctaagatctctaatacgaccacagatagccggtgtccaactcaaggagaggccaccctggtcgaagaacaggacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatgtgtactgggtcgttcaaactggagaaggaagtcgctgagacccagcacggtacggtgcttgttcagataaagtacgagggcacagacgcgccttgcaaaatcccattctcgacccaagatgaaaagggggtgactcagaacggacgcttgattacagcaaatcccatcgtaaccgacaaagagaagcctgtcaacatagaagccgagccaccctttggcgagtcttatattgtgatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtttttacatccgtggggaaacttgtccatcagattttcggaacggcgtacggcgtgctgttttctggtgtaagctggaccatgaagatagggatcggcgtgttgctcacttggctgggattaaattcacgaagtacatccctgagcatgacctgtattgctgttggcctaatcacactctacctgggggtcatggtgcaggccgattctggatgcgtgatcaactggaaaggccgcgaacttaagtgtggttcagggattttcgtcactaatgaggttcacacctggacggaacaatataagtttcaggcagacagtccgaaaagattgagcgccgctataggaaaggcctgggaggagggcgtgtgcggtatcaggtccgcaacacggctggaaaacattatgtggaaacagatctctaacgagctcaatcatattctgttagaaaacgacatgaagttcaccgtggtagtcggcgatgtggctgggatcctggcccagggcaagaagatgatacgccctcaacccatggagtacaaatattcgtggaaaagctggggcaaggcgaagatcattggggccgacgttcagaatactacctttatcattgatggaccaaacacacctgaatgtcccgacgatcagagagcttggaatatctgggaggtggaggactacggcttcggtatatttactaccaacatttggcttaagttgagggattcctatacacaggtctgcgaccaccgtctcatgtcagcagccatcaaagatagtaaggctgtgcacgccgacatggggtactggattgaatctgagaaaaatgaaacgtggaagctggcacgggcgagcttcatcgaggttaagacctgtatatggccaaaatcccatactctatggtcaaacggagtgctggaaagcgagatgatcattcccaagatctatggcggtcctatttctcaacacaattaccgaccaggctacttcacacaggccgctgggccgtggcatctcggaaaactggagcttgattttgacttgtgcgaaggcaccactgtagtcgtggatgagcactgcgggaacagaggaccctccctgaggacaaccacggtgactggcaagatcatacacgaatggtgttgccgcagttgtaccttacctccactccggttcagaggtgaggacgggtgctggtatggaatggagattaggcccgtcaaagaaaaggaggaaaatctggttaagagcatggtgtctgccggctccggtgaggtagactcatttagtcttggcctgttgtgtatcagcatcatgattgaagaggtgatgcgctcgcgatggtcccggcgtatgctcatgacagggaccctggcagtcttctttctactgatcatgggacagctcacttggaacgatctgattagactttgcataatggtgggcgctaatgcctctgacaggatggggatgggaacaacctacttggcactgatggccacattcaaaatgcgccctatgtttgctgttggcttactcttccggagactgactagcagggaggtgcttctgctaaccatcggtctctcactggtcgcgagtgtggaattgccaaactccctggaggaattaggggatggactcgccatgggcattatgatcctgaaacttctgacggactttcaatctcatcagttgtgggcaacactcctgagcctaaccttcattaaaactaccttttccctgcactatgcttggaagacaatggccatggttctttcaatcgtgagcctcttccccctgtgtttgagtactacctctcagaaaacgacatggctgccggtcttactcggctccctggggtgcaagcctcttaccatgtttctgatagccgagaataagatctggggacgacgcagctggccattgaacgaaggtattatggctgtaggcatcgtgtcgattctcctgtcatctctactgaaaaacgatgttccccttgcagggcctctcatcgccggaggcatgctgatagcgtgttacgtgattagtggttccagcgctgacttgtctttagagaaggccgcagaggtcagctgggaagaggaagccgagcattccggggcttcacacaatatcctggtggaagtacaggatgacggaactatgaaaatcaaggatgaggagcgggacgatacactcaccattctgcttaaagcaactctgttggccgtgagtggcgtctatcccctaagcataccagcgacactgttcgtttggtacttctggcaaagaaagaaacagaggtctggcgtgctctgggacaccccttcacccccagaagtggagcgtgctgtcctggatgacgggatctatcgcattatgcagcggggacttttaggtagaagccaggtgggcgttggggtatttcaagaaaacgtgttccatacgatgtggcacgtcactaggggagccgtgctgatgtaccagggcaagcgactcgagccgagttgggcaagcgttaagaaagacttgatctcctacggtgggggatggcggctgcagggctcttggaataccggcgaggaagtgcaggtcattgccgtggagcctgggaagaaccccaaaaatgtacaaacagctccaggaacctttaagacacccgaaggtgaggtcggcgccatcgcactcgatttcaaacctgggacttcgggaagcccaatagtgaaccgcgaaggcaagatcgttggtctgtatgggaatggagtggtcaccacgtcaggcacatacgtgtccgctattgcccaggcgaaggccagtcaggagggcccccttcctgagatcgaagacgaggtttttagaaaaaggaacctgactattatggatttgcacccggggtctggaaagacccggcgatatctaccagcaatcgtgagagaagctataaaacgcaagctgaggacactcattttagcccccacccgtgtcgtggctagcgagatggcagaagccctgaaaggtatgcctatccggtaccaaactaccgccgtaaagtccgagcatacaggcaaggagatcgtggaccttatgtgccacgctacgttcactatgagactgctctcaccagttagggtccccaattataacatgattatcatggatgaagcgcattttaccgacccttctagcatagcagcccgcgggtacattagtacacgagtgggaatgggcgaggctgccgcaatcttcatgaccgccactccgcccggttccgtggaggcttttccacagagcaatgcggtcattcaggatgaggaaagagacatccctgagcggtcttggaactcagggtatgagtggataacagatttccccggaaaaaccgtatggtttgtgccatccattaagagtggcaatgacatcgccaactgtttgaggaaaaatggcaagcgcgttatccagctgagccgtaaaacgttcgatactgaataccaaaagacaaagaacaacgactgggactacgtggtcaccaccgatatttcggagatgggggcaaatttcagagctgaccgggtgatcgatcctaggcgctgcctcaaacccgttattctgaaggacggaccagaacgagtgatacttgccggtccgatgcctgtcactgtggcatctgccgctcagagacggggcaggatcgggcgcaaccacaataaagagggagatcagtatatttacatgggccagcccctaaacaatgacgaggatcatgcccactggacagaagcgaagatgctgttggacaacatcaataccccagagggtatcattcccgcattatttgaacctgagagagaaaaatccgccgctatagatggggagtataggctgcggggcgaggcccgtaagacattcgtagaactcatgcgccgaggagacctgccagtgtggcttagctacaaggttgcttcagagggctttcaatatagtgatagaaggtggtgcttcgacggggaacggaacaatcaggtcctggaggaaaacatggatgtggagatctggactaaagagggagaacgcaagaaactcagacccaggtggttggacgcacggacgtactctgaccctctggccctacgagagtttaaggagttcgctgccggtagacgctccgtgagcggcgatctgattctcgagatcgggaaacttccgcagcacctgacccagagggcacaaaatgcgttagacaacttggtcatgctgcataattcagaacagggaggccgggcctatcgtcacgctattgaggagctcccagatacaatcgaaactctgatgcttctggccctcatagcagttttgaccggtggggtgacactgtttttcttaagtggcagaggactaggcaagaccagcatcgggctgctctgtgtaatggcttcctctgtgcttctgtggatggccagcgtcgagccccattggattgcagcctccatcattttggaatttttcctgatggtgctcctgatccctgagcccgacaggcagcgcactccacaggataaccaacttgcttacgttgtgataggactcctgtttatgattttgacggtcgcggccaatgagatgggtctgttagaaaccaccaaaaaggacctaggcatcgggcacgtagcagtggagaaccaccatcacgctgccatgctggatgttgacctccatcctgcctcagcatggactctttacgctgtggccaccacaattatcacccccatgatgcggcacactatagaaaacacaacggcgaatatctctctgaccgctattgccaaccaggcagccatcttgatgggactggataagggctggccaattagtaaaatggacatcggtgtccctctcctggctcttgggtgctatagccaggtgaatccgttaactctgacagcagccgtcctcatgttggtggcgcattacgctataattggccccggactgcaagccaaggcaacccgagaggcccagaaaagaaccgctgccggcatcatgaagaacccaacagttgatgggatcgtggcaattgacctagatcctgtagtgtatgacgctaaattcgaaaagcagctgggacagatcatgctccttatactgtgtactagccaaattttgctgatgaggacgacctgggccctctgcgagtccatcacactggcgactggccccttaaccacactttgggagggttctccagggaagttttggaataccactattgccgtctcaatggcaaacatcttccgcggaagctacctggctggcgccggtctcgcattctccctaatgaaaagtctgggcgggggacggagaggcacgggggctcagggagaaacattgggcgagaagtggaaacgtcagctgaatcagctctctaagagcgaatttaacacctataaaaggtcaggtataatggaggttgaccggtccgaagccaaggaggggcttaagcgcggagagactaccaaacacgccgtgagtcgaggcacagcgaagctgagatggttcgtcgaaaggaatttggtgaaacctgagggtaaggtaatcgatctgggctgtgggcggggaggctggagctactattgcgctgggctcaaaaaggtgactgaagttaagggatacaccaaaggcggtcccgggcacgaggaaccgattccaatggcaacatacggatggaacttagtgaagctgcattctggcaaagacgtctttttcatccctcccgagaagtgtgatacgcttctgtgcgacattggcgagtcctcaccaaatcccaccatcgaagaggggcgcactctaagagtgctcaaaatggtcgaaccttggctgaggggaaaccaattttgtattaagatcttgaatccgtatatgcccagcgtggttgagacactggagcagatgcagcgaaaacacggtggcatgctcgtacggaacccactttcgcgtaattctacccatgaaatgtactgggtgagttgcgggactggaaacatagtctccgccgtgaatatgacaagcagaatgctgttaaaccgcttcaccatggctcacaggaagcctacgtatgagcgggatgttgacctgggcgccggtaccagacacgtggcagtcgaacccgaggtggccaacttggatattatcgggcagcgcatcgaaaatattaagcatgagcacaaatcaacatggcattacgacgaggataacccttataagacttgggcttaccacggatcctatgaagtaaaaccatctggcagcgcgagttccatggtgaatggcgttgtcaagctcctgaccaaaccctgggacgtgatacctatggtgacacaaatcgccatgactgataccacaccatttgggcagcagagggtcttcaaggagaaggttgacacccgaactcccaaagcaaagcggggaacggctcaaattatggaagtgacagccaaatggctatggggttttcttagcagaaacaagaaaccgaggatctgtacccgcgaggagttcactcgtaaggtacggtctaatgcagccattggcgctgtgtttgtcgacgagaaccagtggaactcagccaaggaggcggtggaagatgagagattctgggacctggttcatagggaacgcgagctccacaaacaggggaagtgcgcaacctgcgtgtacaacatgatgggaaaacgagaaaagaaactgggcgagtttggtaaggccaaggggagtcgggctatctggtacatgtggttgggagccagattcctggagttcgaagcactcggctttatgaatgaggatcactggttctccagggaaaacagcctttctggcgtcgagggggagggactgcataaattaggttatatactgcgcgacatctcgaagattcctggcgggaatatgtacgctgatgacacagccggatgggatacgagaatcaccgaagacgatttgcagaacgaggctcggattactgacatcatggaaccagagcacgccctcctggcaaaatcaatatttaagctaacatatcaaaataaagtggtaagggttcagcgtcccgcgaagaacggcaccgtgatggatgtcattagccgacgcgaccagagaggttccggacaggtgggaacttacggccttaatacattcaccaacatggaagcccaactgatccggcagatggagagtgagggcatcttttctcctagcgaactcgagacaccaaacctggctgaaagggtgttggattggttagagaaatatggggtcgaacgcctgaagagaatggccatttccggagacgactgtgttgtgaagcccatagatgaccggttcgcaactgctctcaccgcccttaatgatatgggtaaagtaaggaaggacatcccgcagtgggagccttcaaaaggctggaacgattggcagcaagtgcccttttgcagtcatcacttccaccagctgattatgaaggacgggcgagagatcgtcgtgccatgtcgtaatcaggatgagctagttggcagagcacgcgtgtctcagggcgccggttggagcctgcgggagacggcgtgcctcgggaaatcctacgctcaaatgtggcagttgatgtattttcataggagagacctgcgccttgccgcaaacgccatttgttcagctgtccctgtggattggatccccaccagccggacaacttggtctatacacgcccatcaccagtggatgaccacagaagacatgctgtccgtatggaatagggtttggatcgaggaaaacccatggatggaggataagactcatattagtagctggggagacgtgccctacctcggcaagcgagaggaccaatggtgcggctcgttaatcgggctgaccgcaagagctacgtgggccacaaatattcaggtcgcgatcaaccaggtgcggaggttgattggaaatgaaaactacctggattatatgacctccatgaaacgcttcaagaatgagtctgaccctgaaggtgctctctggtga

SEQ ID NO: 13652 - RNA, 9879 nt, synthetic construct
  misc_feature 1..9879: note = derived and/or modified CDS sequence (opt3) from DENV-1__FJ906728__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagctgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccgtgctgaggaaactttgcattgaagctaagatctctaatacgaccacagatagccggtgtccaactcaaggagaggccaccctggtcgaagagcaggacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctaccacagagatccagctgaccgactacggggccctcatccttgattgtagcccaaggactggactggacttcaacgaaatggtcttgctaacaatgaaggagaaatcttggctggtgcataagcagtggtttctcgatctgccgcttccctggacgtccggcgcatcaaccagccaagagacttggaatcggcaggacctgttggtaacattcaaaaccgctcacgccaagaagcaggaagttgtggtcctcggtagtcaagagggggctatgcacacagccctgactggcgcaaccgaaattcagacgtctggaaccacaactatatttgccggccatttaaaatgccgtctgaagatggataaactaaccctcaaggggatgtcctatgtgatgtgtacaggacctttcaaactggagaaggaagtcgctgagactcagcacggtaccgtgcttgttcagatcaagtacgagggcacggacgcgccatgcaaaattcccttcagcacacaagatgaaaagggggtgacccagaacggacgcttgatcactgcaaatcctatagtaacagacaaagagaagccagtcaacattgaagccgagcccccgtttggcgagtcgtatatcgtgatcggtgctggggaaaaagccctgaagctctcttggttcaagaaaggctcctcaattggaaagatgtttgaggcaaccgccagaggcgctaggcggatggccatcctgggggatactgcatgggacttcggaagtattggtggcgtttttaccagcgtggggaaacttgtccatcagatattcggaacagcgtacggcgtgctgttttccggtgtatcttggacgatgaagatcgggattggcgtgttgctcacctggctgggattaaatagccgatcaactagtctgtccatgacatgtatcgctgttggcctagtcaccctctacctgggggtgatggtgcaggccgatagcggatgcgtcatcaactggaaaggccgcgaacttaagtgtggttctgggattttcgttacaaatgaggtgcacacttggaccgaacaatataagtttcaggcagactcacctaaaagattgagtgccgctataggaaaggcctgggaggagggcgtgtgcggtatcaggagcgcaacgcggctggaaaacattatgtggaaacagatctccaacgagctcaatcatattctgttagaaaacgacatgaagctgacagtagtcgtgggcgatgttgctgggatccttggacagggcaaaaagatgatacgcccccaaccaatggagtacaaatattcttggaagtcgtgggggaaggccaaaatcattggagcggacgcccagaataccactttcatcattgatggccctaacacccccgaatgtccagacgatcagagagcttggaatatctgggaggtggaggactacggttttgggatattcacaactaacatttggttgaagctcagggatagctatacccaggtctgcgaccaccgtctgatgtccgcagccatcaaagattcaaaggctgtgcacgccgacatgggatactggattgaaagtgagaaaaatgaaacatggaagctagcacgggcgtcttttatcgaggttaagacgtgtatatggcccaaaagccataccctgtggtccaacggcgtgctcgaatcagagatgatcattcctaagatctatggtggcccaattagccaacacaattaccgaccggggtacttcactcagacagccggaccctggcatctgggcaaacttgagttggatttcgacctgtgcgaagggaccactgtagtcgtggatgagcactgcggaaacagaggcccttctttaaggacaaccacggtgactggtaagatcatacacgaatggtgttgccgctcctgtaccctcccacccctgcggtttagaggggaggacggatgctggtatggcatggagattaggcctgtcaaagaaaaggaggaaaatcttgttaagagtatggtgagcgctggttctggcgaggtagactccttctcactggggttgctctgtatcagtatcatgattgaagaggtgatgcgcagccgatggtcgcggaaaatgctgatgacaggaaccctagccgtctttttcctgctcatcatgggccagctgacttggaacgatcttattcgtttgtgcataatggtgggggcaaatgcttccgacagaatgggaatgggcacaacctacctggccttaatggcaacatttaagatgaggccaatgttcgccgttggtctcctgcttcgccggctgacttctagagaggtgctactcctgaccatcgggttgagcctggtcgcttcagtggaattacccaacagtctcgaggaactgggagatggccttgcgatgggcattatgatcctgaaattgctcacggactttcaatcccatcagctgtgggccacactactgtctcttaccttcattaagactacctttagcctccactatgcatggaaaacaatggctatggttctgtccatcgtgtcattgttcccgctgtgtttaagcactaccagtcagaagacgacatggctccctgtcctgcttgggtctctgggatgcaagccattgaccatgtttctcatagccgagaataaaatctggggtaggaagtcctggcccctgaacgaaggcattatggccgtagggatcgtgagcattctactgtcgtcacttctcaaaaacgatgttcctctggctggacccttgatcgcaggcggtatgttaatagcctgttacgtgatttctgggagttccgcggacctgagcctcgagaaggctgccgaggtctcttgggaagaggaagcagagcatagcggagcctcccacaatatcctggtggaagtacaggatgacggcactatgaaaatcaaggatgaggagcgagacgatacacttaccattctgttgaaagctactctactggcagtgtcaggcgtctatccactcagtatacctgccacactgttcgtttggtacttttggcaaaagaagaaacagcgcagcggggtgctttgggacaccccctctccaccggaagtggagcgggcggtcttagatgacggaatctatagaattatgcagaggggtctgctcggccgttcccaggtgggggttggagtattccaagaaaacgtgttccatacgatgtggcacgtcactcgcggcgctgtgttgatgtaccagggtaagcggctggagccttcatgggccagtgttaaaaaggacctcatcagctacgggggaggctggagactgaggggctcctggaataccggggaggaagtgcaggtcattgcagtggagcccggaaaaaacccaaagaatgtacagacagcccccggtacctttaagacacctgaaggcgaggtcggggctatcgcccttgatttcaaaccaggaacttctggctcgcccatagtgaaccgagaaggtaagatcgttgggctgtatggaaatggcgtggtcaccacgagcggcacatacgtgtcagcaattgctcaagccaaagcgtcccaggaggggcctttgccggagatcgaagacgaggtttttcggaagcgcaacctaactattatggatctgcacccaggaagtggtaaaaccagaaggtatctccccgccatcgtgcgggaagcaataaagcgaaagttaagaacactgattcttgctcctacccgcgtcgtggcctctgagatggctgaagcactgaaaggcatgccaatcaggtaccagactaccgccgtaaagagcgagcatacagggaaagagatcgtggacctcatgtgccacgccacgttcactatgcgtttgctgtcccccgttcgggtccctaattataacatgattatcatggatgaagctcattttaccgacccgtcatctatagcggcaagaggatacattagcacaagggtgggcatgggtgaggccgctgccatcttcatgaccgcaactcccccagggagtgtggaagcctttcctcaatccaatgctgtcattcaggatgaggaacgcgacatccccgagcgaagctggaacacaggatatgagtggataaccgatttcccaggcaagacggtatggtttgtgccttctattaaatcaggcaatgacatcgcgaactgtctcagaaagaatgggaagcgggttatccagctgtccaggaaaactttcgatacagaataccagaagaccaaaaacaacgactgggactacgtggtcaccactgatattagtgagatgggagccaattttcgcgcagaccgtgtgatcgatcccagacggtgccttaagccagttattctaaaagacggtccggaaagggtgatactggctggccctatgcccgtcacagtggccagcgcagcccaacgccgagggagaatcggacggaaccacaataaggagggcgatcagtatatttacatgggtcagccattgaacaatgacgaggatcatgctcactggaccgaagccaagatgttactggacaacatcaatacacccgaggggatcattcctgcgctcttcgaaccagagagggaaaaatcggcagccgtagatggcgagtatcgcctgagaggagaggctaggaagactttcgtggaacttatgcggcgtggcgacctgcccgtttggctctcttacaaagtcgcctccgaggggtttcagtatagcgatcgccgatggtgcttcgacggagaaagaaacaatcaagtgttggaggaaaacatggatgtggagatatggacgaaggagggtgaaaggaaaaagctgcggcctcgctggctagacgctagaacctactcagacccgctggcactcagggagtttaaagaattcgccgctggccggcgaagtgtctctggggatcttatcctggagattggaaagttaccacagcacttgacacagagagcccagaatgcactggacaacctcgttatgctgcataattccgaacaaggcggtcgcgcgtataggcacgccatggaggagcttcccgatactatcgaaaccctgatgctcttggctctgattgccgtgttaacagggggcgtaaccctatttttcctgagcggacggggcctcgggaagacttcaatcggacttctgtgtgtgatggcaagtagcgtcttgctgtggatggcttccgtggagcctcattggatagccgcatctatcattctcgaatttttcctgatggttcttctcatccccgagccagaccgtcagagaacgcctcaggataaccagctggcctacgtggtcattggtttgctgtttatgatcttagctgtagcggccaatgagatgggcctactggaaaccacaaaaaaggacctcgggataggacacgtggcagttgagaaccaccatcacgctgccatgcttgatgtggacctgcatcccgccagcgcatggactttgtacgctgtcgccaccacaattatcaccccaatgatgaggcacactattgaaaacacaacggcgaatatctccctgaccgctatagccaaccaagcagccatcctcatgggcctggataaaggttggcctatttcaaagatggacatcggggtgccgcttttagctctgggctgctattctcaggtcaatcccctcactttgacagcagccgtgctgatgctagttgcgcattacgctattatcggaccaggcctgcaggccaaagcaacccgcgaggcccaaaagcggaccgctgccgggataatgaagaaccctacagtggatggaattgtagcaatcgacctcgatcccgtggtctatgacgctaaattcgaaaagcagcttggccagatcatgctgttgattctgtgtactagtcagatcctcctgatgcgaacgacctgggccttatgcgagtcgataacacttgcgactggtccactgaccacactctgggaggggagccctggaaaattttggaataccactattgccgtttccatggcaaacatcttcagaggctcttacctagctggtgccggcctggcattttcattgatgaagagcctggggggaggcaggcgcgggacgggagctcaaggcgaaacactcggtgagaaatggaagcggcagcttaatcagctgtccaagagtgaattcaacacctataaaagatctgggattatggaggtggaccgtagcgaagccaaggagggattgaaaaggggcgagactaccaagcacgccgtctcacggggtacagcgaaactgcgctggttcgtggaacgaaatctcgtaaagcccgagggcaaggtgatcgatttagggtgtggaagaggcgggtggtcctactattgcgctggactgaaaaaggttactgaagtgaaaggctacaccaagggtgggccgggacacgaggaaccaatacctatggcaacatacggctggaaccttgtcaaactgcatagtggcaaggacgtgtttttcatccccccagagaaatgtgatacgctactctgcgacattggggagagctctcccaatcctaccatcgaagagggaaggactctgcgggtcttgaagatggtggaaccgtggctgcgcggtaaccagttttgtattaagatcctcaatccctatatgccatccgttgtagagacacttgagcaaatgcagagaaaacacggcgggatgctggtgaggaaccctttatcacgaaatagcacccatgaaatgtactgggtctcgtgcggaactggcaacattgtgtctgccgttaatatgacaagtcggatgctgttgaaccgtttcaccatggctcacagaaagcccacgtatgagcgcgatgtggacctcggtaccgggacaaggcacgtcgccgtggaacctgaggtagcaaacctggatatcataggacagcggattgaaaatatcaaacatgagcacaagtccacttggcattacgacgaggataacccatataaaacctgggcctaccacggcagctatgaagtgaagccctcaggctccgcttctagcatggttaatggggtcgtgaagctacttacaaaaccttgggacgtgatcccaatggtcactcagattgcgatgaccgatacaaccccctttggacaacagagagttttcaaggagaaagtggacactcgcacgccgaaggccaaaaggggtacagcacagataatggaagtaaccgctcgatggctgtggggctttctcagtcggaacaagaagcctagaatctgtactagggaggaattcacccgcaaagtgcgttccaatgccgcaattggggccgtctttgtggacgagaaccaatggaatagcgctaaggaggccgttgaagatgagcggttctgggacctggtgcatagagaaagggagttgcacaaacagggaaagtgcgcgacatgcgtctacaacatgatgggcaaacgcgaaaagaagctgggtgagtttgggaaagcaaagggatctcgagccatctggtacatgtggctcggcgctcggttccttgagtttgaagccctgggcttcatgaatgaggatcactggttctcaagagaaaacagtttatccggggtggagggagagggtctgcataaattgggctatattctcagggacatcagcaagataccagggggaaatatgtacgcagatgacacggctggctgggatacccgcatcactgaagacgatctgcagaacgaggccaaaattacagacatcatggaacccgagcacgctctacttgccaaggcaatttttaaactgacctatcagaataaggtagttagagtgcaacggcctgcgaagaacggtactgtcatggatgtgatctctaggcgtgaccagcgagggtcgggacaggtgggcacatacggcctcaataccttcacaaacatggaagcccagctgatacgccaaatggagtcagaggggatttttagcccatccgaattggagactcccaacttagctgaaagagccctggattggctcgagaaatatggagtcgaacggcttaagaggatggcaatcagtggtgacgactgtgttgtgaaaccgatcgatgaccgcttcgctaccgccctgacggcactaaatgatatgggcaaggtaagaaaagacattcctcagtgggagccctctaaggggtggaacgattggcagcaggtgccattttgcagccatcacttccaccaactgataatgaaggacggacgggagatcgtcgtgccttgtaggaatcaggatgaactcgttggccgagcccgtgtgtcccagggtgcggggtggtcattgagagagaccgcttgcctgggaaaaagttacgcccagatgtggcaacttatgtattttcatcgccgggacctgaggctcgcagccaacgctatttgttctgccgtccccgtggattgggtaccaacaagcagaactacctggtccatccacgcacatcaccagtggatgacaactgaagacatgttatcagtttggaatcgcgtgtggattgaggaaaacccctggatggaggataagacccatatcagctcttgggaggacgtcccttacctgggcaaacgggaagaccagtggtgcggctccttgatagggctgacggctagggccacatgggcgaccaatatccaagtggctattaaccaggttcgaagactcatcggaaatgagaactaccttgattatatgactagtatgaagcggttcaaaaatgaaagcgacccagagggtgccctgtggtga

SEQ ID NO: 13653 - RNA, 9879 nt, synthetic construct
  misc_feature 1..9879: note = derived and/or modified CDS sequence (opt3) from DENV-1__FJ461313__SS-prME
  source 1..9879: mol_type = other RNA
agcgtgaccatgctgctcatgcttatgcccacagcactggctttccacttgactacgagaggaggggaacctcatatgatcgtctccaagcaggaaaggggaaaatctttactgtttaagacctcagccggtgttaacatgtgcacattaattgccatggacctcggcgaactgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaattgctcaagacagaggtgaccaaccctgccgtgctgaggaaactttgcattgaagctaagatctctaatacgaccacagatagccggtgtccaactcaaggagaggccaccctggtcgaagaacaggacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatgtgtactgggtcgttcaaactggagaaggaagtcgctgagacccagcacggtacggtgcttgttcagataaagtacgagggcacagacgcgccttgcaaaatcccattctcgacccaagatgaaaagggggtgactcagaacggacgcttgattacagcaaatcccatcgtaaccgacaaagagaagcctgtcaacatagaagccgagccaccctttggcgagtcttatattgtgatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtttttacatccgtggggaaacttgtccatcagattttcggaacggcgtacggcgtgctgttttctggtgtaagctggaccatgaagatagggatcggcgtgttgctcacttggctgggattaaattcacgaagtacatccctgagcatgacctgtattgctgttggcctagtcacactctacctgggggccatggtgcaggcagattctggatgcgtgatcaactggaaaggccgcgaacttaagtgtggttcagggatcttcgtcactaatgaggttcacacctggacggaacaatataagtttcaggccgacagtccgaaaagattgagcgctgccattggaaaggcatgggaggagggcgtgtgcggtataaggtccgctacacggctggaaaacatcatgtggaaacagatttctaacgagctcaatcatatcctgttagaaaacgacatgaagctgaccgtggtagtcggcgatgtggccgggattcttggacagggcaaaaagatgatccgccctcaacccatggagtacaaatattcgtggaaaagctgggggaaggcgaaaataatcggagccgacgctcagaatactaccttcattatcgatggcccaaacacacctgaatgtcccgacgatcagagagcatggaatatttgggaggttgaggactacggttttgggatcttcactaccaacatatggttgaagctcagggattcctatacacaggtgtgcgaccaccgtctgatgtcagccgctattaaagatagtaaggccgtccacgcagacatgggatactggatcgaatctgagaaaaatgaaacgtggaagctagcgcgggccagctttattgaggtgaagacctgtatctggccaaaatcccatactctgtggtcaaacggcgttctcgaaagcgagatgataatccccaagatttatggtggccctatctctcaacacaattaccgaccagggtacttcacacagaccgctggaccgtggcatctgggcaaacttgagttggatttcgacctgtgcgaagggactacagtggtagtcgatgagcactgcggaaacagaggcccctccttaaggaccacgactgtgaccggtaagattatccacgaatggtgttgccgcagttgtacactccctccactgcggtttagaggggaggacggatgctggtatggcatggagataaggcccgtgaaagaaaaggaggaaaatcttgtcaagagcatggtttctgccggttccggcgaggtggactcattcagtctggggttgctctgtattagcatcatgatcgaagaggtaatgcgctcgcgatggtcccggaaaatgctgatgaccggaactctagcagtgtttttcctgctcattatgggccagctgacatggaacgatcttatccgtttgtgcattatggtcggggctaatgcctctgacagaatgggaatgggcaccacatacctggcattaatggccacttttaagatgaggcctatgttcgctgtgggtctcctgtttcgccggcttaccagcagagaggttctgctactcacgatagggctgtcattggtggcgagtgtcgaactgccaaactccttagaggaactcggagatggcctggccatgggcatcatgattcttaaactgttgacagacttccaatctcatcagctctgggcaaccctgctaagcctgacttttatcaagaccacattctcccttcactatgcttggaaaactatggccatggtgctctcaattgttagcctgtttcccttgtgtctgagtaccacgtctcagaagacaacctggttaccggtgctcctggggtcccttggatgcaagcctctgactatgttcttgatcgccgagaataaaatatggggtaggaagtcctggccactcaacgaaggcatcatggctgtcgggattgtatcgatcctgctatcatctctgcttaaaaacgatgtgcccctcgcaggacctctgattgccggcggtatgttgatcgcgtgttacgttataagtgggtccagcgctgacttatctctggagaaggccgcagaggtgagctgggaagaggaagccgagcattccggagcttcacacaatattctcgtcgaagtgcaggatgacggcacaatgaaaatcaaggatgaggagcgagacgataccctgactatccttctgaaagcaacattgctagccgtaagtggcgtgtatcccctgagcattccagcgaccctctttgtctggtacttctggcaaaagaagaaacagcgctctggggttctgtgggacacgccttcacccccagaagtggagcgggctgtgcttgatgacggaatatatagaatcatgcagaggggtttactgggccgtagccaggtcggggtgggagttttccaagaaaacgtatttcatactatgtggcacgtgacccgcggcgccgtcctcatgtaccagggtaagcggttggagccgagttgggcaagcgtgaaaaaggacctgatttcctacgggggaggctggagactcaggggctcttggaatacaggggaggaagttcaggtgatcgccgtcgagcctggcaaaaaccccaagaatgtgcagaccgctccaggtacattcaagactcccgaaggcgaggtaggggccattgcactggattttaaacctggaacctcgggcagcccaatcgtcaaccgagaaggtaagatagtggggctttatggaaatggcgttgtgacgacatcaggcacttacgtctccgctatcgcccaagcgaaagccagtcaggaggggcccctgcctgagattgaagacgaggtgttccggaagcgcaacttgaccatcatggatctacacccgggatctggtaaaacaagaaggtatctgccagcaattgttcgggaagctatcaagcgaaagctcagaaccttaatactggcccccactcgcgtggtcgctagcgagatggcagaagcccttaaaggcatgcctattaggtaccagaccacagccgtgaagtccgagcatacggggaaagagatcgtagacctgatgtgccacgctacttttaccatgcgtctcttgtcaccagtgcgggttcccaattataacatgatcattatggatgaagcgcatttcacagacccttctagcatcgcagccagaggatacataagtaccagggtcggcatgggtgaggctgccgcaatttttatgactgccacaccgcccgggtccgtggaggctttcccacaaagcaatgcggtgatccaggatgaggaacgcgacattcctgagcgatcttggaactcaggatatgagtggatcaccgattttcccggcaagacggtctggttcgtaccatccataaaaagtggcaatgacattgccaactgtctgagaaagaatgggaagcgggtgatccagctcagcaggaaaacttttgatacagaataccagaagaccaaaaacaacgactgggactacgttgtgaccactgatatctcggagatgggagcaaatttccgcgctgaccgtgtcattgatcctagacggtgcctgaagcccgtgatccttaaagacggtccagaaagggttattctagccggcccgatgcctgtgacagtcgcatctgccgctcaacgccgagggagaataggacggaaccacaataaggagggcgatcagtatatctacatgggtcagcccctgaacaatgacgaggatcatgcccactggaccgaagcgaagatgttgttagacaacattaatacaccagaggggatcatccccgcactgttcgaacctgagagggaaaaatccgccgctgtggatggcgagtatcgcctcagaggagaggccaggaagacttttgtagaactgatgcggcgtggcgaccttccagtgtggctgagctacaaagttgcttcagaggggttccagtatagtgatcgccgatggtgctttgacggagaaagaaacaatcaagtcctcgaggaaaacatggatgtggagatttggacgaaggagggtgaaaggaaaaagttgcggccccgctggctggacgcaagaacctactctgaccctctagccctgagggagttcaaagaatttgctgccggccggcgatccgtgagcggggatctcatacttgagatcggaaagctgccgcagcacttaacacagagagcacagaatgcgttggacaacctggtcatgctccataattcagaacaaggcggtcgcgcctataggcacgctatggaggagctgccagatactattgaaacccttatgctgctcgccttgatcgcagttctgacagggggcgtgaccttattctttctaagtggacggggcctggggaagactagcattggactcctttgtgtaatggcttcctctgtgctgttgtggatggccagcgtcgagccccattggatcgcagcctccataatcctggagttctttctcatggtgctgcttattcctgagcccgaccgtcagagaacgccacaggataaccagctcgcttacgttgtgatcggtctgttgttcatgattctgaccgtcgcggccaatgagatgggcttactagaaacaactaaaaaggacctggggatcggacacgtagcagtggagaaccaccatcacgctgccatgctcgatgttgaccttcatcctgcctcagcatggaccctgtacgctgtggccacaaccataattactcccatgatgaggcacacaatcgaaaacacgaccgcgaatatttctttgactgctatcgccaaccaagcagccatactgatgggcctcgataaaggttggccaatcagtaagatggacattggggtccctctgcttgctttaggctgctatagccaggtgaatccgctgacactcaccgcagccgtcttgatgctggtggcgcattacgctatcattggacccggcctacaggccaaagcaacccgcgaggcccaaaagcggacagctgccgggatcatgaagaacccaactgttgatggaatagtggcaattgacctggatcctgtagtgtatgacgctaaatttgaaaagcagctcggccagatcatgcttctgatcttgtgtacgagccagattctgctcatgcgaaccacatgggccctgtgcgagtccatcactttagcgaccggtccccttacaaccctgtgggaggggtctccaggaaaattctggaatactacgatagccgtctcaatggcaaacatttttagaggcagctacctcgctggtgccggcctagcattctccctgatgaagagtctagggggaggcaggcgctctacaggggctcaaggagaaaccctgggcgagaaatggaagcggcagctcaatcagcttagcaagtcagagttcaacacttataaaagatccggtatcatggaggttgaccgtagtgaagccaaggaggggctgaaaaggggagagaccacaaagcacgccgtgagccggggcactgcgaaattgcgctggtttgtcgaacgaaatctggtgaagcctgagggtaaggtaattgatctcggctgtgggagaggaggctggtcttactattgcgctgggctaaagaaggtgaccgaagttaaaggatacacaaagggcggtcccgggcacgaggaaccgatcccaatggcaacgtacggatggaacctggtgaaacttcattccggcaaggacgtcttctttatacctcccgagaaatgtgataccctgctatgcgacatcggcgagtcaagcccaaatcccactattgaagaggggaggacactccgggtgctgaagatggtcgaaccttggttgcgcggaaaccagttctgtatcaagattctgaatccgtatatgccctcggtggttgagaccctcgagcaaatgcagagaaaacacggtggcatgcttgtaaggaacccactgtctcgaaatagtactcatgaaatgtactgggtgtcctgcgggacaggaaacatcgtcagcgccgtgaatatgacctcacggatgttactgaaccgttttacgatggctcacagaaagcctacctatgagcgcgatgttgacttgggcacaggtactaggcacgtggccgtcgaacccgaggtggcaaacctcgatattatcgggcagcggatagaaaatattaaacatgagcacaagtccacctggcattacgacgaggataacccttataaaacatgggcctaccacggatcttatgaagtaaagccaagcggcagtgcttccagcatggtgaatggcgttgtcaagctgctaactaaaccctgggacgtgatccctatggtgacccagatcgcgatgacagataccactccattcgggcaacagagagtctttaaggagaaagttgacacgcgcacacccaaggccaaaaggggaaccgcacagattatggaagtgactgctcgatggctttggggtttcctgtctcggaacaagaagccgagaatatgtaccagggaggaatttacacgcaaagtacgttcaaatgccgcaatcggcgccgtgttcgtcgacgagaaccaatggaatagtgctaaggaggccgtggaagatgagcggttttgggacctcgttcatagagaaagggagctgcacaaacaggggaagtgcgcgacgtgcgtgtacaacatgatgggaaaacgcgaaaagaagttgggcgagttcggtaaagcaaaggggtcccgagccatttggtacatgtggctgggagctcggtttctcgagttcgaagcccttggcttcatgaatgaggatcactggtttagcagagaaaactctctgtcgggcgtcgagggggagggattacataaactgggttatatcttgagggacatttcaaagatccctggcgggaatatgtacgcagatgacaccgctggatgggatactcgcataacagaagacgatctccagaacgaggccaaaatcaccgacattatggaaccagagcacgctctgctagccaaggcaatcttcaaacttacttatcagaataaggtggtaagagttcaacggcccgcgaagaacggcacagtgatggatgtcattagcaggcgtgaccagcgaggttccggacaggtgggaacctacggcctgaatacatttactaacatggaagcccagctcatccgccaaatggagagtgagggcatattctctcctagcgaactggagaccccaaacttggctgaaagagccttaaattggctggagaaatatggggtggaacggctcaagaggatggcaatttccggagatgactgtgtcgttaaacccatcgacgatcgctttgctacggcccttaccgcactgaacgacatgggtaaggtgagaaaagatatcccgcagtgggagccttcaaagggctggaatgactggcagcaggtacccttctgcagtcatcactttcaccaactaattatgaaggatgggcgggagatagtggtcccatgtaggaaccaggacgaactggtgggacgagcccgtgtttctcagggcgcgggttggagcctcagagagacagcttgcttggggaaatcctacgcccagatgtggcaactgatgtatttccatcgccgggatcttaggctggcagccaatgctatctgttcagccgtgcctgtcgactgggtgcccactagcagaaccacatggtctattcacgcacatcaccagtggatgactaccgaagatatgctctccgtatggaaccgcgtttggatcgaggaaaatccatggatggaggacaagacgcatattagtagctgggaggatgtgccctacttaggaaaacgggaagaccagtggtgcggctcgctgatcggcttgacagctagggccacctgggcgactaacatacaagtcgctatcaatcaggtgcgaagactgattgggaacgagaattacctcgactatatgacatccatgaagcggtttaaaaacgaatctgatcctgagggagccctttggtga

SEQ ID NO: 13654 - RNA, 9879 nt, synthetic construct
  misc_feature 1..9879: note = derived and/or modified CDS sequence (opt3) from DENV-1__FJ547063__SS-prME
  source 1..9879: mol_type = other RNA
agcgtgaccatgctgctcatgcttatgcccacggccctggctttccacttgactacgagaggaggggaacctcatatgatcgtctccaagcaggaaagaggaaaatctttactgtttaagacctcagccggtgttaatatgtgcacactgattgccatggacctcggcgagctgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccgggagcttcaaactggagaaggaacttgccgagacgcagcacggtacagtcttggtgcagataaagtacgagggcaccgacgctccttgcaaaatcccattctcgactcaagatgaaaagggggttacacagaacggacgcctgattaccgcgaatcccatcgtgactgacaaagagaagcctgtaaacatagaagcagagccaccctttggcgagtcttatattgtcatcggtgccggggaaaaagctctcaagctgtcctggttcaagaaaggctcaagtatcggaaagatgtttgaggccaccgcaagaggcgccaggcggatggctattcttggggatacagcctgggacttcggaagcatcggtggcgtgtttacgtccgttgggaaactggtgcatcagattttcggaaccgcatacggcgtcttgttttctggtgtgagctggactatgaagatagggatcggcgtactcctgacatggttaggactaaattcacgaagtacctccctaagcatgacatgtattgcggtgggcctcgttactctgtaccttggggtcatggtgcaggctgattctggatgcgtgatcaactggaaaggccgcgaattgaagtgtggttcagggatcttcgtcaccaatgaggttcacacgtggacagaacaatataagtttcaggccgacagtccgaaaagactgagcgcagccattggaaaggcttgggaggagggcgtgtgcggtataaggtccgccacccggctcgaaaacatcatgtggaaacagatttctaacgagctgaatcatatcttactggaaaacgacatgaagttcactgtggtagtcggcgatgtggcagggattcttgctcagggcaagaagatgatccgccctcaacccatggagtacaaatattcgtggaaaagctggggcaaggccaagataatcggggcggacgttcagaataccacatttattatcgatggaccaaacactcctgaatgtcccgacgatcagagagcctggaatatttgggaggtggaggactacggcttcggtatctttaccacaaacatatggttgaagctcagggattcctatacgcaggtctgcgaccaccgtctgatgtcagctgcaattaaagatagtaaggccgtgcacgctgacatggggtactggatcgaatctgagaaaaatgaaacctggaagctagcccgggcatccttcattgaggttaagacttgtatctggccaaaatcccatacactgtggtcaaacggagtgctcgaaagcgagatgataatccccaagatttatggcggtcctatctctcaacacaattaccgaccaggctacttcacccagactgcggggccgtggcatctgggaaaacttgagttggattttgacctgtgcgaaggcacaaccgtagtcgtggatgagcactgcgggaacagaggaccctccttaaggacgactaccgtgacaggcaagattatccacgaatggtgttgccgcagttgtaccctccctccactgcggttcagaggtgaggacgggtgctggtatggaatggagataaggcccgtcaaagaaaaggaggaaaatcttgttaagagcatggtgtctgccggctccggtgaggtagactcatttagtctgggcttgctctgtattagcatcatgatcgaagaggtgatgcgctcgcgatggtcccggaaaatgctgatgactgggacactagctgtcttctttctgctcattatgggacagctgacctggaacgatcttatccgtttgtgcattatggtgggcgccaatgcatctgacagaatggggatgggaacaacttacctggctttaatggccaccttcaagatgaggcctatgtttgcagttggcctcctgttccgccggcttacgagcagagaggtgctgctactcacaataggtctgtcattggtcgccagtgtggaactgccaaactccttagaggaactcggggatggactggctatgggcatcatgattcttaaactgttgaccgactttcaatctcatcagctctgggcgactctgctaagcctgaccttcatcaagacaactttttcccttcactatgcctggaaaaccatggcaatgattctctcaatcgttagcctgttccccttgtgtctgagtacgacatctcagaagaccacttggttaccggtgctcctgggctcccttgggtgcaagcctctgacaatgtttttgatagctgagaataaaatctggggaaggcgaagctggccactcaacgaaggtattatggccgtcggcatcgtatcgattctgctatcatctctgcttaagaacgatgtgcccctcgccgggcctctgatcgctggaggcatgttgatagcatgttacgttattagtggttccagcgccgacttatctctggagaaagcggctgaggtgagctgggaagaggaagccgagcattccggggcatcacacaatatcctcgtcgaagtgcaggatgacggaaccatgaagatcaaagatgaggagcgcgacgatactctgacaattcttctgaaggccaccttgctagctgtaagtggcgtgtatcccctgagcataccagcaacactcttcgtctggtacttctggcagaagaagaagcagcggtctggcgttctgtgggacactccttcacccccagaagtggagagagccgtgcttgatgacgggatctataggattatgcagcgtggattactgggtcgcagccaggtcggcgtgggggtttttcaagaaaacgtattccataccatgtggcacgtgacacggggagcggtcctcatgtaccagggcaaaagattggagccgagttgggctagcgtgaagaaagacctgatctcctacggtgggggatggaggctccagggctcttggaataccggcgaggaagttcaggtgattgccgtcgagcctgggaagaaccccaaaaatgtgcaaacagcaccaggaacttttaagacccccgaaggtgaggtaggcgccatcgctctggatttcaagcctgggacgtcgggaagcccaatagtcaaccgagaaggcaaaatcgtgggtctttatgggaatggagttgtgacaacttcaggcacctacgtctccgccattgcacaggctaaggccagtcaggagggccccctgcctgagatcgaagacgaggtgtttcggaaacgcaacttgacaattatggatctacacccggggtctggaaagaccagaaggtatctgccagcgatcgttcgggaagccataaaacgaaagctcagaactttaattctggcacccacccgcgtggtcgctagcgagatggccgaagctcttaagggtatgcctatcaggtaccaaacaacggcagtgaaatccgagcatactggcaaggagatcgtagacctgatgtgccacgccaccttcacaatgcgtctcttgtcaccagtgcgggttcccaattataacatgattatcatggatgaagcccattttaccgacccttctagcatagctgcgagagggtacattagtactagggtcggaatgggcgaggcagccgctatcttcatgacagccaccccgcccggttccgtggaagcatttccacagagcaatgccgtgattcaggatgaggaacgcgacatccctgagcgatcttggaactcagggtatgagtggataacggatttccccggaaaaactgtctggtttgtaccatccattaagagtggcaatgacatcgctaactgtctgaggaaaaatggcaagcgggtgatccagctcagcaggaagacattcgataccgaataccagaaaaccaagaacaacgactgggactacgttgtgactacagatatttcggagatgggggcgaatttccgcgccgaccgtgtcatcgatcctagacggtgcctgaaacccgtgattcttaaggacggaccagaaagggttatactagcaggtccgatgcctgtgaccgtcgcttctgccgcacagcgccgaggcagaatcgggcggaaccacaataaagagggagatcagtatatttacatgggccagcccctgaacaatgacgaggatcatgcccactggacagaagctaagatgttgttagacaacatcaatactccagagggtatcattcccgccctgtttgaacctgagagggaaaagtccgcggcaatagatggggagtatcgcctcagaggcgaggccaggaaaacgttcgtggaactgatgcggcgtggagaccttccagtatggctgagctacaaggtggcttcagagggctttcaatatagtgatcgccgatggtgcttcgacggggaaagaaacaatcaggttctcgaggaaaacatggatgtcgagatctggaccaaagagggagaaaggaagaaattgcggccccgctggctggacgccagaacatactctgaccctctagctctgagggagtttaaggagttcgcagccggtcggcgatccgtgagcggcgatctcattcttgagatcgggaaactgccgcagcacttaactcagagagctcaaaatgccttggacaacctggtgatgctccataattcagaacagggaggccgcgcatataggcacgcgatggaggagctgccagataccattgaaacacttatgctgctcgccttgatcgctgtcctgaccggtggggttactttatttttcctaagtggccggggactgggcaagacgagcatagggctcctttgtgtgatggcctcctctgtactgttgtggatggcaagcgtggagccccattggatcgctgcctccattatcctggaatttttcctcatggtcctgcttattcctgagcccgaccgtcagagaaccccacaggataaccaactcgcatacgtggttatcggactgttgtttatgatactgacagtggccgctaatgagatgggtttactagaaactaccaagaaagacctgggcattgggcacgtcgcggtagagaaccaccatcacgccgcaatgctcgatgtggaccttcatcctgcttcagcctggacactgtacgccgttgcaaccactatcattacacccatgatgaggcacacgatcgaaaacaccactgctaatatatctttgacagccatcgcgaaccaggctgccattctgatgggactcgataagggctggccaatcagtaaaatggacattggtgtgcctctgcttgcattagggtgctattcgcaggtcaatccgctgaccctcaccgccgctgtgttgatgctggtcgcacattacgccatcataggccccggactacaagcgaaggctacacgcgaggcccagaaacggactgcagccggcattatgaagaacccaacggtggatgggatcgttgctatcgacctggatcctgtggtatatgacgccaagttcgaaaaacagctcggacagattatgcttctgatcttgtgtaccagccaaatactgctcatgcgaacaacttgggcactgtgcgagtccattaccttagctacaggcccccttaccactctgtgggagggttctccagggaagttttggaatacgacaatcgccgtgtcaatggcgaacattttcagaggaagctacctcgccggcgcaggtctagctttctccctgatgaaaagtttgggcgggggaaggcgcggcaccggggcccagggagaaactctgggcgagaagtggaaacggcagctcaatcagctttctaagagcgaatttaacacctataagagatcaggtatcatggaggtcgaccgttccgaagcaaaagaggggctgaagaggggagagacaactaaacacgctgttagtcggggcaccgccaagttgcgctggttcgtggaacgaaatctggtcaaacctgagggtaaggtgatagatctcggctgtgggagaggaggctggagctactattgcgccgggttaaagaaagtaacagaagtgaagggatacacgaaaggcggtcccgggcacgaggaaccgatcccaatggcgacctacggatggaacctggttaaacttcattctggcaaagacgtgtttttcattcctcccgagaagtgtgatactctgctatgcgacatcggcgagtcctcaccaaatcccacaattgaagaggggaggaccctccgggtcctgaaaatggtggaaccttggttgcgcggaaaccaattttgtatcaagattctgaatccgtatatgcccagcgtcgtggagactctcgagcagatgcagagaaagcacggtggcatgcttgttaggaacccactgcagcgaaattcgacacatgaaatgtactgggtatcttgcgggaccggaaacatcgtgagtgctgtcaatatgacgtcccggatgttactgaaccgtttcaccatggcacacagaaaacctacatatgagcgcgatgtggacttgggcgccggtactaggcacgttgctgtggaacccgaggtcgccaacctcgatataattgggcaacggatcgaaaatatcaagcatgagcacaaaagcacctggcattacgacgaggataacccttataagacatgggcataccacggatcatatgaagtgaaaccatccggctctgccagcagtatggtaaatggcgtggttaagctgctaactaagccctgggacgtcattcctatggtgacccagatagctatgacagataccactccatttgggcagcaaagagtgttcaaagagaaggtcgacacgcgcacacccaaagcgaagaggggaaccgcccagatcatggaagttactgcaaaatggctttggggttttctgtcccgaaacaagaagccgcggatttgtaccagagaggagttcacaaggaaagtgcgcagcaatgctgccatcggcgcagtatttgtggacgagaaccagtggaactctgccaaggaggctgtcgaagatgagcgtttctgggacctcgtgcatcgggaaagagagctgcacaaacaggggaagtgcgccacgtgcgtttacaacatgatgggaaaaagggaaaagaagttgggcgagtttggtaaagcgaaggggtcacgcgcaatttggtacatgtggctgggagcccgattcctcgagttcgaagctcttggctttatgaatgaggatcactggttcagtcgggaaaactccctgagcggcgtggagggggagggattacataaactgggttatatcttgagagacatatctaagatccctggcgggaatatgtacgccgatgacaccgcaggatgggatactaggattacagaagacgatctccaaaacgaggctcgcatcaccgacattatggaaccagagcacgccctgctagctaaatcgatctttaaacttacttatcagaataaagtcgtgagagtacagcggcccgccaagaacggcacagttatggatgtgatatcaaggcgtgaccagcgaggtagcgggcaagtcggaacctacggcctgaatacattcactaacatggaagcacagctcattcgccagatggagtccgagggcatctttagtccttctgaactggagaccccaaacttggcggaaagagtgttagattggctggagaagtatggggtggaacggctcaaaaggatggccatcagcggagacgactgtgtcgttaagcccattgatgaccgcttcgctacggcccttaccgcactgaatgatatgggtaaagtgagaaaggacataccgcagtgggagccttccaaaggctggaacgattggcaacaggtacccttttgctcacatcacttccaccagctaatcatgaaggacgggcgggagattgtggtcccatgtaggaatcaggatgaactggtgggacgagctcgtgttagtcaaggcgccggttggtctctcagagagacagcatgcttgggaaagagctacgcccagatgtggcagctgatgtattttcatcgccgggaccttaggctggcggctaacgccatctgttccgcagtgcctgtcgattggattcccacttcaagaaccacatggagcatccacgcccatcaccaatggatgactaccgaagacatgctctctgtgtggaatcgcgtatggatagaggaaaacccatggatggaggataaaacgcatatctccagttggggagacgttccctacttaggcaagcgggaggaccagtggtgcggcagcctgattgggttgacagctagggccacctgggcaactaatatccaggtggctattaaccaggtccgaagactgatcggaaatgaaaactacctcgattatatgacatcgatgaaacggttcaagaatgagtccgaccctgaaggtgccctttggtga

SEQ ID NO: 13655 - RNA, 9879 nt, synthetic construct
  misc_feature 1..9879: note = derived and/or modified CDS sequence (opt3) from DENV-1__FJ410218__SS-prME
  source 1..9879: mol_type = other RNA
agcgtgaccatgctgctcatgcttatgcccaccgcactggctttccacttgactacgaggggaggggaacctcatatgatcgtcaccaagcaggaaaggggaaaatccttactgtttaagacatctgccggtgttaatatgtgcactctaattgccatggacctcggcgaactgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggtagcttcaaactggagaaggaagtggctgagacccagcacggaacggtccttgtgcagataaagtacgagggcacagacgcgccttgcaaaatcccattctcgacccaagatgaaaagggggttactcagaacggacgcttgattacagcaaatcccatcgtgaccgacaaagagaagcctgtaaacatagaagccgagccaccctttggcgagtcttatattgtcatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtgtttacatccgttgggaaacttgtgcatcagattttcggaacggcgtacggcgtcctgttttctggtgtgagctggaccatgaagatagggatcggcgtattgctcacttggctgggattaaattcacgaagtacatccctgagcatgacctgtattgctgtgggcctagttacactctacctgggggtcatggtgcaggccgattctggatgcgtgatcaactggaaaggccgcgaacttaagtgtggttcagggatcttcgtcactaatgaggttcacacctggacggaacaatataagtttcaggcagacagtccgaaaagattgagcgccgctattggaaaggcctgggaggagggcgtgtgcggtataaggtccgcaacacggctggaaaacatcatgtggaaacagatttctaacgagctcaatcatatcctgttagaaaacgacatgaagttcaccgtggtagtcggcgatgtggttgggattctggctcagggcaaaaagatgatccgccctcaacccatggagcacaaatactcgtggaaaagctggggcaaggccaagataatcggggcggacgtgcagaatactacctttattatcgatggaccaaacacacctgaatgtcccgacgatcagagagcctggaatatttgggaggtcgaggactatggcttcggtatctttactaccaacatatggcttaagttgagggattcctacacacaggtgtgcgaccaccgtctcatgtcagctgcaattaaagatagtaaggccgttcatgctgacatggggtattggatcgaatctgagaaaaatgaaacgtggaagctggcccgggcatccttcattgaggtgaagacctgtatctggccaaaatcccacactctatggtcaaacggagtactggaaagcgagatgataatccccaagatttacggcggtcctatctctcaacataattatcgaccaggctacttcacacagaccgcggggccgtggcacctcggaaaactggagcttgattttgacttgtgcgaaggcactacagtcgtggtggatgagcactgcgggaacagaggaccctccctgaggaccacgactgtcaccggcaagattatccatgaatggtgttgccgcagttgtacattacctccactccggttcaaaggtgaggacgggtgctggtacggaatggagataagacccgttaaggaaaaggaggaaaatctggtgaaaagcatggtatctgccggctccggtgaggtggactcatttagtcttggcctgttgtgtattagcatcatgatcgaagaggtcatgaggtcgcgctggtcccgaaagatgctcatgaccgggactctggctgtgttcctactgctcattatgggacagctgacatggaacgatcttatccggttgtgcattatggttggcgccaatgcatctgaccgtatggggatgggaaccacatatctggctttaatggccacttttaaaatgagacctatgttcgcagtgggcctcctgtttaggcgccttaccagccgggaggtcctgctactcacgataggtctgtcattggtggccagtgttgaactgccaaactccttagaggaactcggggatggactggctatgggcatcatgattcttaagctgttgacagacttccaatctcaccagctctgggcgaccctgctaagcctgacttttatcaaaaccacactttccctccattacgcctggaagactatggcaatggtgctgtcaattgtcagcttgttccccctgtgtttaagtaccacgtctcagaagacaacctggctcccggtactgcttggctccctggggtgcaaacctttgactatgtttctcatcgtggagaataagatatggggaagaaaaagctggccactgaacgaaggtatcatggctgttggcgtggtctcgattctactgtcatctcttctcaagaacgatgtgcccctggccgggcctttgatcgccggaggcatgttaattgcttgttatgtaatcagtggttccagcgcagacctgtctctcgagaaagccgcggaggtgagctgggaagaggaagctgagcactccggggcctcacataatatactggtcgaagttcaggatgacggaacaatgaagattaaagatgaggagagggacgatacccttactatcctgttgaaggcaacactactggccgtgagtggcgtgtaccccctcagcatcccagctaccctgttcgtctggtatttttggcaaaagaaaaagcagcgatctggcgtgctttgggacacgccttcacccccagaagttgagcgcgcagtattagatgacgggatttaccggataatgcagagaggactgctcggtaggagccaggtgggcgtcggggtgttccaagaaaacgttttccacactatgtggcacgtgacccgtggagccgtcttgatgtatcagggcaaacgcctggagccgagttgggcgagcgtgaagaaagacctcatctcctacggtgggggatggcggctgcagggctcttggaatacaggcgaggaagtacaggtcattgctgtggagcctgggaagaaccccaagaatgttcaaaccgccccaggaacatttaaaactcccgaaggtgaggtgggcgcaatcgcccttgatttcaagcctgggacctcgggaagcccaattgtcaacagagaaggcaaaatcgtgggtctgtacgggaatggagttgtgacgacatcaggcacttatgtctccgctatagcccaggcaaaggctagtcaggagggccccttgcctgagatcgaagacgaggtgtttaggaaacgaaacctaaccattatggatctgcatccggggtctggaaagacacggcgctacctcccagccatcgtaagagaagcgattaagaggaaattacggaccctgatccttgcccccactcgagtggttgcaagcgagatggctgaagccctgaagggtatgcctataagatatcaaaccacagctgtcaaatccgagcacacgggcaaggagattgtggacctcatgtgccatgcaactttcaccatgcgcttgctgtcaccagtgagggtccccaattacaacatgatcatcatggatgaagcccactttacagacccttctagcattgccgctcgtgggtatatcagtacccgggtaggaatgggcgaggcggcagccatattcatgactgctacaccgcccggttccgtggaagcctttccacagagcaatgcagttattcaggatgaggaaagagacatccctgagaggtcttggaactcagggtacgagtggattaccgatttccccggaaaaacggtgtggtttgtcccatccatcaagagtggcaatgacatagccaactgtctccgcaagaatggcaaacgagtgattcagctgagcagaaagactttcgatacagaatatcagaaaaccaagaacaacgactgggactacgttgtgaccactgatatctcggagatgggggctaattttcgggcggacagggtcatcgatcctcgccgttgccttaaacccgtgattctaaaggacggaccagaaagagtaatcctggccggtccgatgcctgtgacagttgcatctgctgcccagcggaggggccgcattgggcgaaaccataataaggagggagatcagtacatatatatgggccagcccttgaacaatgacgaggatcacgcacactggaccgaagccaaaatgttactggacaacatcaatacaccagagggtattatccccgctctcttcgaacctgagagagaaaagtccgccgcgatcgatggggagtaccggctgaggggcgaggcacgcaaaactttcgtcgaacttatgagaaggggagacctgccagtgtggctcagctataaggtggcctcagagggctttcaatacagtgatcggcgttggtgcttcgacggggaacgcaacaatcaggtcttggaggaaaacatggatgttgagatttggacgaaagagggagaacgaaagaaactgagacccaggtggctagacgctcggacctattctgaccctctggccctccgcgagtttaaggagttcgctgcaggtagaaggtccgtgagcggcgatcttatactggagatcgggaagttaccgcagcatttgacacagcgggcccaaaatgctctggacaacctcgtaatgctgcacaattcagaacagggaggccgagcctacagacatgcaatggaggagcttccagatactattgaaaccctgatgctcttggcgctgatcgccgtgttaacaggtggggtcaccctatttttcctgagtggccgcggactcggcaaaactagcattgggcttctgtgtgtgatggcttcctctgttttgctgtggatggccagcgtggagccccactggatcgcagcttccataatcctcgaatttttcctgatggtccttctcattcctgagcccgacaggcagcggacgccacaggataaccaactggcctatgtagtgatcggattgctgtttatgattttaaccgttgcagccaatgagatgggtctactggaaacaactaagaaagacctcggcatcgggcacgtggctgtcgagaaccatcaccatgcgaccatgcttgatgtggacctgcaccctgcctcagcatggacattgtacgctgtcgccaccactataattacacccatgatgcgtcatacgatcgaaaacaccactgccaatatttctctgacagcaatcgctaaccaggccgcgatactcatgggactggataagggctggccaatcagtaaaatggacattggtgtgcctcttttagctctggggtgctactcgcaggttaatccgctcaccttgaccgccgcagtgctgatgctagtagcccactatgctatcattggccccggactgcaagcaaaggccacaagagaggcgcagaagaggactgctgccggcatcatgaaaaacccaacggtggatgggatagtcgcaattgacctcgatcctgttgtgtacgacgccaagttcgaaaaacagcttggacagatcatgctgttgatcctgtgtaccagccaaattctcctgatgcgcacaacttgggctttatgcgagtccatcacccttgccacaggccccctgaccactctctgggagggttctccagggaagttttggaatacgacaatagcagtctcaatggctaacattttccggggaagctatctagccggcgcgggtctggccttttccttgatgaaaagtctgggcgggggacgaagaggcaccggggcacagggagaaactctcggcgagaagtggaagaggcagcttaatcagctgtctaaaagcgagttcaacatctacaagcgctcaggtattatggaggtggaccggtccgaagctaaagaggggttgaagagaggagagaccacacgtcacgccgtaagtaggggcactgcaaaactgcggtggttcgtggaacgcaatctcgttaagcctgagggtaaggtgatcgatttaggctgtgggcgaggaggctggagctattactgcgctgggctgaaaaaggtcaccgaagtgaaaggatatacaaagggcggtcccgggcatgaggaaccgataccaatggccacgtacggatggaaccttgtcaaactgcactctggcaaggacgtgtttttcacccctcccgagaaatgtgatactctactctgcgacatcggcgagtcctcaccaaatcccacaattgaagaggggagaaccctgagggttttgaagatggtagaaccttggctgcggggaaaccaattttgtatcaagattctcaatccgtacatgcccagcgtggtcgagactcttgagcagatgcagcgcaaacatggtggcatgctggtgagaaacccattatcgagaaattctacacacgaaatgtattgggttagttgcgggaccggaaacatcgtgtccgccgtcaatatgacgagccgaatgctgttgaaccggttcaccatggcgcaccgtaagcctacatacgagagagatgtggacctcggcgctggtactcgccatgtagcagtggaacccgaggttgccaacctggatattatcgggcagaggatagaaaatattaaacacgagcataagtcaacctggcactatgacgaggataacccttacaaaacatgggcttatcatggatcctacgaagtcaagccatctggcagcgccagttccatggtgaatggcgtggtcaagctacttactaaaccctgggacgttatccctatggtgacccaaatcgcaatgacagataccactccatttgggcagcagcgggtattcaaggagaaagtggacacgagaacacccaaggccaaacgcggaaccgctcaaattatggaagtcactgcgaggtggctgtggggttttctcagccgaaacaagaagccgcggatatgtaccagagaggagttcacaaggaaagtgcgctctaatgccgcaatcggcgctgtttttgtggacgagaaccagtggaactcagccaaggaggcagtcgaagatgagcgtttctgggacctggtgcagaaagaacgggagttgcacaagcaggggaaatgcgccacgtgcgtatataacatgatgggaaagagagaaaagaaactgggcgagtttggtaaggctaaagggagtagggccatttggtacatgtggctcggagcgcgcttccttgagtttgaagcactgggcttcatgaatgaggatcactggttctcccgagaaaacagcttatctggcgttgagggggagggactgcataagttgggttacatcctccgggacatttcgaaaatccctggcgggaatatgtatgccgatgacaccgctggatgggatactagaataacagaagacgatctgcaaaacgaggccaagatcaccgacattatggaaccagagcacgcactacttgctacttcaatctttaaactgacataccagaataaggtggtcagggtgcagcgccccgccaagaacggcaccgtgatggatgtcattagcagacgggaccagaggggttccgggcaagttggaacatatggcctcaatactttcaccaacatggaagctcagctgatccgtcagatggagagtgagggcatattttctcctagcgaattggagattccaaacttagccgaacgagtgctggattggctcgagaaatacggggtagaacgccttaagagaatggcaatctccggagacgactgtgtggtcaaacccatcgatgaccggttcgcgacggccctgaccgctctaaatgatatgggtaaggtgaggaaagacgttccgcagtgggagccttcaaagggctggaacgattggcaacaggtgcccttttgcagtcatcacttccaccagctgattatgaaggacgggcgcgagatagtcgtgccatgtagaaatcaggatgaactcgtaggacgggccagggtttctcaaggcgcaggttggagcttgcgagagacagcttgcctggggaaatcctatgcccagatgtggcagcttatgtactttcatcgtagagacctgcgcctcgcagccaacgcgatctgttcagctgtgcctgtcgattgggtgcccactagccggaccacatggtctattcacgcccatcaccaatggatgactaccgaagacatgttatccgtttggaatagggtgtggatcgaggaaaacccatggatggaggataagacgcatgtcagtagctggggagacgtgccctatctgggcaaaagagaggaccagtggtgcggctcgttgattgggctgacagcacgcgccacctgggcttccaatatccaggtagccataaaccaggtgcggaggctcatcggaaatgaaaactaccttgattacatgacttctatgaagcgattcaaaaatgagggtgaccctgaaggcgcactgtggtga

SEQ ID NO: 13656 - RNA, 9879 nt, synthetic construct
  misc_feature 1..9879: note = derived and/or modified CDS sequence (opt3) from DENV-1__FJ461316__SS-prME
  source 1..9879: mol_type = other RNA
agcgtgaccatgctgctcatgcttatgcccacagccctggctttccacttgactacgagaggaggggagcctcatatggtcgtttccaagcaagaaagaggaaaatctttactgtttaagacctcagcgggtgtgaatatgtgcacactgatcgccatggacctcggcgagctgtgtgaagatactatgacctacaaatgcccacggattacagaggcggaaccggacgatgtagactgttggtgcaatgctaccgatacttgggtgacatatgggacctgtagtcaaacgggagagcaccgccgagacaagcgtagcgtcgcccttgcaccccatgtgggcctgggtttggagactagaaccgaaacatggatgtcctctgagggggcctggaaacagatacagagggttgaaacttgggctctccggcaccctggattcaccgtgatcgcactgtttctggcccatgctattggcacatcgatcacccagaagggcattatcttcatactcttaatgctggtcacgccatcaatggccatgcgctgcgtggggatcggaagcagagattttgtagagggtcttagtggcgcgacttgggttgacgtggtcttggagcacgggtcctgtgtgacaaccatggcaaaggataaacccactctggacattgaactgctcaagacagaggtgaccaaccctgccatcctgaggaaactttgcattgaagctaagatctctaatacgaccacagatagccggtgtccaactcaaggagaggccaccctggtcgaagaacaagacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatgtgtactggtagcttcaaactggagaaggaagtcgctgagacccagcacggaacggtgcttgttcagataaagtacgagggcacagacgcgccttgcaaaatcccattctcgacccaagatgaaaagggggtgactcagaacggacgcttgattacagcaaatcccatcgtaaccgacaaagagaagcctgtcaacatagaagccgagccaccctttggcgagtcttatattgtgatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtttttacatccgtggggaaacttgtccatcagattttcggaacggcgtacggcgtgctgttttctggtgtaagctggaccatgaagatagggttgggcgtgctcctgacttggttaggactaaattcacgaagtacatccctaagcatgacctgtatcgctgttggcctcgtcacactgtaccttggggtgatggtgcaggccgattctggatgcgtcattaactggaaaggccgcgaattgaagtgtggttcagggatcttcgttactaatgaggtgcacacctggacggaacaatataagtttcaggcagacagtccgaaaagactgagcgccgctatcggaaaggcctgggaggagggcgtgtgcggtattaggtccgcaacacggctcgaaaacgtaatgtggaaacagatatctaacgagctgaatcatatcttactggaaaacgacatgaagttcaccgtcgtggttggcgatgtggctgggattcttgcccagggcaaaaagatgatccgccctcaacccatggagtacaaatattcgtggaaaagctggggcaaggcgaagattatgggggccgacgtccagaatactacctttatcatagatggaccaaacacacctgaatgtcccgacgatcagagagcttggaatatctgggaggtggaggactacggcttcggtatttttactaccaacatctggttgaagctcagggattcctatacacaggtttgcgaccaccgtctgatgtcagcagccattaaagatagtaaggctgtgcacgccgacatggggtactggatcgaatctgagaaaaatgaaacgtggaagctagcacgggcgagcttcatagaggtaaagacctgtatttggccaaaatcccatactctgtggtcaaacggagtcctcgaaagcgagatgatcattcccaagatctatggcggtcctatatctcaacacaattaccgaccaggctacttcacacagaccgccgggccgtggcatctgggaaaacttgagttggattttgacctgtgcgaaggcactacagtggtggtcgatgagcactgcgggaacagaggaccctccttaaggaccacgactgttaccggcaagatcattcacgaatggtgttgccgcagttgtacactccctccactgcggttcagaggtgaggacgggtgctggtatggaatggagatcaggcccgtgaaagaaaaggaggaaaatcttgtaaagagcatggtgtctgctggctccggtgaggtcgactcatttagtctgggcttgctctgtattagcatcatgatagaagaggtgatgcgctcgcgatggtcccggaaaatgctgatgaccgggactctagccgttttcctgctcctgattatgggacagcttacatggaacgatttgatccgtctgtgcatcatggtgggcgcaaatgcttctgacagaatggggatgggaaccacatacttagccctcatggcaacttttaagatgaggcctatgttcgccgtcggcctgctttttcgccggctgaccagcagagaggtgctactcctgacgattggtttgtcactggttgctagtgtggaattaccaaactccctcgaggaactgggggatggacttgcgatgggcatcatgattctgaaattgctcacagacttccaatctcatcagctgtgggccaccctactgagccttacttttataaagaccacattctccctccactatgcatggaaaactatggctatggtcctgtcaatcgtatccttgtttcccctgtgtttaagtaccacgtctcagaagacaacctggctcccggtgctgcttggctccctggggtgcaagcctttgactatgttcctcattgccgagaataaaatctggggaaggcgaagctggccactgaacgaaggtattatggccgttggcatcgtgtcgatactactgtcatctcttctcaagaacgatgtccccctggctgggcctttgatcgcaggaggcatgttaattgcctgttacgtgatcagtggttccagcgcggacctgtctctcgagaaagctgccgaggtaagctgggaagaggaagcagagcattccggggcctcacacaatattctggtggaagtccaggatgacggaacaatgaagatcaaagatgaggagcgcgacgatacccttactatactgttgaaggctacactactggcagttagtggcgtgtatcccctcagcattccagccaccctgtttgtgtggtacttctggcagaaaaagaagcagcggtctggcgtcctttgggacacgccttcacccccagaagtggagagagcggttttagatgacgggatctataggatcatgcagcgtggactgctcggtcgcagccaggtaggcgtgggggtcttccaagaaaacgtgtttcatactatgtggcacgttacccggggagctgtgttgatgtaccagggcaaaagactggagccgagttgggccagcgtcaagaaagacctcatttcctacggtgggggatggaggctgcagggctcttggaatacaggcgaggaagtgcaggtaatagcagtcgagcctgggaagaaccccaaaaatgtgcaaaccgccccaggaacattcaagactcccgaaggtgaggttggcgctatcgcccttgattttaagcctgggacctcgggaagcccaattgtgaaccgagaaggcaaaatcgtcggtctgtatgggaatggagtggttacgacatcaggcacttacgtgtccgcaattgctcaggccaaggcgagtcaggagggccccttgcctgagatcgaagacgaggtcttccggaaacgcaacctaaccataatggatctgcacccggggtctggaaagacaagaaggtatctcccagccatcgtgcgggaagcaattaaacgaaagttaagaaccctgatccttgctcccactcgcgtagtggccagcgagatggctgaagcactgaagggtatgcctattaggtaccaaaccacagccgttaaatccgagcatacgggcaaggagatcgtcgacctcatgtgccacgccacttttaccatgcgtttgctgtcaccagtgcgggtgcccaattataacatgataattatggatgaagctcatttcacagacccttctagcatcgcggcaagagggtacatcagtaccagggtcggaatgggcgaggccgctgccatttttatgactgcaacaccgcccggttccgtagaagccttcccacagagcaatgctgtgatccaggatgaggaacgcgacatacctgagcgatcttggaactcagggtatgagtggattaccgattttcccggaaaaacggtttggttcgtgccatccatcaagagtggcaatgacattgcgaactgtctcaggaaaaatggcaagcgggtcatccagctgagcaggaagacttttgatacagaataccagaaaaccaagaacaacgactgggactacgtggttaccactgatatatcggagatgggggccaatttccgcgcagaccgtgtgattgatcctagacggtgccttaaacccgtcatcctaaaggacggaccagaaagggtgatcctggctggtccgatgcctgtaacagtggcctctgcagcccagcgccgaggcagaattgggcggaaccacaataaagagggagatcagtatatctacatgggccagcccttgaacaatgacgaggatcatgctcactggaccgaagccaagatgttactggacaacattaatacaccagagggtataatccccgcactcttcgaacctgagagggaaaagtccgcagccattgatggggagtatcgcctgagaggcgaggctaggaaaacttttgttgaacttatgcggcgtggagacctgccagtctggctcagctacaaggtggcctcagagggcttccaatatagtgatcgccgatggtgctttgacggggaaagaaacaatcaggtgttggaggaaaacatggatgtcgagatctggacgaaagagggagaaaggaagaaactgcggccccgctggctagacgctagaacctactctgaccctctggcactcagggagttcaaggaatttgccgctggtcggcgatccgttagcggcgatcttatcctggagattgggaaattaccgcagcacttgacacagagagcccaaaatgcactggacaacctcgtgatgctgcataattcagaacagggaggccgcgcgtataggcacgccatggaggagcttccagatactatagaaaccctgatgctcttggctctgatcgccgtattaacaggtggggtgaccctattctttctgagtggccggggactcggcaagactagcattgggcttctgtgtgtcatggcatcctctgtgttgctgtggatggctagcgttgagccccattggatcgccgcatccattatcctcgagttctttctgatggtgcttctcatacctgagcccgaccgtcagagaacgccacaggataaccaactggcctacgtcgtaatcggattgctgttcatgattttaaccgtggctgcgaatgagatgggtctactggaaacaactaagaaagacctcggcatcgggcacgccgcagttggaaaccaccatcacgctgccatgcttgatgtggacctgcatcctgcctcagcatggaccttgtacgctgtcgccacaaccattatcactcccatgatgaggcacacaatagagaacacgaccgcgaatatttctctgactgctatcgccaaccaggcagccattctcatgggcctggataagggttggccaatcagtaaaatggacataggggtgcctcttttagctctgggctgctattcgcaggtcaatccgctcacattgaccgcagccgtgctgatgctagttgcgcattacgctatcattggacccggcctgcaagccaaggcaacccgcgaagcccagaaacggacagctgccgggatcatgaagaacccaactgtggatggaattgtagcaatcgacctcgatcctgtggtctatgacgctaagtttgagaaacagcttggccagataatgctgttgattctgtgtacgagccaaatcctcctgatgcgaaccacatgggccttatgcgaatccatcactcttgcgaccggtcccctgacaaccctctgggaggggtctccaggaaagttctggaatactacgattgccgtttcaatggcaaacatctttagaggcagctacctagctggtgccggcctggcattctccttgatgaaaagtctagggggaggcaggcgcgggacaggagctcagggcgagaccctcggtgaaaagtggaaacggcagcttaatcagctgtctaagagcgagttcaacacttataagagatcagggataatggaagtggaccgttccgaggccaaagaaggattgaagaggggcgagaccacaaaacacgccgtcagtcggggtactgcgaagctgcgctggtttgtggagcgaaatctcgtaaaacctgaaggcaaggtgattgatttagggtgtggaagaggcgggtggagctactattgcgctggactgaagaaagttaccgaggtgaagggctacacaaaaggtgggcccggacacgaagaaccgatcccaatggcaacgtacggctggaaccttgtcaagctgcattctggcaaagacgtgttctttattcctcccgaaaagtgtgataccctactctgcgacatcggggagtcctcaccaaatcccactatagaggaaggaaggacactgcgggtcttgaaaatggtggagccttggctgcgcggtaaccaattctgtatcaagattctcaatccgtatatgcccagcgttgtagaaacccttgagcagatgcagagaaagcacggcgggatgctggtgaggaacccattatcgcgaaattctactcatgagatgtactgggtcagttgcggaacaggcaacatcgtgtccgccgttaatatgaccagccggatgctgttgaaccgttttacgatggctcacagaaaacctacctatgaacgcgatgtggacctcggtgccgggacaaggcacgtcgcagtggagcccgaagtagccaacctggatattatcggacagcggattgagaatatcaagcatgaacacaaatcaacttggcattacgacgaggataacccttataagacctgggcttaccacggctcctatgaggtgaaaccatctggcagcgcgagttccatggttaatggggtcgtgaagctacttacaaagccctgggacgtgatacctatggtcactcaaattgccatgaccgatacaaccccattcggacagcagagagtttttaaagaaaaggtggacactcgcacgcccaaagcaaagaggggtacagctcaaatcatggaggtaaccgccaaatggctgtggggcttcctcagccgaaacaagaagccgcggatctgtactagagaagagtttaccaggaaagtgcgctctaatgcagccattggggctgtcttcgtggacgaaaaccagtggaactcagccaaggaggcggttgaggatgaacgtttttgggacctggtgcatcgggagagagaattgcacaaacagggaaagtgcgcaacatgcgtctacaacatgatgggcaaaagggagaagaagctgggtgagttcgggaaagccaagggaagtcgcgctatatggtacatgtggctcggcgcccgatttcttgagttcgaggcactgggcttcatgaatgaagatcactggttttcccgggagaacagcttatctggggtggaaggagagggtctgcataaattgggctatatcctcagagacatttcgaagatccctgggggaaatatgtacgctgatgacacggccggctgggataccaggattactgaggacgatctgcagaacgaagctcgcatcacagacataatggagccagaacacgccctacttgcaaaatcaatcttcaagctgacctatcaaaataaagtagttagagtgcagcggcccgcgaagaacggtactgtcatggatgtgattagcaggcgtgaccagcgagggtccggacaggtgggcacatacggcctcaatacctttacaaacatggaggcccaactgatccgccagatggaaagtgaggggattttctctcctagcgagttggaaactccaaacttagctgagagagtcctggattggctcgaaaagtatggagttgagcggcttaaaaggatggccatctccggtgacgactgtgtggtaaagcccatagatgaccgctttgcaaccgctctgacggccctaaatgatatgggcaaagtgagaaaggacattccgcagtgggaaccttcaaaagggtggaacgattggcagcaagtccccttctgcagtcatcactttcaccagctgatcatgaaggacggacgggagatcgtggttccatgtaggaatcaggatgagctcgtgggccgagcacgtgtctctcagggtgccgggtggagcttgagagaaaccgcgtgcctgggaaagtcctacgctcaaatgtggcagcttatgtatttccatcgccgggacctgaggctcgccgcaaacgccatttgttcagctgtgcctgtagattggatacccacaagcagaactacctggtctatccacgcccatcaccagtggatgacaactgaggacatgttatccgtttggaatcgcgtgtggattgaagagaacccatggatggaagataaaacccatatcagtagctggggcgacgtcccctacctgggcaagcgggaggaccaatggtgcgggtcgttgattggactgacggcaagggctacatgggccaccaatatccaggtggcgataaaccaggttcgaagactcatcggtaatgagaactaccttgattatatgacttccatgaaacggtttaagaatgaatctgaccctgagggcgctctgtggtga

SEQ ID NO: 13657 - RNA, 9879 nt, synthetic construct
  misc_feature 1..9879: note = derived and/or modified CDS sequence (opt3) from DENV-1__FJ410220__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagctgtgtgaagatactatgacctacaaatgcccacggataacagaggcggaaccggacgatgtggactgttggtgcaatgctaccgatacttgggtaacatatgggacctgtagtcaaacgggagagcaccgccgagagaagcgtagcgtggcccttgcaccccatgtcggcctgggtttggaaactagaaccgagacatggatgtcctctgaaggggcctggaaacagatccagagggtggagacttgggctctccggcaccctggattcaccgttattgcactgtttctggcccatgctatcggcacatcgattacccagaagggcatcgtgttcatactcttaatgctggtcacgccatcaatggccatgcgctgcgtggggatcggaagcagagactttgtagagggtcttagtggcgcgacttgggttgatgtggtcttggaacacgggtcctgtgtgacaaccatggcaaaggacaaacccactctggatattgagctactcaagacagaagtgaccaaccctgccgtcctgaggaaactttgcatcgaggctaagatttctaatacgaccacagacagccggtgtccaactcaaggagaagccaccctggttgaggagcaggatgcaaacttcgtgtgccgccgaacatttgtagacagaggctggggtaatgggtgtggattgttcggcaaaggctccctcctgacttgcgctaagtttaagtgcgtgaccaaattagaagggaagatcgtccagtacgagaacctgaaatattcagtgatagttacagtgcacaccggagatcagcatcaagtcggtaatgaaagtactgagcacggcacgacagccaccattactccccaggcgcctaccacagaaatccagctcaccgactacggggcccttactctggactgtagcccaaggacaggattggatttcaacgagatggtgctactgacgatgaaggagaaatcttggctcgtacataagcagtggtttctggaccttccgctgccctggacctccggcgcatcaactagccaagaaacatggaatcggcaggatttgctcgttaccttcaaaacagctcacgccaagaagcaggaggtggtcgtgctgggtagtcaagaaggggctatgcacactgccttaaccggcgcaacggagattcagacctctggaacaactaccatctttgccggccatctgaaatgccgtctaaagatggacaaactcacactgaaggggatgtcctatgtcatgtgtactggaagcttcaaacttgaaaaggaggtggctgagacccagcacggtacggttttggtgcagatcaagtacgaaggcacagatgcgccttgcaaaattccattctcgacccaagacgagaagggggtaactcagaacggacgcctgataacagcaaatcccatcgtcaccgataaagaaaagcctgtgaacattgaggccgagccaccctttggcgaatcttatatcgttataggtgctggggagaaagccctcaagctgtcctggttcaagaaaggctcaagtattggaaagatgtttgaagcaactgccagaggcgctaggcggatggccatccttggggacaccgcatgggatttcggaagcatcggtggcgtgtttacatccgtcgggaaactggtgcatcagattttcggaacggcgtacggcgtattgttttctggtgtgagctggaccatgaagatcgggattggcgttctcctgacttggttaggactgaattcacgaagtacatccctaagcatgacctgtatagctgtcggcctcgtgacactgtaccttggggtgatggtccaggccgactctggatgcgttatcaactggaaaggccgcgagttgaagtgtggttcagggattttcgtgactaatgaagtgcacacctggacggagcaatataagtttcaggcagatagtccgaaaagactgagcgccgctatcggaaaggcctgggaggaaggcgtatgcggtatcaggtccgcaacacggctcgagaacattatgtggaaacagatatctaacgaactgaatcatatcttactggagaacgacatgaagttcaccgtcgtggttggcgacgtggctgggattcttgtccagggaaaaaagatgatccgccctcaacccatggaatacaaatattcgtggaagagctggggcaaggccaaaattatcggggcggatgtgcagaattccacttttataatcgacggaccaaacacccctgagtgtcccgatgaccagagagcctggaatatttgggaggttgaagattacggcttcggtatctttacaactaacatttggttgaagctcagggactcatatacccaggtgtgcgatcaccgtctgatgagtgctgcaatcaaagactctaaggccgtacacgctgatatggggtactggatagagagcgaaaaaaatgagacatggaagctagcccgggcatccttcattgaagtcaagacgtgtatctggccaaaatcacataccctgtggagcaacggagtgctcgagtctgagatgattatccccaagatacacggcggtcctatctcccaacataattatcgaccaggctacttcactcagacagcggggccgtggcacctgggaaaacttgaattggactttgatctgtgcgagggcaccactgtggtcgttgacgaacactgcgggaacagaggacccagtttaaggacaaccacggtgactggcaagattatccatgagtggtgttgccgcagctgtaccctccctccactgcggttcagaggtgaggatgggtgctggtacggaatggaaattaggcccgtaaaagagaaggaagagaatcttgtgaagtctatggtctccgccggctcaggtgaagtggacagttttagcctgggcttgctctgtatctcgataatgattgaggaggttatgcgctcccgatggtctcggaaaatgctgatgacagggaccctagctgtgttctttctgctcatcatgggacagctgacttggaacgaccttatccgtttgtgcattatggtcggcgccaatgcaagcgatagaatggggatgggaacaacctatctggctttaatggccacattcaagatgaggcctatgtttgcagtgggcctcctgttccgccggcttacttcaagagaagttctgctactcaccatcggtctgagtttggtggcctccgtcgagctgccaaactctttagaagagctcggggacggactggctatgggcattatgatacttaaactgttgacggattttcaaagctaccagctctgggcgacactgctatccctgaccttcatcaagactaccttttcacttcactatgcctggaaaacaatggcaatggtactcagcattgtgagtctgttccccttgtgtctgtctactacctcccagaagacgacatggttaccggttctcctgggcagccttgggtgcaagcctctgaccatgtttttgatcgctgaaaataaaatttggggaaggaagtcgtggccactcaacgagggtatcatggccgtgggcatagtctcaatcctgctatctagtctgcttaaaaacgacgtgcccctcgccgggcctctgattgctggaggcatgttgatcgcatgttacgtaatttccggtagctctgccgatttaagcctggagaaggcggctgaagtgtcctgggaggaagaggccgaacattcaggggcaagtcacaatatcctcgtcgaggttcaggacgatggaactatgaaaataaaggacgaggaacgagatgacacactgaccattcttctgaaagccactttgctagctgtgagcggcgtgtatcccctgtctatcccagcaacactcttcgtctggcatttctggcaaaagaagaaacagcgctccggcgtgctgtgggataccccttcacccccagaggttgaacgggccgtacttgacgatgggatctacagaattatgcagaggggattactgggtcgtagtcaggtgggcgtcggggtgtttcaagagaacgttttccacacgatgtggcacgtgactcgcggagcggtcctcatgtatcagggcaagcggttggagccgagctgggcttccgtgaaaaaggacctgatatcttacggtgggggatggagatttcagggctcgtggaataccggcgaagaggtacaggtcatcgccgtggaacctgggaaaaaccccaagaatgttcaaacagcaccaggaaccttcaagacacccgagggtgaagtgggcgccattgctctcgactttaaacctgggactagcggatcaccaatcgtcaacagggagggcaagattgtgggtctgtacgggaatggagttgtgaccacgtccggcacatatgtcagtgccatcgcacaggctaaagcctctcaggagggcccccttcctgaaatagaggatgaagtgttccgaaagcggaacctgactatcatggacttgcatccggggagcggaaaaacccgcagatacctaccagcgattgtaagggaggccatcaagcggaagctgcgaacactcattttagcacccaccagagtggttgcttccgaaatggccgaggctctgaaaggtatgcctatccgctatcaaactaccgcagtcaagtcagagcacacaggcaaagaaatagtggatcttatgtgccatgccacgtttactatgaggctgctctctccagtgcgtgtccccaattacaacatgattatcatggacgaggcccacttcaccgatcctagcagtatcgctgcgcgggggtatatttccacaagagtaggaatgggcgaagcagccgctatctttatgaccgccactccgcccggtagcatggaggcattcccacagtctaatgccgtgatacaggacgaagagagggatattcctgagcgctcatggaactccgggtacgaatggatcacagactttcccggaaagaccgtttggttcgtgccaagtattaaagctggcaatgatatcgcgaactgtttgcgaaagaatggcaagagagtcatacagctgagccggaaaacgttcgacactgagtatcaaaagacaaaaaacaacgattgggactacgtggttaccaccgacatttcggaaatgggggccaattttagggcagatcgcgtgatcgaccctcgtagatgcctcaagcccgtcatcctgaaagatggaccagagcgggtgattcttgctggtccgatgcctgtaactgtggcctctgcagcccagaggcgcggccgaatcgggagaaaccataataaggagggagaccagtacatttatatgggccagcccctaaacaatgatgaagaccacgctcactggacagaggccaagatgctgttggataacataaataccccagaaggtatcattcccgcgttattcgagcctgaacgggagaaatccgcagccatcgacggggagtacaggctgcgcggcgaagctagaaagacatttgttgagctcatgaggcggggagatctgccagtctggcttagctataaagtggcctcagaaggcttccaatacagtgaccgtcgctggtgctttgatggggagcgaaacaatcaggtgctggaagagaacatggacgtcgagatctggactaaggaaggagagagaaaaaagctcaggccccggtggttggatgctcgcacgtattctgaccctctggcactaagagaattcaaagagtttgccgctggtaggcggtccgttagcggcgacctgattctcgaaatagggaagcttccgcagcatctgacccagcgagcccaaaatgcattagataacttggtgatgctgcacaattcagagcagggaggcagagcgtaccgccatgccatggaggaactcccagacacaatcgagactctgatgcttctggctctcattgccgtattgaccggtggggtgacactgttctttttaagtggcaagggactaggcaaaaccagcatcgggctgctctgtgtcatggcatcctctgtgcttctgtggatggctagcgttgaaccccactggattgccgcatccatcatattggagttctttctgatggtgctcctgatccctgagcccgataggcagcggactccacaggacaaccaacttgcctatgtcgtaattggactcctgttcatgatcttgacggtggctgcgaatgaaatgggtctgttagagaccacaaagaaagatctaggcattgggcacgttgccgtggaaaaccatcaccatgcagctatgctggacgtcgatctccaccctgcctcagcctggactctttacgcagtggctaccacaatcataacccccatgatgcgtcatactattgagaacacaacggccaatatctctctgaccgcgattgctaaccaggccgcaatcttgatgggactggacaagggctggccaataagtaaaatggatatcggtgtccctctcctggcccttgggtgctactcgcaggtgaatccgttaactctgacagctgcagttctcatgttggtggcccactatgcgattatcggccccggactgcaagctaaggccaccagagaagcacagaagaggaccgccgctggcattatgaaaaacccaacaatcgacgggatagtagccattgatctagaccctgtggtctacgatgcaaagtttgagaaacagctgggacagatcatgctccttatcctgtgtactagccaaattttgctgatgcgcacgacctgggctctctgcgagtccatcacactggccactggccccttaaccacactttgggaaggttctccagggaagttctggaataccactatagcggtttcaatggccaacattttccggggaagctatctggcaggcgctggtctcgccttttccctaatgaaaagtctgggcgggggacgaagaggcacgggggcacagggagagacattgggcgaaaagtggaagaggcagctgaatcagctctctaaaagcgagttcaacacctacaagcgctcaggtatcatggaagtggaccggtccgaggctaaagaggggcttaagagaggagaaactaccaaacacgccgtcagtcgtggcacagccaagctgaggtggtttgtggagcggaatttggtaaagcctgaaggtaaagtgattgacctgggctgtgggcgcggaggctggagctattactgcgcggggctcaagaaagttactgaggtgaagggatataccaaaggcggtcccgggcatgaagagccgatcccaatggctacatacggatggaacttagtcaagctgcactctggcaaagatgtgttctttatacctcccgagaagtgtgacacgcttctgtgcgatatcggcgaatcctcaccaaatcccaccattgaggaagggcgaactctaagagtcctcaagatggtggagccttggctgaggggaaaccaattctgtatcaaaattttgaatccgtacatgcccagcgttgtagagacactggaacagatgcagcggaagcatggtggcatgctcgtgcgcaacccactttcgagaaattctacccacgagatgtattgggtcagttgcgggactggaaacatcgtgtccgcagttaatatgacaagcaggatgctgttaaaccgatttaccatggcccaccggaaacctacgtacgaacgtgacgtggatctgggcgctggtaccagacatgtcgccgtggagcccgaagtagcaaacttggacattatcgggcagcgcatagagaatattaagcacgagcataaatcaacatggcactatgatgaagacaacccttacaagacttgggcctatcatggatcctacgaggtgaagccatctggcagcgctagttccatggttaatggcgtcgtgaaactcctgaccaagccctgggatgtgatccctatggtcacacaaatcgcgatgactgacaccacaccattcgggcagcagagggtttttaaagaaaaggtggatacccggactcccaaagccaagagaggaacggcacaaattatggaggtaacagctcgctggctatggggtttccttagcaggaacaagaaaccgcgaatatgtacccgggaagagtttactagaaaggtgaggtctaatgccgcaatcggcgccgtcttcgtggacgagaaccagtggaattcagctaaagaagccgttgaggacgatcgcttttgggacctggtgcaccgtgaacgggagctccacaagcaggggaaatgcgcgacctgcgtctataacatgatgggaaagagagaaaagaaactgggcgagttcggtaaggcaaaagggagtagggccatttggtacatgtggttgggagctcgcttcctggagtttgaagccctcggcttcatgaatgaggatcattggttttcccgagaaaacagcctttctggcgtggagggggagggactgcacaagttaggttacatcctgcgggacatttcgaaaatccctggcgggaatatgtatgcagatgacacagctggatgggatacgagaataaccgaagacgatttgcagaacgaggccaagatcactgacattatggaaccagagcatgctctcctggccaaatcaatcttcaagctaacataccaaaataaggtagttagggtgcagcgccccgcaaaaaacggcaccgtcatggatgtgattagcagacgggaccagaggggttccgggcaggtgggaacttatggccttaatacatttaccaacatggaagcgcaactgatccgtcagatggagagtgagggcatattcctccctaacgaactggagacaccaaatttggccgggcgagtcttagattggctggaaaagtacggagttgagcgcctcaaaagaatggctatttctggtgacgactgtgtggtaaagcccatcgatgaccggtttgccactgcacttaccgctctgaacgatatgggcaaagtgaggaaggacatcccgcagtgggaacctagcaaggggtggaatgattggcagcaagtccccttctgctcccaccactttcatcagctaattatgaaagacggacgcgagatagtggttccatgtagaaaccaggatgagctggtgggccgggccagggtctcacagggtgcagggtggagtctccgagaaacggcctgcttgggaaagtcttatgcgcaaatgtggcagctgatgtacttccaccgtagagaccttcgcctggctgccaatgcaatctgtagcgccgtgcctgtagattgggttcccacctcccggacaacttggtcaattcatgctcaccatcagtggatgaccacagaggacatgctcagcgtgtggaacagggtctggatcgaagagaatccatggatggaagataaaactagaatttcttcctgggaggacgtgccctatttaggcaagcgcgaggaccaatggtgcggcagtctgatcgggttgaccgcccgggcaacgtgggctacaaacatacaggttgccatcaatcaggtgaggcgactgattggaaacgaaaattacagcgattacatgacctcgatgaaaagatttaagaacgagtccgaacctgagggtgcgctctggtga

SEQ ID NO: 13658 - RNA, 9879 nt, synthetic construct
  misc_feature 1..9879: note = derived and/or modified CDS sequence (opt3) from DENV-1__JF937649__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagctgtgtgaagatactatgacctacaaatgcccacggataacagaggtggaaccggacgatgtagactgttggtgcaataccactgatacatgggtgacctatgggacgtgtagtcaaactggagagcaccgccgagacaagcgtagcgtcgcgcttgctccccatgtgggcctgggtttggagaccagagccgaaacatggatgtcctctgagggggcatggaaacagatccagaaggttgaaacttgggccctcaggcaccctggattcaccgtgattgctctgtttctggcacatgccatcggcacatcgattacccagaagggcatcatattcatcctcttaatgctggtcacgccatcaatggctatgcggtgcgtggggattggaagccgcgattttgtagagggtcttagtggcgccacttgggttgacgtggtcttggagcacgggtcctgtgtgacaaccatggcgaaagataagcccactctggacatcgaactactcaaaacagaggtgaccaaccctgcagtcctgagaaagctttgcattgaagccaaaatctctaatacgaccacagatagcaggtgtccaactcaaggagaggctaccctggttgaagagcaggacgccaacttcgtgtgccggcgcacatttgtagatcgaggctggggtaatgggtgtggattgttcggcaagggctccctcataacttgcgcaaagtttaaatgcgtgaccaagctggaggggaaaattgtccagtacgaaaacttaaagtattcagtgatcgttacagtgcacaccggagaccagcatcaagtcggtaatgagagtactgaacacggcacgacagctaccattactccccaggcccctaccagcgagatccagctgacagactacggggcgctcacccttgattgttctccaagaactggactggacttcaacgaaatggtgttgctaacaatgaaagagaagtcctggctggtacataaacagtggtttctcgatctgccgcttccctggacgtcaggcgccagcaccagtcaagagacttggaataggcaggacctgttggttacattcaagaccgcacacgctaagaaacaggaagtggtcgtgctcggttctcaagagggggccatgcacacagctctgactggcgccaccgaaatccagacgtccggaaccacaactatttttgcaggccatttaaagtgccggctgaaaatggataagctaaccctcaaagggatgagctatgtcatgtgtacaggatcgttcaagctggagaaggaagtggccgagactcagcacggtaccgttcttgtgcagataaaatacgagggcacggacgctccttgcaagatcccattctctacacaagatgaaaaaggggtaacccagaacggacgtttgattactgcgaatcccatcgtcacagacaaggagaaacctgtgaacatagaagcagagccaccctttggcgagtcctatattgttatcggtgccggggaaaaggctctgaagctctcatggttcaaaaagggcagtagcatcggaaaaatgtttgaggccaccgcacgcggcgccagaaggatggctattctgggggatactgcctgggacttcggatccatcggtggcgtgtttacctctgtcgggaagcttgtgcatcagattttcggaacagcatacggcgtactgtttagcggtgtgtcatggacgatgaaaatagggatcggcgttttgctcacctggctgggattaaatagtcggtccactagcctgtctatgacatgtattgcggtcggcctagtgaccctctacctgggggtgatggtccaggctgattcaggatgcgttatcaactggaagggccgagaacttaagtgtggtagtgggatcttcgtgacaaatgaggtgcacacttggaccgaacaatataaatttcaggccgacagcccgaagcgcttgtccgcagccattggaaaagcttgggaggagggcgtatgcggtataagatctgccacgaggctggaaaacatcatgtggcggcagatttcgaacgagctcaatcatatcctgttagaaaacgacatgaagttcacagtcgtggttggcgatgtggtcgggattctggcacagggaaaaaagatgatccgccctcaacccatggagcacaaatacagctggaagtcctggggcaaggctaaaataatcggggccgacgtgcagaataccacttttattatcgatggaccaaacacccctgaatgtcccgacgatcagagagcgtggaatatttgggaggttgaggactatggcttcggtatctttacaactaacatatggcttaagttgagggattcatacacccaggtgtgcgaccaccgtctcatgagtgccgctattaaagattctaaggcagtacatgccgacatggggtattggatcgaaagcgagaaaaatgaaacatggaagctggctcgggcctccttcattgaggtcaagacgtgtatctggccaaaatcacacaccctatggagcaacggagtgctggaatctgagatgataatccccaagatttacggcggtcctatctcccaacataattatcgaccaggctacttcactcagacagcagggccgtggcacctcggaaaactggagcttgattttgacttgtgcgaaggcaccactgtggtcgttgatgagcactgcgggaacagaggacccagtctgaggacaaccacggtgactggcaagattatccatgaatggtgttgccgcagctgtaccttacctccactccggttcaaaggtgaggacgggtgctggtacggaatggagataagacccgtaaaggaaaaggaggaaaatctggtgaaatctatggtctccgcgggctcaggtgaggtggacagttttagccttggcctgttgtgtatttcgatcatgatcgaagaggttatgaggtcccgctggtctcgaaagatgctcatgacagggaccctggccgtgttctttctactgattatgggacagctcacttggaacgatctgatccggagctgcattatggtcggcgctaatgcctcagaccgtatggggatgggaacaacctatcttgcattgatggctacattcaaaatgagacctatgtttgccgtgggcctgttattcaggcgcctcactagtcgggaggttctgcttctgaccataggtctatccctcgtggcatctgtcgaactgccaaacagcttggaggaactgggggatggattagccatgggcatcatgattctcaagctgcttacggactttcaatcctaccagctgtgggctacattgctctcactgaccttcatcaaaactacctttagcctacactatgcgtggaagacaatggccatggtactgagtattgtgtctcttctccccctgtgtttgtccactaccagccagaagacgacatggctgccggttttactcggctcgctggggtgcaaacctcttaccatgttcctgatcgcagagaataagatatggggaagaaaatcatggccattgaacgaaggtatcatggctgtgggcattgtctctatcctcctgagttccctactgaagaacgatgtgccccttgccgggcctctcattgccggaggcatgctgatcgcttgttacgtaataagcggttctagcgcagacttgtccttagagaaagccgcggaggtgtcatgggaagaggaagctgagcatagtggggccagccacaatattctggtcgaagttcaggatgacggaactatgaagatcaaagatgaggagagggacgatacactcaccatcctgcttaaggcaactctgttggccgtgtctggcgtgtatcccctatccattccagctacactgtttgtctggtacttctggcaaaagaaaaagcagcgatcaggcgtgctctgggacacccctagtcccccagaagttgagcgcgcagtactggatgacgggatatatcggatcatgcagagaggacttttaggtaggagccaggtgggcgtcggggtgttccaagaaaacgtttttcatacgatgtggcacgtgactcgtggagccgtcctgatgtaccagggcaaacgcctcgagccgtcctgggcgtctgtgaagaaagacttgatttcgtacggtgggggatggcggctgcagggcagctggaataccggcgaggaagtacaggtcatcgctgtggagcctgggaagaaccccaagaatgttcaaacagccccaggaaccttcaaaacacccgaaggtgaggtgggcgcaattgccctcgattttaagcctgggacttcaggatccccaatcgtcaacagagaaggcaaaatagtgggtctgtatgggaatggagttgtgaccacgagtggcacatacgtctctgctatcgcccaggcaaaggctagccaggagggcccccttcctgagattgaagacgaggtgttcaggaaacgaaacctgactatcatggatttgcacccggggtccggaaagacccggcgctatctaccagccattgtaagagaagcgatcaagaggaaactgcggacactcatattagcccccacccgagtggttgcatcagagatggctgaagccctgaagggtatgcctattagataccaaactaccgctgtcaaatctgagcatacaggccgcgagatcgtggaccttatgtgccacgcaacgtttactatgaggctgctcagcccagtgcgtgtccccaattataacatgatcattatggatgaagcccatttcaccgaccctagttccatcgccgctcgggggtacataagcacaagagtaggaatgggcgaggcggcagccatttttatgaccgctactccgcccggttctgtggaagccttcccacagtcaaatgcagttatccaggatgaggaaagggacattcctgagcgctcctggaacagtgggtatgagtggatcacagattttcccggaaagaccgtgtggttcgtcccaagcataaaatcgggcaatgacattgccaactgtttgcgaaagaatggcaagagagtgatccagctgtctcggaaaacgtttgatactgaataccaaaagacaaaaaacaacgactgggactacgttgtgaccaccgatatctccgagatgggggctaatttcagggcggaccgcgtcattgatcctcgtagatgcctcaagcccgtgatcctgaaagacggaccagaacgggtaattcttgccggtccgatgcctgtgactgttgcaagcgctgcccagaggcgcggccgaatagggagaaaccacaataaggagggagatcagtatatctacatgggccagcccctaaacaatgacgaggatcatgcacactggacagaagccaagatgctgttggacaacattaataccccagagggtatcatccccgctttattcgaacctgagcgggaaaaatcagccgcgattgatggggagtataggctgcgcggcgaggcaagaaagacatttgtcgaactcatgaggcggggagacctgccagtgtggcttagttacaaagtggcctctgagggcttccaatattccgatcgtcgctggtgctttgacggggaacgaaacaatcaggtcctggaggaaaacatggatgttgagatatggactaaggagggagaaagaaaaaagctcaggccccggtggttggacgctcgcacgtacagcgaccctctggccctaagagagttcaaagaatttgctgcaggtaggcggtcagtgagtggcgatctgatcctcgagattgggaagcttccgcagcacctgacccagcgagcccaaaatgctttagacaacttggtaatgctgcataatagcgaacagggaggcagagcctatcgccacgcaatggaggagctcccagatacaatcgaaactctgatgcttctggcgctcattgccgtgttgaccggtggggtcacactgttctttttatccggcaagggactaggcaaaacctctatcgggctgctctgtgtgatggctagctccgcccttctgtggatggcatcagttgagccccattggatagctgcctctatcattttggaattctttctgatggtgctcctgatccctgagcccgacaggcagcggactccacaggataaccaacttgcatacgtcgtaattggactcctgttcatgatcttgacggtggccgctaatgagatgggtctgttagaaaccacaaagaaagacctaggcatagggcacgttgcggtggagaaccaccatcacgccactatgctggatgtcgacctccatcctgcaagtgcttggaccctttacgccgtggccacaaccattatcactcccatgatgcgtcacacaattgaaaacacgaccgcaaatatctcgctgactgctatagccaaccaggcggctatcttgatgggactggataagggctggccaattagcaaaatggacatcggtgtccctctcctggcccttgggtgctattcccaggtgaatccgttaacactgaccgcagccgttctcatgttggtggctcattacgcaattatcggccccggactgcaagccaaggcgaccagagaggctcagaagaggacagccgcaggcataatgaaaaacccaactgtagatgggattgtggccatcgacctagatcctgtcgtttatgacgctaagtttgaaaaacagctgggacagatcatgctccttattctgtgtacgtctcaaatcttgctgatgcgcaccacatgggccctctgcgagtcaataactctggcaaccggccccttaacaaccctttgggagggtagcccagggaagttctggaatactacgattgctgtgtccatggccaacatctttcggggaagttacctggcgggcgccggtctcgcattctctctaatgaaaagcctgggcgggggacgaagaggcacaggggctcagggagaaaccttgggcgagaagtggaagaggcagctgaatcagctctcaaaatccgaattcaacacttataagcgcagtggtattatggaggtcgaccggagcgaagccaaagaggggcttagacgtggagagaccacaaagcacgcagtgtctaggggcactgctaaactgcggtggtttgtagaacgcaatttggtgaagcctgagggtaaggttatcgatctgggctgtgggcgaggaggctggtcctactattgcgccgggctcaaaaaggtgaccgaagtcaaaggatacacaaagggcggtcccgggcacgaggaaccgataccaatggccacgtacggatggaacttagtgaaactgcattcaggcaaggacgtcttctttatccctcccgagaaatgtgatacccttctgtgcgacattggcgagagctcgccaaatcccactatcgaagaggggagaacactaagggtgctcaagatggttgaaccttggctgcggggaaaccaattctgtattaagatcttgaatccgtatatgccctctgtagtggagaccctggagcagatgcagcgcaaacacggtggcatgctcgtcagaaacccacttagtaggaattccactcatgaaatgtactgggtgagctgcgggacaggaaacattgtttcagcggtgaatatgacctcccgaatgctgttaaaccggtttacgatggctcaccgtaagcctacctatgagagagatgtcgacctgggcgcaggtacacgccacgtggccgtagaacccgaggtggctaacttggatatcatagggcagaggattgaaaatatcaaacatgagcacaagtctacttggcattacgacgaggataacccttataaaacctgggcctaccacggaagctatgaagttaagccaagtggctccgcaagctctatggtcaatggcgtggtgaagctcctgacaaaaccctgggacgtcatccctatggttactcaaattgccatgaccgatacaaccccattcgggcagcagcgggtgtttaaggagaaagtagacactagaacgcccaaggctaaacgcggaacagcgcaaataatggaagtgaccgccaggtggctatggggtttcctttcacgaaacaagaagccgcggatctgtactagagaggaatttaccaggaaagtccgcagtaatgcagctattggcgccgtgttcgttgacgagaaccagtggaattccgcaaaggaggccgtggaagatgagcgtttttgggacctggtccatcgggaaagagagctccacaaacaggggaagtgcgctacatgcgtgtacaacatgatgggaaaaagggaaaagaagctgggcgagttcggtaaagccaaggggagccgcgcgatctggtacatgtggttgggagcacgatttctggagttcgaagccctcggcttcatgaatgaggatcactggttttctcgggaaaactcgctttcaggcgtagagggggagggactgcataaattaggttatattctgagagacatcagcaagatacctggcgggaatatgtacgctgatgacacggccggatgggataccaggatcactgaagacgatttgcagaacgaggcaaaaattacagacatcatggaaccagagcacgctctcctggccacctccattttcaagctaacttatcaaaataaagttgtgcgcgtccagagacccgctcggaacggcacagtgatggatgtgatcagtaggcgtgaccagcgaggttctgggcaggtcggaacctacggccttaatacatttactaacatggaagcccaactgatacgccagatggagagcgagggcattttctccccttcagaactcgagaccccaaacctggcagaaagagttttggattggttagagaagcatggggtggaacggctgaagaggatggcgatcagtggagacgactgtgtagtgaaacccatcgatgaccgctttgccacggctctctctgcccttaatgatatgggtaaggtcagaaaagacattccgcagtgggagcctagcaagggctggaacgattggcagcaagtgcccttctgctcccaccactttcatcagctgataatgaaagacgggcgggagatcgttgtgccatgtaggaatcaggatgaactagtcggacgagcacgtgtgtcacagggcgctggttggagcctgagagagaccgcctgcctcgggaagtcttatgcacaaatgtggcagttgatgtacttccaccgccgggacctgaggcttgccgcgaacgctatttgttccgccgtacctgttgattgggtgcccacaagtagaactacctggagcatccatgcacaccatcagtggatgacaactgaagacatgctgtcggtctggaatcgcgtgtggattgaggaaaacccatggatggaggataagacccacatctcctcttggggagacgttccctatctcggcaaacgggaggaccaatggtgcggctcattaatagggctgacggccagggctacatgggccaccaatatccaggtggcaattaaccaggtccgaagattgatcggaaatgaaaactacctggattacatgactagcatgaagcggtttaaaaatgagagtgaccctgaaggtgctctctggtga

SEQ ID NO: 13659 - RNA, 9879 nt, synthetic construct
  misc_feature 1..9879: note = derived and/or modified CDS sequence (opt3) from DENV-1__FJ410222__SS-prME
  source 1..9879: mol_type = other RNA
agcgtgaccatgctgctcatgcttatgcccacagccctggctttccacttgactacgagaggaggggaacctcatatgatcgtctccaagcaggaaagaggaaaatctttactgtttaagacctcagccggtgttaatatgtgcacactgattgccatggacctcggcgagctgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccgggtcgttcaaactggagaaggaacttgccgagacgcagcacggtacagtcttggtgcagataaagtacgagggcaccgacgctccttgcaaaatcccattctcgactcaagatgaaaagggggttacacagaacggacgcctgattaccgcgaatcccatcgtgactgacaaagagaagcctgtaaacatagaagcagagccaccctttggcgagtcttatattgtcatcggtgccggggaaaaagctctcaagctgtcctggttcaagaaaggctcaagtatcggaaagatgtttgaggccaccgcaagaggcgccaggcggatggctattcttggggatacagcctgggacttcggaagcatcggtggcgtgtttacgtccgttgggaaactggtgcatcagattttcggaaccgcatacggcgtcttgttttctggtgtgagctggactatgaagatagggatcggcgtactcctgacatggttaggactaaattcacgaagtacctccctaagcatgacatgtattgcggtgggcctcgttactctgtaccttggggtcatggtgcaggctgattctggatgcgtgatcaactggaaaggccgcgaattgaagtgtggttcagggatcttcgtcaccaatgaggttcacacgtggacagaacaatataagtttcaggccgacagtccgaaaagactgagcgcagccattggaaaggcttgggaggagggcgtgtgcggtataaggtccgccacccggctcgaaaacatcatgtggaaacagatttctaacgagctgaatcatatcttactggaaaacgacatgaagttcactgtggtagtcggcgatgtggcagggattcttgctcagggcaaaaagatgatccgccctcaacccatggagtacaaatattcgtggaaaagctggggcaaggccaagataatcggggcggacgttcagaataccacatttattatcgatggaccaaacactcctgaatgtcccgacgatcagagagcctggaatatttgggaggtggaggactacggcttcggtatctttaccacaaacatatggttgaagctcagggattcctatacgcaggtctgcgaccaccgtctgatgtcagctgcaattaaagatagtaaggccgtgcacgctgacatggggtactggatcgaatctgagaaaaatgaaacctggaagctagcccgggcatccttcattgaggttaagacttgtatctggccaaaatcccatacactgtggtcaaacggagtgctcgaaagcgagatgataatccccaagatttatggcggtcctatctctcaacacaattaccgaccaggctacttcacccagactgcggggccgtggcatctgggaaaacttgagttggattttgacctgtgcgaaggcacaaccgtagtcgtggatgagcactgcgggaacagaggaccctccttaaggacgactaccgtgacaggcaagattatccacgaatggtgttgccgcagttgtaccctccctccactgcggttcagaggtgaggacgggtgctggtatggaatggagataaggcccgtcaaagaaaaggaggaaaatcttgttaagagcatggtgtctgccggctccggtgaggtagactcatttagtctgggcttgctctgtattagcatcatgatcgaagaggtgatgcgctcgcgatggtcccggaaaatgctgatgactgggacactagctgtcttctttctgctcattatgggacagctgacctggaacgatcttatccgtttgtgcattatggtgggcgccaatgcatctgacagaatggggatgggaacaacttacctggctttaatggccaccttcaagatgaggcctatgtttgcagttggcctcctgttccgccggcttacgagcagagaggtgctgctactcacaataggtctgtcattggtcgccagtgtggaactgccaaactccttagaggaactcggggatggactggctatgggcatcatgattcttaaactgttgaccgactttcaatctcatcagctctgggcgactctgctaagcctgaccttcatcaagacaactttttcccttcactatgcctggaaaaccatggcaatggttctctcaattgtgagcctgttgcccctgtgtttaagtacgacatctcagaagaccacttggctcccggtcctgcttggctccctggggtgcaagcctttgacaatgttcctcatcgctgagaataaaatatggggaaggcgaagctggccactgaacgaaggtatcatggccgtaggcattgtgtcgatcctactgtcatctcttctcaagaacgatgttcccctggccgggcctttgattgctggaggcatgttaatcgcatgttacgtgataagtggttccagcgccgacctgtctctcgagaaagcggctgaggtcagctgggaagaggaagccgagcattccggggcatcacacaatattctggtggaagtacaggatgacggaaccatgaagatcaaagatgaggagcgcgacgatactcttacaatcctgttgaaggccaccctactggctgtgagtggcgtctatcccctcagcattccagcaacgctgtttgtttggtacttctggcagaaaaagaagcagcggtctggcgtgctttgggacactccttcacccccagaagtggagagagccgtcttagatgacgggatatataggatcatgcagcgtggactgctcggtcgcagccaggtgggcgttggggtattccaagaaaacgtgtttcataccatgtggcacgtcacacggggagcggtgttgatgtaccagggcaaaagactggagccgagttgggctagcgttaagaaagacctcatttcctacggtgggggatggaggctgcagggctcttggaataccggcgaggaagtgcaggtcatcgccgtggagcctgggaagaaccccaaaaatgtacaaacagcaccaggaactttcaagacccccgaaggtgaggtcggcgccattgctcttgattttaagcctgggacgtcgggaagcccaatcgtgaaccgagaaggcaaaatagttggtctgtatgggaatggagtggtcacaacttcaggcacctacgtgtccgccatcgcacaggctaaggccagtcaggagggccccttgcctgagattgaagacgaggttttccggaaacgcaacctaacaatcatggatctgcacccggggtctggaaagaccagaaggtatctcccagcgattgtgcgggaagccatcaaacgaaagttaagaactctgatacttgcacccacccgcgtcgtggctagcgagatggccgaagctctgaagggtatgcctattaggtaccaaacaacggcagtaaaatccgagcatactggcaaggagatcgtggacctcatgtgccacgccacctttacaatgcgtttgctgtcaccagttcgggtccccaattataacatgatcattatggatgaagcccatttcaccgacccttctagcatcgctgcgagagggtacataagtactagggtgggaatgggcgaggcagccgctatttttatgacagccaccccgcccggttccgtggaagcattcccacagagcaatgccgtcatccaggatgaggaacgcgacattcctgagcgatcttggaactcagggtatgagtggatcacggattttcccggaaaaactgtatggttcgtgccatccataaagagtggcaatgacattgctaactgtctcaggaaaaatggcaagcgggttatccagctgagcaggaagacatttgataccgaataccagaaaaccaagaacaacgactgggactacgtggtcactacagatatctcggagatgggggcgaatttccgcgccgaccgtgtgattgatcctagacggtgccttaaacccgttatcctaaaggacggaccagaaagggtgattctggcaggtccgatgcctgtcaccgtggcttctgccgcacagcgccgaggcagaatagggcggaaccacaataaagagggagatcagtatatctacatgggccagcccttgaacaatgacgaggatcatgcccactggacagaagctaagatgttactggacaacattaatactccagagggtatcatccccgccctcttcgaacctgagagggaaaagtccgcggcaattgatggggagtatcgcctgagaggcgaggccaggaaaacgtttgtagaacttatgcggcgtggagacctgccagtgtggctcagctacaaggttgcttcagagggcttccaatatagtgatcgccgatggtgctttgacggggaaagaaacaatcaggtcttggaggaaaacatggatgtggagatatggaccaaagagggagaaaggaagaaactgcggccccgctggctagacgccagaacatactctgaccctctggctctcagggagttcaaggaatttgcagccggtcggcgatccgtgagcggcgatcttatcctggagattgggaaattaccgcagcacttgactcagagagctcaaaatgccctggacaacctcgtcatgctgcataattcagaacagggaggccgcgcatataggcacgcgatggaggagcttccagataccatcgaaacactgatgctcttggccctgattgctgttttaaccggtggggtgactctattctttctgagtggccggggactcggcaagacgagcatcgggcttctgtgtgtaatggcctcctctgtgttgctgtggatggcaagcgtcgagccccattggatagctgcctccatcattctcgagttctttctgatggtgcttctcatccctgagcccgaccgtcagagaaccccacaggataaccaactggcatacgttgtgattggattgctgttcatgatcttaacagtcgccgctaatgagatgggtctactggaaactaccaagaaagacctcggcatagggcacgtagcggtggagaaccaccatcacgccgcaatgcttgatgttgacctgcatcctgcttcagcctggacattgtacgccgtggcaaccactattatcacacccatgatgaggcacacgattgaaaacaccactgctaatatctctctgacagccatagcgaaccaggctgccatcctcatgggactggataagggctggccaattagtaaaatggacatcggtgtccctcttttagcactggggtgctatagccaggtgaatccgctcaccttgaccgccgctgtcctgatgctagtggcacattacgccattatcggccccggactgcaagcgaaggctacacgcgaggcccagaaacggactgcagccggcataatgaagaacccaacggttgatgggattgtggctatcgacctcgatcctgtagtgtatgacgccaagtttgaaaaacagcttggacagatcatgctgttgattctgtgtaccagccaaatcctcctgatgcgaacaacttgggcattatgcgagtccataacccttgctacaggccccctgaccactctctgggagggttctccagggaagttctggaatacgacaattgccgtctcaatggcgaacatctttagaggaagctacctagccggcgcaggtctggctttctccttgatgaaaagtctgggcgggggaaggcgcggcaccggggcccagggagaaactctcggcgagaagtggaaacggcagcttaatcagctgtctaagagcgagttcaacacctataagagatcaggtattatggaggttgaccgttccgaagcaaaagaggggttgaagaggggagagacaactaaacacgctgtgagtcggggcaccgccaagctgcgctggtttgtcgaacgaaatctcgtgaaacctgagggtaaggtaatcgatttaggctgtgggagaggaggctggagctactattgcgccgggctgaagaaagtgacagaagttaagggatacacgaaaggcggtcccgggcacgaggaaccgataccaatggcgacctacggatggaaccttgtgaagctgcattctggcaaagacgtcttctttatccctcccgagaagtgtgatactctactctgcgacattggcgagtcctcaccaaatcccacaatcgaagaggggaggaccctgcgggtgttgaaaatggtcgaaccttggctgcgcggaaaccaattctgtattaagatcctcaatccgtatatgcccagcgtggttgagactcttgagcagatgcagagaaagcacggtggcatgctggtaaggaacccattatcgcgaaattctacacatgaaatgtactgggtgagttgcgggaccggaaacattgtctccgctgtgaatatgacgagccggatgctgttgaaccgttttaccatggcacacagaaaacctacatatgagcgcgatgttgacctcggcgccggtactaggcacgtggctgtcgaacccgaggtggccaacctggatatcatagggcagcggattgaaaatatcaagcatgagcacaaatcaacctggcattacgacgaggataacccttataagacatgggcataccacggatcctatgaagtaaaaccatctggcagcgccagttccatggtgaatggcgttgtcaagctacttactaagccctgggacgtgatccctatggtgacccaaattgctatgacagataccactccattcgggcagcagagagtctttaaagagaaggttgacacgcgcacacccaaagcgaagaggggaaccgcccaaataatggaagtgactgcaaaatggctgtggggtttcctcagccgaaacaagaagccgcggatctgtaccagagaggaatttacaaggaaagtacgctctaatgctgccattggcgcagtgttcgtcgacgagaaccagtggaactcagccaaggaggctgtggaagatgagcgtttttgggacctggttcatcgggaaagagagttgcacaaacaggggaagtgcgccacgtgcgtgtacaacatgatgggaaaaagggaaaagaagctgggcgagttcggtaaagcgaaggggagtcgcgcaatctggtacatgtggctcggagcccgatttcttgagttcgaagctctgggcttcatgaatgaggatcactggttttcccgggaaaacagcttatctggcgtcgagggggagggactgcataaattgggttatattctcagagacatctcgaagatacctggcgggaatatgtacgccgatgacaccgcaggatgggatactaggatcacagaagacgatctgcagaacgaggctcgcattaccgacatcatggaaccagagcacgccctacttgctaaatcaattttcaagctgacttatcaaaataaagtggtaagagttcagcggcccgccaagaacggcacagtgatggatgtcatcagcaggcgtgaccagcgaggttccggacaggtgggaacctacggcctcaatacatttactaacatggaagcacaactgatacgccagatggagagtgagggcattttctctcctagcgaattggagaccccaaacttagcgaagagagtgctggattggctcgaaaaatatggggtcgagcggcttaagaggatggccatctccggagacgactgtgttgtgaaacccatcgatgaccgctttgctacggccctgaccgcactaaatgatatgggtaaggtaagaaaagacattccgcagtgggaaccttcaaagggctggaacgattggcagcaagtgcccttctgcagtcatcactttcaccagctgataatgaaggacgggcgggagatcgtcgtgccatgtaggaatcaggatgagctcgttggacgagctcgtgtgtctcagggcgccggttggagcttgagagaaacagcatgcctggggaaatcctacgcccaaatgtggcagcttatgtatttccatcgccgggacctgaggctcgcggctaacgccatttgttcagcagtccctgtggattggatccccactagcagaaccacatggtctattcacgcccatcaccagtggatgactaccgaggacatgttatccgtatggaatcgcgtttggatcgaagagaacccatggatggaagataagacgcatataagtagctggggagacgtgccctacctgggcaaacgggaggaccaatggtgcggctcgttgatcgggctgacagctagggccacctgggcaactaatattcaggtcgctatcaaccaggtgcgaagactcattggaaatgagaactaccttgattatatgacatccatgaagcggtttaaaaatgaatctgaccctgagggtgccctgtggtga

SEQ ID NO: 13660 - RNA, 9879 nt, synthetic construct
  misc_feature 1..9879: note = derived and/or modified CDS sequence (opt3) from DENV-1__FJ461319__SS-prME
  source 1..9879: mol_type = other RNA
agcgtgaccatgctgctcatgcttatgcccacagccctggctttccacttgactacgagaggaggggagcctcatatggtcgtttccaagcaagaaagaggaaaatctttactgtttaagacctcagcgggtgtgaatatgtgcacactgatcgccatggacctcggcgagctgtgtgaagatactatgacctacaaatgcccacggattacagaggcggaaccggacgatgtagactgttggtgcaatgctaccgatacttgggtgacatatgggacctgtagtcaaacgggagagcaccgccgagacaagcgtagcgtcgcccttgctccccatgtgggcctgggtttggagactagaaccgaaacatggatgtcctctgagggggcctggaaacagatacagagggttgaaacttgggccctccggcaccctggattcaccgtgatcgcactgtttctggcccatgctattggcacatcgatcacccagaagggcattatcttcatactcttaatgctggtcacgccatcaatggccatgcgctgcgtggggatcggaagcagagattttgtagagggtcttagtggcgcgacttgggttgacgtggtcttggagcacgggtcctgtgtgacaaccatggcaaaggataaacccactctggacattgaactgctcaagacagaggtgaccaaccctgccatcctgaggaaactttgcattgaagctaagatctctaatacgaccacagatagccggtgtccaactcaaggagaggccaccctggtcgaagaacaagacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatgtgtactggtagcttcaaactggagaaggaagtcgctgagacccagcacggaacggtgcttgttcagataaagtacgagggcacagacgcgccttgcaaaatcccattctcgacccaagatgaaaagggggtgactcagaacggacgcttgattacagcaaatcccatcgtaaccgacaaagagaagcctgtcaacatagaagccgagccaccctttggcgagtcttatattgtgatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtttttacatccgtggggaaacttgtccatcagattttcggaacggcgtacggcgtgctgttttctggtgtaagctggaccatgaagatagggttgggcgtgctcctgacttggttaggactaaattcacgaagtacatccctaagcatgacctgtatcgctgttggcctcgtcacactgtaccttggggtgatggtgcaggccgattctggatgcgtcattaactggaaaggccgcgaattgaagtgtggttcagggatcttcgttactaatgaggtgcacacctggacggaacaatataagtttcaggcagacagtccgaaaagactgagcgccgctatcggaaaggcctgggaggagggcgtgtgcggtattaggtccgcaacacggctcgaaaacgtaatgtggaaacagatatctaacgagctgaatcatatcttactggaaaacgacatgaagttcaccgtcgtggttggcgatgtggctgggattcttgcccagggcaaaaagatgatccgccctcaacccatggagcacaaatactcgtggaaaagctggggcaaggcgaagattatcggggccgacgtccagaatactacctttataatcgatggaccaaacacacctgaatgtcccgacgatcagagagcttggaatatttgggaggtggaggactatggcttcggtatctttactaccaacatttggttgaagctcagggattcctacacacaggtttgcgaccaccgtctgatgtcagcagccatcaaagatagtaaggctgtgcatgccgacatggggtattggatagaatctgagaaaaatgaaacgtggaagctagcacgggcgagcttcattgaggtaaagacctgtatctggccaaaatcccacactctgtggtcaaacggagtcctcgaaagcgagatgattatccccaagatatacggcggtcctatctctcaacataattatcgaccaggctacttcacacagaccgccgggccgtggcacctgggaaaacttgagttggattttgacctgtgcgaaggcactacagtggtggtcgatgagcactgcgggaacagaggaccctccttaaggaccacgactgttaccggcaagattatccatgaatggtgttgccgcagttgtacactccctccactgcggttcagaggtgaggacgggtgctggtacggaatggagattaggcccgtgaaagaaaaggaggaaaatcttgtaaagagcatggtgtctgctggctccggtgaggtcgactcatttagtctgggcttgctctgtatcagcataatgattgaagaggtgatgcgctcgcgatggtcccggaaaatgctgatgaccgggactctagccgttttcctgctcctgatcatgggacagcttacatggaacgatttgatccgtctgtgcattatggtgggcgcaaatgcttctgacagaatggggatgggaaccacatatttagccctcatggcaacttttaagatgaggcctatgttcgccgtcggcctgctttttcgccggctgaccagcagagaggtgctactcctgacgatcggtttgtcactggttgctagtgtggaattaccaaactccctcgaggaactgggggatggacttgcgatgggcattatgatactgaaattgctcacagacttccaatctcaccagctgtgggccaccctactgagccttacttttatcaagaccacattctccctccattacgcatggaaaactatggctatggtcctgtcaattgtatccttgtttcccctgtgtttaagtaccacgtctcagaagacaacctggctcccggtgctgcttggctccctggggtgcaagcctttgactatgttcctcatcgccgagaataaaatttggggaaggcgaagctggccactgaacgaaggtatcatggccgttggcatagtgtcgatcctactgtcatctcttctcaagaacgatgtccccctggctgggcctttgattgcaggaggcatgttaatcgcctgttatgtgattagtggttccagcgcggacctgtctctcgagaaagctgccgaggtaagctgggaagaggaagcagagcactccggggcctcacataatatcctggtggaagtccaggatgacggaacaatgaagataaaagatgaggagcgcgacgatacccttactattctgttgaaggctacactactggcagttagtggcgtgtaccccctcagcatcccagccaccctgtttgtgtggtatttctggcagaaaaagaagcagcggtctggcgtcctttgggacacgccttcacccccagaagtggagagagcggttttagatgacgggatctacaggattatgcagcgtggactgctcggtcgcagccaggtaggcgtgggggtcttccaagaaaacgtgtttcacactatgtggcacgttacccggggagctgtgttgatgtatcagggcaaaagactggagccgagttgggccagcgtcaagaaagacctcatatcctacggtgggggatggaggctgcagggctcttggaatacaggcgaggaagtgcaggtaatcgcagtcgagcctgggaagaaccccaaaaatgtgcaaaccgccccaggaacattcaagactcccgaaggtgaggttggcgctattgcccttgattttaagcctgggacctcgggaagcccaatcgtgaaccgagaaggcaaaattgtcggtctgtacgggaatggagtggttacgacatcaggcacttatgtgtccgcaatcgctcaggccaaggcgagtcaggagggccccttgcctgagatagaagacgaggtcttccggaaacgcaacctaaccatcatggatctgcatccggggtctggaaagacaagaaggtacctcccagccattgtgcgggaagcaatcaaacgaaagttaagaaccctgattcttgctcccactcgcgtagtggccagcgagatggctgaagcactgaagggtatgcctatcaggtatcaaaccacagccgttaaatccgagcacacgggcaaggagatagtcgacctcatgtgccatgccacttttaccatgcgtttgctgtcaccagtgcgggtgcccaattacaacatgattatcatggatgaagctcacttcacagacccttctagcatcgcggcaagagggtatattagtaccagggtcggaatgggcgaggccgctgccatctttatgactgcaacaccgcccggttccgtagaagccttcccacagagcaatgctgtgatacaggatgaggaacgcgacattcctgagcgatcttggaactcagggtacgagtggatcaccgattttcccggaaaaacggtttggttcgtgccatccattaagagtggcaatgacatcgcgaactgtctcaggaaaaatggcaagcgggtcatacagctgagcaggaagacttttgatacagaatatcagaaaaccaagaacaacgactgggactacgtggttaccactgatatttcggagatgggggccaatttccgcgcagaccgtgtgatcgatcctagacggtgccttaaacccgtcatcctaaaggacggaccagaaagggtgattctggctggtccgatgcctgtaacagtggcctctgcagcccagcgccgaggcagaatcgggcggaaccataataaagagggagatcagtacatttatatgggccagcccttgaacaatgacgaggatcacgctcactggaccgaagccaagatgttactggacaacataaatacaccagagggtatcattcccgcactcttcgaacctgagagggaaaagtccgcagccatcgatggggagtaccgcctgagaggcgaggctaggaaaacttttgttgaacttatgcggcgtggagacctgccagtctggctcagctataaggtggcctcagagggcttccaatacagtgatcgccgatggtgctttgacggggaaagaaacaatcaggtgttggaggaaaacatggatgtcgagatctggacgaaagagggagaaaggaagaaactgcggccccgctggctagacgctagaacctattctgaccctctggcactcagggagttcaaggaatttgccgctggtcggcgatccgttagcggcgatcttattctggagatagggaaattaccgcagcatttgacacagagagcccaaaatgcactggacaacctcgtgatgctgcacaattcagaacagggaggccgcgcgtacaggcatgccatggaggagcttccagatactatcgaaaccctgatgctcttggctctgattgccgtattaacaggtggggtgaccctattctttctgagtggccggggactcggcaagactagcatcgggcttctgtgtgtcatggcatcctctgtgttgctgtggatggctagcgttgagccccactggattgccgcatccatcatactcgagttctttctgatggtgcttctcatccctgagcccgaccgtcagagaacgccacaggataaccaactggcctatgtcgtaattggattgctgttcatgatcttaaccgtggctgcgaatgagatgggtctactggaaacaactaagaaagacctcggcattgggcacgccgcagttggaaaccatcaccatgctgccatgcttgatgtggacctgcaccctgcctcagcatggaccttgtacgctgtcgccacaaccatcataactcccatgatgaggcatacaattgagaacacgaccgcgaatatctctctgactgctattgccaaccaggcagccatcctcatgggcctggataagggttggccaataagtaaaatggacatcggggtgcctcttttagctctgggctgctactcgcaggtcaatccgctcacattgaccgcagccgtgctgatgctagttgcgcactatgctattatcggacccggcctgcaagccaaggcaacccgcgaagcccagaaacggacagctgccgggattatgaagaacccaactgtggatggaatcgtagcaatagacctcgatcctgtggtctacgacgctaagtttgagaaacagcttggccagattatgctgttgatcctgtgtacgagccaaatcctcctgatgcgaaccacatgggccttatgcgaatccattactcttgcggccggtcccctgaccacactctgggaggggtctccaggaaagttctggaataccactatcgcagtttcaatggctaacatatttagaggcagctatctagccggtgcaggcctggctttctccttgatgaaaagtctagggggaggcaggcgcgggacgggagcccagggcgagacactcggtgaaaagtggaaacggcagcttaatcagctgtctaagagcgagttcaacacctacaagagatcagggattatggaagtggaccgttccgaggccaaagaaggattgaagaggggcgagactaccaaacacgcggtcagtcggggtacagctaagctgcgctggtttgtggagcgaaatctcgtaaaacctgaaggcaaggtgatcgatttagggtgtggaagaggcgggtggagctattactgcgcaggactgaagaaagttactgaggtgaagggctataccaaaggtgggcccggacatgaagaaccgattccaatggccacatacggctggaaccttgtcaagctgcactctggcaaagacgtgttctttatccctcccgaaaagtgtgatacgctactctgcgacataggggagtcctcaccaaatcccaccatcgaggaaggaaggactctgcgggtcttgaaaatggtggagccttggctgcgcggtaaccaattctgtattaagatcctcaatccgtacatgcccagcgttgtagaaacacttgagcagatgcagagaaagcatggcgggatgctggtgaggaacccattatcgcgaaattctacccacgagatgtattgggtcagttgcggaactggcaacattgtgtccgctgttaatatgacaagccggatgctgttgaaccgttttaccatggcccacagaaaacctacgtacgaacgcgatgtggacctcggtgcagggaccaggcatgtcgccgtggagcccgaagtagctaacctggatatcattggacagcggatcgagaatataaagcacgaacataaatcaacatggcactatgacgaggataacccttacaagacttgggcgtatcatggctcctacgaggtgaaaccatctggcagcgccagttccatggttaatggggtcgtgaagctacttaccaagccctgggacgtgattcctatggtcacacaaatcgcaatgactgataccacaccattcggacagcagagagtttttaaagaaaaggtggacacccgcactcccaaagctaagaggggtacggcccaaatcatggaggtaacagcaaaatggctgtggggcttcctcagccgaaacaagaagccgcggatttgtaccagagaagagtttactaggaaagtgcgctctaatgccgctataggggccgtcttcgtggacgaaaaccagtggaactcagcgaaggaggcagttgaggatgaacgtttttgggacctggtgcaccgggagagagaattgcacaaacagggaaagtgcgcaacctgcgtctataacatgatgggcaaaagggagaagaagctgggtgagttcgggaaagctaagggaagtcgcgccatctggtacatgtggctcggcgcacgatttcttgagttcgaggctctgggcttcatgaatgaagatcattggttttcccgggagaacagcttatctggggtggaaggagagggtctgcacaaattgggctacattctcagagacatctcgaagattcctgggggaaatatgtatgccgatgacacagctggctgggatacgaggatcaccgaggacgatctgcagaacgaagcccgcataactgacatcatggagccagaacatgcactacttgcgaaatcaattttcaagctgacataccaaaataaagtagttagagtgcagcggcccgccaagaacggtaccgtcatggatgtgatcagcaggcgtgaccagcgagggtccggacaggtgggcacttatggcctcaatacatttaccaacatggaggctcaactgattcgccagatggaaagtgaggggatcttctctcctagcgagttggaaacaccaaacttagccgagagagtcctggattggctcgaaaagtacggagttgagcggcttaaaaggatggcaatatccggtgacgactgtgtggtaaagcccattgatgaccgctttgctactgccctgaccgcactaaatgatatgggcaaagtgagaaaggacatcccgcagtgggaaccttcaaaagggtggaacgattggcagcaagtccccttctgcagtcaccactttcatcagctgatcatgaaggacggacgggagattgtggttccatgtaggaatcaggatgagctcgtgggccgagcccgtgtctctcagggtgcggggtggagcttgagagaaacggcttgcctgggaaagtcctatgcccaaatgtggcagcttatgtacttccaccgccgggacctgaggctcgcagccaacgctatatgttcagccgtgcctgtagattggatccccaccagcagaacaacttggtctattcatgcacaccatcagtggatgaccacagaggacatgttatccgtttggaatcgcgtgtggatcgaagagaacccatggatggaagataaaactcacattagtagctggggcgacgtcccctatctgggcaagcgggaggaccaatggtgcgggtcgttgatcggactgaccgctagggccacgtgggcgacaaatgtgcaggttgctataaaccaggtgcgaagactcatcggtaatgagaactaccttgattacatgacctccatgaaacggtttaagaatgaatctgaccctgagggcgccctgtggtga

SEQ ID NO: 13661 - RNA, 9879 nt, synthetic construct
  misc_feature 1..9879: note = derived and/or modified CDS sequence (opt3) from DENV-1__FJ461320__SS-prME
  source 1..9879: mol_type = other RNA
agcgtgaccatgctgctcatgcttatgcccaccgccctggctttccacttgactacgaggggaggggaacctcatatgatcgtcaccaagcaggaaaggggaaaatccttactgtttaagacatctgccggtgttaatatgtgcactctaattgccatggacctcggcgaactgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggttgacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggatcgttcaaactggagaaggaagtggctgagacccagcacggtacggtccttgtgcagataaagtacgagggcacagacgcgccttgcaaaatcccattctcgacccaagatgaaaagggggttactcagaacggacgcttgattacagcaaatcccatcgtgaccgacaaagagaagcctgtaaacatagaagccgagccaccctttggcgagtcttatattgtcatcggtgctggggaaaaagccctgaagctctcctggttcaagaaaggctcaagtatcggaaagatgtttgaggcaactgccagaggcgctaggcggatggccattctgggggataccgcatgggacttcggaagcgtgggtggcgtttttacatccgtggggaaacttgtccatcagatcttcggaacggcgtacggcgtgctgttttctggtgtaagctggaccatgaagattgggataggcgtgttgctcacttggctgggattaaattcacgaagtacatccctgagcatgacctgtatcgctgttggcctagtcacactctacctgggggtgatggtgcaggccgattctggatgcgtcattaactggaaaggccgcgaacttaagtgtggttcagggatcttcgttactaatgaggtgcacacctggacggaacaatataagtttcaggcagacagtccgaaaagattgagcgccgctatcggaaaggcctgggaggagggcgtgtgcggtattaggtccgcaacacggctggaaaacataatgtggaaacagatctctaacgagctcaatcatattctgttagaaaacgacatgaagttcaccgtagtcgtgggcgatgttgtggggatcctggctcagggcaaaaagatgattcgccctcaacccatggagcacaaatactcgtggaaaagctggggcaaggccaagatcataggggcggacgtccagaatactacctttatcattgatggaccaaacacacctgaatgtcccgacgatcagagagcctggaatatctgggaggtggaggactatggcttcggtatttttactaccaacatctggcttaagttgagggattcctacacacaggtttgcgaccaccgtctcatgtcagctgcaataaaagatagtaaggccgtgcatgctgacatggggtattggattgaatctgagaaaaatgaaacgtggaagctggcccgggcatccttcatcgaggtaaagacctgtatttggccaaaatcccacactctatggtcaaacggagtcctggaaagcgagatgatcatacccaagatctacggcggtcctatttctcaacataattatcgaccaggctacttcacacagaccgcggggccgtggcacctcggaaaactggagcttgattttgacttgtgcgaaggcactacagtggtggtcgatgagcactgcgggaacagaggaccctccctgaggaccacgactgttaccggcaagatcattcatgaatggtgttgccgcagttgtacattacctccactccggttcaaaggtgaggacgggtgctggtacggaatggagatcagacccgtgaaggaaaaggaggaaaatctggtaaaaagcatggtgtctgccggctccggtgaggtcgactcatttagtcttggcctgttgtgtataagcattatggtggaagaggttatgaggtcgcgctggtcccgaaagatgctcatgaccgggactctggctgtgttcctactgctcatcatgggacagctgacatggaacgatcttatccggttgtgcattatggtcggcgccaatgcatctgaccgtatggggatgggaaccacatatctggctttaatggccacttttaaaatcagacctatgttcgcagtgggcctcctgtttaggcgccttaccagccgggaggttctgctactcacgattggtctgtcattggtggccagtgtcgaactgccaaactccttagaggaactcggggatggactggctatgggcataatgatccttaagctgttgacagacttccaatctcaccagctctgggcgaccctgctaagcctgacttttattaaaaccacactttccctccattacgcctggaagactatggcaatggtactgtcaatcgtgagcttgttccccctgtgtttaagtaccacgtctcagaagacaacctggctcccggttctgcttggctccctggggtgcaaacctttgactatgtttctcattacagagaataagatctggggaagaaaaagctggccactgaacgaaggtataatggctgtgggcgtcgtgtcgatcctactgtcatctcttctcaagaacgatgtacccctggccgggcctttgattgccggaggcatgttaatcgcttgttatgtgattagtggttccagcgcagacctgtctctcgagaaagccgcggaggtcagctgggaagaggaagctgagcactccggggcctcacataatatcctggttgaagtgcaggatgacggaaccatgaagataaaagatgaggagagggacgatactcttacaattctgttgaaggcaaccctactggccgtgagtggcgtctaccccctcagcatcccagctacgctgttcgtgtggtatttttggcaaaagaaaaagcagcgatctggcgttctttgggacactccttcacccccagaagtagagcgcgcagtgttagatgacgggatctaccggattatgcagagaggactgctcggtaggagccaggtcggcgtgggggttttccaagaaaacgtgttccacaccatgtggcacgtcacacgtggagccgtgttgatgtatcagggcaaacgcctggagccgagttgggcgagcgtaaagaaagacctcatatcctacggtgggggatggcggctgcagggctcttggaataccggcgaggaagtccaggtgatcgctgttgagcctgggaagaaccccaagaatgtgcaaacagccccaggaacttttaaaacccccgaaggtgaggtcggcgcaattgcccttgatttcaagcctgggacgtcgggaagcccaatcgtgaacagagaaggcaaaattgttggtctgtacgggaatggagtggtcacaacttcaggcacctatgtgtccgctatcgcccaggcaaaggctagtcaggagggccccttgcctgagatagaagacgaggtatttaggaaacgaaacctaacaatcatggatctgcatccggggtctggaaagacccggcgctacctcccagccattgtgagagaagcgatcaagaggaaattacggactctgattcttgcccccacccgagttgtcgcaagcgagatggctgaagccctgaagggtatgcctatcagatatcaaacaacggctgtgaaatccgagcacactggcaaggagatagtggacctcatgtgccatgcaaccttcacaatgcgcttgctgtcaccagtcagggtacccaattacaacatgattatcatggatgaagcccactttaccgacccttctagcatcgccgctcgtgggtatattagtactcgggtgggaatgggcgaggcggcagccatcttcatgacagctaccccgcccggttccgttgaagcctttccacagagcaatgcagtgatacaggatgaggaaagagacattcctgagaggtcttggaactcagggtacgagtggatcacggatttccccggaaaaactgtctggtttgtgccatccattaagagtggcaatgacatcgccaactgtctccgcaagaatggcaaacgagttatacagctgagcagaaagacattcgataccgaatatcagaaaaccaagaacaacgactgggactacgtggtcactacagatatttcggagatgggggctaattttcgggcggacagggtgatcgatcctcgccgttgccttaaacccgtaatcctaaaggacggaccagaaagagtgattctggccggtccgatgcctgttaccgtcgcatctgctgcccagcggaggggccgcatcgggcgaaaccataataaggagggagatcagtacatttatatgggccagcccttgaacaatgacgaggatcacgcacactggacagaagccaaaatgttactggacaacataaatactccagagggtatcattcccgctctcttcgaacctgagagagaaaagtccgccgcgatcgatggggagtaccggctgaggggcgaggcacgcaaaacgttcgtggaacttatgagaaggggagacctgccagtgtggctcagctataaggtcgcctcagagggctttcaatacagtgatcggcgttggtgcttcgacggggaacgcaacaatcaggttttggaggaaaacatggatgtggagatctggaccaaagagggagaacgaaagaaactgagacccaggtggctagacgctcggacatattctgaccctctggccctccgcgagtttaaggagttcgctgcaggtagaaggtccgtaagcggcgatcttattctggagatagggaagttaccgcagcatttgactcagcgggcccaaaatgctctggacaacctcgtgatgctgcacaattcagaacagggaggccgagcctacagacatgcaatggaggagcttccagataccatcgaaacactgatgctcttggcgctgattgccgtcttaaccggtggggtgactctatttttcctgagtggccgcggactcggcaaaacgagcatcgggcttctgtgtgttatggcttcctctgtgttgctgtggatggccagcgtcgagccccactggattgcagcttccatcatactcgaatttttcctgatggtacttctcatccctgagcccgacaggcagcggaccccacaggataaccaactggcctatgtggttattggattgctgtttatgatcttaacagtggcagccaatgagatgggtctactggaaactaccaagaaagacctcggcattgggcacgtcgctgtggagaaccatcaccatgcgacaatgcttgatgtcgacctgcaccctgcctcagcatggaccttgtacgctgtggccactacaatcataacgcccatgatgcgtcataccattgaaaacactacagccaatatctctctgaccgcaattgctaaccaggccgcgatcctcatgggactggataagggctggccaataagtaaaatggacatcggtgttcctcttttagctctggggtgctacagccaggtgaatccgctcaccttgacagccgcagtactgatgctagtggcccactatgctattatcggccccggactgcaagcaaaggccactagagaggcgcagaagaggacggctgccggcattatgaaaaacccaaccgtcgatgggatcgttgcaatagacctcgatcctgtggtctacgacgccaagttcgaaaaacagcttggacagattatgctgttgatcctgtgtacaagccaaatcctcctgatgcgcactacctgggctttatgcgagtccattacacttgccaccggccccctgactacgctctgggagggttctccagggaagttttggaatacaaccatcgcagtgtcaatggctaacatattccggggaagctatctagccggcgcgggtctggccttttccttgatgaaaagtctgggcgggggacgaagaggcactggggcacagggagaaaccctcggcgagaagtggaagaggcagcttaatcagctgtctaaaagcgagttcaacatttacaagcgctcaggtatcatggaggtagaccggtccgaagctaaagaggggttgaagagaggagagacaactcgtcacgccgtgagtaggggcaccgcaaaactgcggtggttcgttgaacgcaatctcgtgaagcctgagggtaaggtcattgatttaggctgtgggcgaggaggctggagctattactgcgctgggctgaaaaaggtgacagaagtcaaaggatatacgaagggcggtcccgggcatgaggaaccgatcccaatggccacctacggatggaaccttgtgaaactgcactctggcaaggacgtatttttcactcctcccgagaaatgtgatacactactctgcgacataggcgagtcctcaccaaatcccaccatcgaagaggggagaactctgagggtattgaagatggtggaaccttggctgcggggaaaccaattttgtattaagatcctcaatccgtacatgcccagcgtcgtggagacacttgagcagatgcagcgcaaacatggtggcatgctggttagaaacccattatcgagaaattctacccacgaaatgtattgggtgagttgcgggacgggaaacattgtctccgccgtgaatatgaccagccgaatgctgttgaaccggttcacaatggcgcaccgtaagcctacttacgagagagatgtagacctcggcgctggtacccgccatgtggcagttgaacccgaggtcgccaacctggatatcattgggcagaggatcgaaaatataaaacacgagcataagtcaacatggcactatgacgaggataacccttacaaaacttgggcttatcatggatcctacgaagtgaagccatctggcagcgccagttccatggtgaatggcgtcgttaagctacttaccaaaccctgggacgtgattcctatggtaacacaaatcgcaatgaccgatactacgccatttgggcagcagcgggtgttcaaggagaaagtcgacacaagaacccccaaggccaaacgcggaactgctcaaatcatggaagtgaccgcgaggtggctgtggggttttctcagccgaaacaagaagccgcggatttgtacaagagaggagttcacgaggaaagttcgctctaatgccgcaataggcgctgtgtttgtcgacgagaaccagtggaactcagccaaggaggcagtggaagatgagcgtttctgggacctggtacagaaagaacgggagttgcacaagcaggggaaatgcgcaacctgcgtttataacatgatgggaaagagagaaaagaaactgggcgagtttggtaaggctaaagggagtagggccatctggtacatgtggctcggagcgcgcttccttgagtttgaagcactgggcttcatgaatgaggatcactggttctcccgagaaaacagcttatctggcgtggagggggagggactgcataagttgggttacattctccgggacatctcgaaaattcctggcgggaatatgtatgccgatgacactgctggatgggatacaagaatcaccgaagacgatctgcaaaacgaggccaagataactgacatcatggaaccagagcacgcactacttgctacatcaatttttaaactgacctaccagaataaggtcgtgagggtgcagcgccccgccaagaacggcacagtcatggatgttatcagcagacgggaccagaggggttccgggcaagtgggaacttatggcctcaataccttcacgaacatggaagctcagctgattcgtcagatggagagtgagggcatctttttgccttctgaattagagaccccaaacctggccgaacgagtactcgattggcttgagaaatacggggtggaacgcctgaagagaatggcaataagcggagacgactgtgtcgtgaaacccattgatgaccggttcgcgacagccctaactgctctgaatgatatgggtaaggttaggaaagacatcccgcagtgggagccttccaagggctggaacgattggcaacaggtgcccttttgctcacatcacttccaccagctcatcatgaaggacgggcgcgagattgtcgtgccatgtagaaatcaggatgaattggtaggacgggccagggttagtcaaggcgcaggttggtctctgcgagagaccgcttgccttgggaaaagctatgcccagatgtggcagctgatgtactttcatcgtagagacctccgcttagcagccaacgcgatatgttccgctgtgcctgtcgattgggtgcccacatcacggactacctggagcatccacgcccatcaccaatggatgacgacagaagacatgctgtctgtttggaatagggtgtggattgaggaaaacccatggatggaggataagacccatgtctccagttggggagacgtgccctatttgggcaaaagagaggaccagtggtgcggcagcctgatcgggctcactgcacgcgccacatgggcttcgaatattcaggtagccatcaaccaggtgcggaggcttataggaaatgaaaactacctggattacatgacctccatgaagcgattcaaaaatgagggtgaccctgaaggcgcactatggtga

SEQ ID NO: 13662 - RNA, 9879 nt, synthetic construct
  misc_feature 1..9879: note = derived and/or modified CDS sequence (opt3) from DENV-1__FJ410225__SS-prME
  source 1..9879: mol_type = other RNA
agcgtgaccatgctgctcatgcttatgcccaccgccctggctttccacttgactacgcggggaggggaacctcatatgatcgtctccaagcaggaaaggggaaaatctttactgtttaagacctcagccggtgttaatatgtgcacactaattgccatggacctcggcgaactgtgtgaagatactatgacctacaaatgcccacggataacagaaaccgaaccggacgatgtggactgttggtgcaatgcgactgatacatgggtaacctatgggacgtgtagtcaaactggagaacaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggttgacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaggacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaggcccctacaaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccgggtcgttcaaactggagaaggaagtcgccgagacgcagcacggtacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattgtgatcggtgccggggaaaaagctctgaagctctcctggttcaagaaaggctcaagtatcggaaagatgtttgaggccaccgcaagaggcgccaggcggatggctattctgggggatacagcctgggacttcggaagcatcggtggcgtttttacgtccattgggaaacttgtgcatcagatattcggaaccgcatacggcgtcctgttttctggtgtgagctggactatgaagatcgggattggcgtattgctcacatggctgggattaaattcacgaagtacctccctgagcatgacatgtatcgcggtgggcctagttactctctacctgggggtcatggtgcaggctgattctggatgcgtgatcaactggaaaggccgcgaacttaagtgtggttcagggattttcgtcaccaatgaggttcacacgtggacagaacaatataagtttcaggccgacagtccgaaaagattgagcgcagccataggaaaggcttgggaggagggcgtgtgcggtatcaggtccgccacccggctggaaaacattatgtggaaacagatctctaacgagctcaatcatattctgttagaaaacgacatgaagttcactgtggtagtcggcgatgtggcagggatcctggctcagggcaagaagatgatacgccctcaacccatggagtacaaatattcgtggaaaagctggggcaaggccaagatcattggggcggacgttcagaataccacatttatcattgatggaccaaacactcctgaatgtcccgacgatcagagagcctggaatatctgggaggtggaggactacggcttcggtatatttaccacaaacatttggcttaagttgagggattcctatacgcaggtctgcgaccaccgtctcatgtcagctgcaatcaaagatagtaaggccgtgcacgctgacatggggtactggattgaatctgagaaaaatgaaacctggaagctggcccgggcatccttcatcgaggttaagacttgtatatggccaaaatcccatacactatggtcaaacggagtgctggaaagcgagatgatcattcccaagatctatggcggtcctatttctcaacacaattaccgaccaggctacttcacccaggcggccgggccgtggcatctcggaaaactggagcttgattttgacttgtgcgaaggcactacagtagtcgtggatgagcactgcgggaacagaggaccctccctgaggaccacgactgtgaccggcaagatcatacacgaatggtgttgccgcagttgtacattacctccactccggttcagaggtgaggacgggtgctggtatggaatggagattaggcccgtcaaagaaaaggaggaaaatctggttaagagcatggtgtctgctggctccggtgaggtagactcatttagtcttggcctgttgtgtatcagcatcatgattgaagaggtgatgcgctcgcgatggtcccggcgtatgctcatgaccgggactctggccgtcttctttctactgatcatgggacagctcacatggaacgatctgattagactttgcataatggtgggcgcaaatgcttctgacaggatggggatgggaaccacatacttggccctgatggcaactttcaaaatgcgccctatgtttgccgttggcttactcttccggagactgaccagcagggaggtgcttctgctaacgatcggtctctcactggtcgctagtgtggaattgccaaactccctggaggaattaggggatggactcgcgatgggcattatgatcctgaaacttctgacagactttcaatctcatcagttgtgggccaccctcctgagcctaactttcattaaaaccacattttccctgcactatgcatggaagactatggctatggttctttcaatcgtgagcctcttccccctgtgtttgagtaccacgtctcagaaaacaacctggctgccggtcttactcggctccctggggtgcaagcctcttactatgtttctgatagccgagaataagatctggggacgacgcagctggccattgaacgaaggtattatggccgtaggcatcgtgtcgattctcctgtcatctctactgaaaaacgatgttccccttgctgggcctctcatcgcaggaggcatgctgatagcctgttacgtgattagtggttccagcgcggacttgtctttagagaaggctgccgagatcagctgggaagaggaagcagagcattccggggcctcacacaatatcctggtcgaagtgcaggatgacggaacaatgaaaattaaggatgaggagcgggacgataccctcactatactgcttaaagctacactgttggcagtaagtggcgtgtatcccctaagcatcccagccaccctgttcgtctggtacttctggcaaaagaaaaagcagagatctggcgttctctgggacacgccttcacccccagaagtggagagggcggtgctggatgacgggatttatcgtatcatgcagcgcggacttttaggtcggagccaggtcggcgtgggggtttttcaagaaaacgtattccatactatgtggcacgtgaccagaggagctgtcctgatgtaccagggcaagaggctcgagccgagttgggccagcgtgaaaaaggacttgatttcctacggtgggggatggcgactgcagggctcttggaatacaggcgaggaagttcaggtgatcgcagtcgagcctgggaaaaaccccaagaatgtgcaaaccgccccaggaacatttaaaactcccgaaggtgaggtaggcgctatagccctcgatttcaagcctgggacctcgggaagcccaatcgtcaaccgggaaggcaagattgtgggtctgtatgggaatggagttgtgacgacatcaggcacttacgtctccgcaatcgctcaggccaaagcgagtcaggagggcccccttcctgagattgaagacgaggtgtttcgcaagagaaacctgaccatcatggatttgcacccggggtctggaaaaacaaggcggtatctaccagccatagttcgagaagcaattaagagaaaactgcgcaccctcatcttagctcccactagggtggtcgccagcgagatggctgaagcactgaagggtatgcctatccgttaccaaaccacagccgtgaagtccgagcatacgggcaaagagattgtagaccttatgtgccacgccactttcaccatgcggctgctctcaccagctagagtgcccaattataacatgatcataatggatgaagcgcattttacagacccttctagcattgcagccagggggtacatcagtacccgcgttggaatgggcgaggctgccgcaattttcatgactgccacaccgcccggttccgtcgaggcttttccacagagcaatgcggtgatccaggatgaggaacgagacatacctgagagatcttggaactcagggtatgagtggattaccgatttccccggaaagacggtgtggtttgtcccatccatcaaaagtggcaatgacatcgccaactgtttgcggaagaatggcaaaagggtaattcagctgagccgcaagactttcgatacagaataccaaaagaccaaaaacaacgactgggactacgtggttaccactgatatctcggagatgggggcaaatttccgtgctgacagagtgattgatcctcggaggtgcctcaagcccgtcatactgaaagacggaccagaacgcgtgatccttgccggtccgatgcctgttacagtggcatctgccgctcagcgaagaggccggattgggaggaaccacaataaggagggagatcagtatatctacatgggccagcccctaaacaatgacgaggatcatgcccactggaccgaagcgaaaatgctgttggacaacatcaatacaccagagggtattatacccgcattatttgaacctgagcgcgaaaagtccgccgctatcgatggggagtatagactgaggggcgaggcccggaagactttcgtcgaactcatgcgtcgcggagacctgccagtgtggcttagctacaaagtagcttcagagggctttcaatatagtgatcgaagatggtgcttcgacggggaaaggaacaatcaggtgctggaggaaaacatggatgttgagatttggacgaaggagggagaacggaaaaagctccgccccagatggttggacgcaaggacctactctgaccctctggccctacgggagtttaaagagttcgctgccggtcgaagatccgtcagcggcgatctgatcctcgagattgggaaacttccgcagcacctgacacagcgcgcacaaaatgcgttagacaacttggtgatgctgcataattcagaacagggaggcagggcctatcggcacgctatggaggagctcccagatactatcgaaaccctgatgcttctggccctcatagcagtgttgacaggtggggtcaccctgtttttcttaagtggccgtggactaggcaaaactagcatcgggctgctctgtgttatggcttcctctgtgcttctgtggatggccagcgtagagccccattggattgcagcctccatcattttggaatttttcctgatggtgctcctgatccctgagcccgacagacagaggacgccacaggataaccaacttgcttacgtcgtgataggactcctgtttatgattttgaccgttgcggccaatgagatgggtctgttagaaacaactaagaaggacctaggcatcgggcacgtggcagtcgagaaccaccatcacgctgccatgctggatgtagacctccatcctgcctcagcatggaccctttacgctgtggccacaaccattatcactcccatgatgcgccacacaatagaaaacacgaccgcgaatatctctctgactgctattgccaaccaggcagccatcttgatgggactggataaaggctggccaattagtaagatggacatcggtgttcctctcctggctcttgggtgctatagccaggtgaatccgttaacactgaccgcagccgtcctcatgttggtggcgcattacgctataattggccccggactgcaagccaaagcaacccgggaggcccagaagcgaacagctgccggcatcatgaaaaacccaactgtcgatgggatcgtggcaattgacctagatcctgttgtgtatgacgctaagttcgaaaagcagctgggacagatcatgctccttatactgtgtacgagccaaattttgctgatgagaaccacatgggccctctgcgagtccatcactctggcgaccggccccttaacaaccctttgggagggttctccagggaaattttggaatactacgattgccgtatcaatggcaaacatcttcaggggaagctacctggctggcgccggtctcgcattctccctaatgaagagtctgggcgggggacgccggggcacaggggctcagggagaaaccttgggcgagaaatggaagagacagctgaatcagctctctaaaagcgaatttaacacttataagcgttcaggtataatggaggtggacaggtccgaagccaaggaggggcttaaacggggagagaccacaaagcacgccgtcagtcgcggcactgcgaaactgcgatggttcgttgaaagaaatttggtgaagcctgagggtaaagtcatcgatctgggctgtgggaggggaggctggagctactattgcgctgggctcaagaaggtgaccgaagtaaaaggatacacaaagggcggtcccgggcacgaggaaccgattccaatggcaacgtacggatggaacttagtgaaactgcattctggcaaggacgtatttttcatccctcccgagaaatgtgatacccttctgtgcgacattggcgagtcctcaccaaatcccactatcgaagaggggcggacactacgcgtgctcaagatggtcgaaccttggctgagaggaaaccaattttgtattaaaatcttgaatccgtatatgcccagcgtggtcgagaccctggagcagatgcagaggaagcacggtggcatgctcgtgcgaaacccactttcgagaaattctactcatgaaatgtactgggttagttgcgggacaggaaacatagtatccgccgtgaatatgaccagccgtatgctgttaaacagattcacgatggctcaccgcaagcctacctatgagagggatgtcgacctgggcgccggtacacggcacgtggcagttgaacccgaggtggccaacttggatattatcgggcagagaatcgaaaatattaaacatgagcacaagtcaacttggcattacgacgaggataacccttataaaacctgggcttaccacggatcctatgaagtcaagccatctggcagcgcgagttccatggtgaatggcgtagtgaaactcctgacaaagccctgggacgttatacctatggtcactcaaatcgccatgaccgatacaaccccatttgggcagcagcgcgtgttcaaggagaaagtggacactaggacgcccaaggcaaaacgaggaacagctcaaattatggaagtcaccgccaagtggctatggggttttcttagccggaacaaaaagccgagaatctgtactagggaggagttcacccgcaaggttcgttctaatgcagccattggcgctgtgtttgtagacgagaaccagtggaactcagccaaagaggcggtggaagatgagcggttctgggacctggtccatagagaaagggagctccacaagcaggggaaatgcgcaacatgcgtgtacaacatgatgggaaagcgcgagaagaagctgggcgagtttggtaaggccaaagggagtcgagctatctggtacatgtggttgggagcccggttcctggagttcgaagcactcggctttatgaatgaggatcactggttctccagagaaaacagcctttctggcgttgagggggagggactgcataagttaggttatatactgagggacatctcgaaaattcctggcgggaatatgtacgctgatgacacggccggatgggatacccgcatcactgaagacgatttgcagaacgaggctagaattacagacatcatggaaccagagcacgccctcctggcaaagtcaatatttaaactaacctatcaaaataaggtggtccgggtgcagaggcccgcgaaaaacggcactgtaatggatgttattagccgtcgagaccagcgcggttccggacaggtgggaacatacggccttaataccttcacaaacatggaagcccaactgatcagacagatggagagtgagggcatcttttctcctagcgaactcgagactccaaacctggctgaacgggtcttggattggttagagaagtatggggtggaaaggctgaagcgcatggccatttccggagacgactgtgtggtcaaacccatagatgacagattcgcaaccgctctcacggcccttaatgatatgggtaaggttcggaaagacatcccgcagtgggagccttcaaagggctggaacgattggcagcaagtgcccttttgcagtcatcacttccaccagctgattatgaaagacgggagggagatcgtagtgccatgtcgaaatcaggatgagctagtcggacgtgcaagagtgtctcagggcgccggttggagcctgcgcgagaccgcgtgcctcgggaagtcctacgctcaaatgtggcagttgatgtattttcatcggagggacctgagacttgccgcaaacgccatttgttcagctgttcctgtggattggatccccacaagccgcactacctggtctatacacgcccatcaccagtggatgacaactgaagacatgctgtccgtctggaatcgggtgtggatcgaggaaaacccatggatggaggataagacccatattagtagctggggagacgtaccctacctcggcaaaagggaggaccaatggtgcggctcgttaatcgggctgacggcacgagctacatgggccaccaatattcaggttgcgatcaaccaggtgagacggttgattggaaatgaaaactacctggattatatgacttccatgaagaggttcaaaaatgagtctgaccctgaaggtgctctctggtga

SEQ ID NO: 13663 - RNA, 9879 nt, synthetic construct
  misc_feature 1..9879: note = derived and/or modified CDS sequence (opt3) from DENV-1__FJ410226__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagttctgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagagcaggacgcaaactttgtttgccgccgaacattcgtggatagaggctggggtaatgggtgtggactgtttggcaaaggctccttgataacttgcgctaagttcaagtgcgtaaccaaactcgaggggaagattgtgcagtacgaaaacctgaaatattcagtcatcgtgacagttcacaccggagaccagcatcaagtgggtaatgagagtactgaacacggcacgacagccaccattactccccaggcgcctagcaccgagatccagttaacagactacggggccctgaccctcgattgttctccaaggactggacttgactttaacgaaatggtcctgttgacaatgaaggagaaatcctggctagtgcataagcagtggttcctggatctcccgctgccctggacgtcaggcgcaagcaccagtcaagagacttggaatcggcaggaccttctggtaacatttaaaaccgctcacgccaagaagcaggaagttgtggtcttgggttctcaagagggggctatgcacacagccctcactggcgcaaccgaaatccagacgtccggaaccacaactattttcgccggccatctgaaatgccgtttaaagatggataaactgaccctaaaggggatgagctatgtgatgtgtacaggatcgttcaaactcgagaaggaagtcgctgagactcagcacggtaccgtgctggttcagataaagtacgagggcacggacgcgccttgcaaaatcccattttctacacaagatgaaaagggggtgacccagaacggacgccttattactgcaaatcccatcgtaacagacaaagataagcctgtcaacatagaggccgaaccacccttcggcgagtcctatattgtgatcggtgctggggagaaagccttgaagctgtcatggtttaagaaaggcagtagcatcggaaagatgttcgaagcaaccgccagaggcgctaggcggatggccattctcggggacactgcatgggattttggatccatcggtggcgttttcacctctgtggggaaactggtccatcagatttttggaacagcgtacggcgtgcttttcagcggtgtatcatggacgatgaagatagggatcggcgtgctgttgacctggctcggactgaatagtcgatccactagcttatctatgacatgtattgctgttggcctggtcaccctatacctcggggtgatggtgcaggccgactcaggatgcgtcgttaactggaaaggccgcgagctgaagtgtggtagtgggatctttgtgacaaatgaagtgcacacttggaccgagcaatataagttccaggcagacagcccgaaaagactttccgccgctatcggaaaggcctgggaagagggcgtatgcggtattaggtctgcaacgcggttggagaacataatgtggaaacagatctcgaacgaactgaatcatattctcctggagaacgatatgaagtttacagtcgtggttggcgacgtggctgggatcttagcccagggaaaaaagatgattcgccctcaacccatggaatacaaatatagctggaagtcctggggcaaggcgaaaatcataggggccgatgtccagaataccactttcatcattgacggaccaaacacccctgagtgtcccgatgaccagagagcttggaatatctgggaagtggaggattacggctttggtattttcacaactaacatctggctgaagcttagggactcatatacccaggtttgcgatcaccgtttgatgagtgcagccataaaagactctaaggctgtgcacgccgatatggggtactggattgagagcgaaaaaaatgagacatggaagctcgcacgggcgtccttcatcgaagtaaagacgtgtatttggccaaaatcacataccctgtggagcaacggagtcctagagtctgaaatgatcatacccaagatctatggcggtcctatttcccaacacaattaccgaccaggctactttactcagacagccgggccgtggcatctgggaaaactcgagctggacttcgatctttgcgagggcaccactgtggtggtcgacgaacactgcgggaacagaggacccagtttgaggacaaccacggttactggcaagatcattcacgagtggtgttgccgcagctgtaccctgcctccattacggtttaaaggtgaagacgggtgctggtatggaatggagatcagacccgtgaaggagaaggaagagaatctcgtaaaatctatggtgtccgctggctcaggtgaagtcgatagtttcagcctgggccttctgtgtatatcgattatgatcgaggaagtgatgaggtcccgctggtctcgaaagatgttgatgacagggaccctcgccgtttttttcctgctaatcatgggacagctgacttggaacgacctcattcggctgtgcatcatggtgggcgcaaatgctagcgatcgtatggggatgggaacaacctaccttgccttgatggcaacatttaaaatgagacctatgttcgccgtcggcctgttatttaggcgcctcacttcacgggaggtgctgcttctgaccattggtctaagtctcgttgcttccgtggagctgccaaactctttggaagagctgggggacggattagcgatgggcataatgatcctcaagctgcttacggatttccaaagccatcagctgtgggccacattgctctccctgacctttattaaaactaccttctcactacactatgcatggaagacaatggctatggtcctgagcatcgtaagtctttttcccctctgtatgtctactacctcccagaagacgacatggctgccggtgttgctgggcagcttagggtgcaaacctctcaccatgttcctgattgccgaaaataagatctggggaagaaaatcgtggccacttaacgagggtataatggccgttggcatcgtgtcaattctgttgtctagtctcctgaagaacgacgtccccctagctgggcctctgatcgcaggaggcatgcttattgcctgttacgtgatctccggtagctctgcggatctcagcctggaaaaagctgccgaggtatcctgggaggaagaggcagaacattcaggggccagtcacaatatattggtggaggtccaggacgatggaactatgaagattaaagacgaagagagggatgacacattaaccatcctgctcaaggctactctgcttgcagttagcggcgtgtatcccctgtctatcccagccacattgttcgtgtggtacttttggcaaaagaaaaagcagcgatccggcgtcctatgggataccccttcacccccagaggtggaacgcgcggttctggacgacgggatttatcggataatgcagagaggactcctgggtaggagtcaggtaggcgtgggggtcttccaagagaacgtgtttcatacgatgtggcacgttactcgtggagctgtgcttatgtaccagggcaaacgcttagaaccgagctgggcctccgtcaagaaagatctgatctcttacggtgggggatggcggctccagggctcgtggaataccggcgaggaggtgcaggtaattgcagtcgaacctgggaagaaccccaagaatgtgcaaacagccccaggaaccttcaaaacaagcgagggtgaagttggcgctatcgccttggactttaagcccgggacttcaggatcccctattgtgaacagagagggcaaaatcgtcggtctgtatgggaatggagtggttaccacgagtggcacatacgtgtctgcaatagctcaggccaaggcgagccaggaaggcccactccccgagatcgaggatgaagtcttcaggaaacgaaacctgactattatggaccttcaccctgggtccggaaagacccggcgctatctgccggccatcgtgagagaggcaattaagaggaaattgcggacactaatcctggctccaacccgagtagtggcctcagaaatggctgaggcactcaagggtatgcccataagataccaaactaccgccgttaaatctgaacatacaggcaaggagattgtcgatttaatgtgccacgccacgtttactatgcgcctgcttagccctgtgagggtgccaaattataacatgatcatcatggacgaggctcatttcaccgatcccagttccattgcggcacgtgggtacatcagcacacgggtcggaatgggcgaagccgctgccatatttatgaccgcaactcctccgggttctgtagaggccttcccccagtcaaatgctgtgattcaggacgaagagagagatatcccagaaaggtcctggaacagtgggtatgagtggattacagactttcctggaaaaaccgtttggttcgtgcccagcatcaagtcgggcaatgatatagcgaactgtctgcgcaagaatggcaaacgagtcattcagctctctagaaagacgttcgacactgagtaccaaaaaacaaagaacaacgactgggattacgtggttaccaccgacatctccgaaatgggggccaattttcgggcagatagggtgatcgacccacgccgttgcttgaaacctgtcattctgaaggatggacccgagagagtgatcctcgctggtccaatgccggtaactgtggccagcgcagcccagcggaggggccgcattgggcgaaaccacaataaggaaggagaccagtatgtttacatgggccagcctctgaacaatgatgaggaccatgctcactggacagaggccaaaatgcttctagataacataaatacccccgaaggtatcattccagcgctgttcgagcccgaaagagagaagtcagcagccatcgacggggaatatcggttgaggggcgaggctcgcaaaacatttgtcgagttaatgagaaggggagatctgcctgtgtggctcagttacaaggtggcctctgaaggcttccaatattccgaccggcgttggtgctttgatggggagcgcaacaatcaggtcctggaagagaacatggacgttgaaatctggactaaagagggagagcgaaagaaacttagaccaaggtggctggacgctcggacgtacagcgatcccctcgcattgcgcgaattcaaggagtttgccgctggtagaaggtcagtgagtggcgacctgattctagaaatagggaagctgcctcagcacctcacccagcgggcccaaaatgcacttgataacctggtaatgttacataatagcgagcagggaggccgagcgtatagacacgccatggaagagttgccggacacaatcgagactctgatgctcctggctcttattgccgtgctgaccggtggggtcacactcttctttttgtccggccgcggactgggcaaaacctctatcgggttactatgtgtgatggcaagctccgttctgctctggatggcttcagtggaaccacattggattgccgcatctatcatacttgagttctttctgatggtcttgctgatccccgaacctgataggcagcggactccccaggacaaccaactcgcctacgtagtgattggactgcttttcatgatcctcacggttgctgcgaatgagatgggtctgttggagaccacaaagaaagatctgggcattgggcacgtggccgtcgaaaaccaccatcacgcagctatgttagacgtggatctacatccagccagtgcctggactctgtacgcagtcgctaccacaatcataacccctatgatgcgtcacactattgagaacacaacggccaatatctcgctcaccgcgattgctaaccaggccgcaatccttatgggactggacaagggctggcccataagcaaaatggatatcggtgtgccattgctggccctcgggtgctattcccaggttaatcctctgactcttacagctgcagtgttaatgctggtagcccattacgcgattatcggcccgggactccaagctaaggccaccagagaagcacagaagaggaccgccgctggcattatgaaaaaccccacagtggacgggatcgtcgccatagatttggacccagttgtgtatgacgcaaagtttgagaaacagctgggacagattatgctactgatcctctgtacttctcaaatccttctgatgcgcacgacctgggctttgtgcgaatcaattacactggccactggccctctcaccacactgtgggagggtagccccgggaagttctggaataccactatcgcggtctccatggccaacatattccggggaagttacttagcaggcgctggtcttgccttttctctgatgaaaagcctcggcgggggacgaagaggcacgggggcacagggagagacactaggcgaaaagtggaagaggcagctgaatcagttgtcaaaatccgagttcaacacctataagcgcagtggtattatggaagtggatcggagcgaggctaaagaagggctgaagagaggagagactaccaaacacgccgtatctcgtggcacagccaagctcaggtggtttgtggagcggaatcttgttaagccagaaggtaaagtgatcgacctgggctgtgggcgcggaggctggtcctactattgcgcggggttgaagaaagtcactgaggtgaagggatacaccaaaggcggtcctgggcacgaagagcccattccgatggctacatacggatggaacctggtcaagctccattcaggcaaagatgtgttctttatcccacctgaaaagtgtgacacgttactgtgcgatataggcgagagctcgcccaatccaaccatcgaggaagggcgaactcttagagttctgaagatggtagagccctggctaaggggaaaccaattctgtattaaaatcctcaatccttatatgccgtctgtggtcgaaacactggagcagatgcagcggaagcacggtggcatgttggtgcgcaaccccctgagtagaaattccacccatgagatgtactgggttagctgcgggactggaaacattgtgtcagcagtcaatatgacatccaggatgctccttaaccgatttaccatggcccaccggaaaccaacgtatgaacgtgacgtggatctgggcgctggtaccagacacgtagccgtggagcctgaagttgcaaacttagacatcattgggcagcgcatcgagaatataaagcatgaacacaaatctacatggcattacgatgaggacaacccctataagacttgggcctaccacggaagctatgaggtcaagcctagtggctccgctagctctatggtgaatggcgtggtcaaactgttgaccaagccatgggatgttattcccatggtgacacaaatcgcgatgactgacaccacacctttcgggcagcagagggtatttaaagaaaaggtggacacccggactccaaaagccaagagaggaacggcacaaatcatggaggtcacagctaagtggctctggggtttcctgtcacgcaacaaaaagcccaggatttgtacccgagaagagtttactcggaaagtgagaagtaatgccgcaataggcgccgttttcgtggatgaaaaccagtggaattccgctaaggaggccgtcgaggacgaaaggttttgggatctagtgcatcgcgagcgtgaacttcacaaacaggggaagtgcgcgacctgcgtatacaacatgatgggaaagcgggagaaaaagctgggcgaattcggtaaagcaaaggggagcagagccatctggtacatgtggctcggagctaggttcctggagtttgaggccttgggcttcatgaatgaagaccactggttttctcgcgagaactcgctgtcaggcgttgaaggggagggactccataaacttggttatattctgcgagatatcagcaagattccgggcgggaatatgtacgcagacgatacagctggatgggacacgcggatcaccgaggatgacttacagaacgaagccaaaataactgatatcatggagcctgaacacgctctgttggccaagtccattttcaagctcacatatcaaaataaagtggtcagagtgcagaggccagcaaagaacggcaccgtgatggacgtcatcagtcgcagagatcagcggggttctgggcaggttggaacttacggcctgaatacatttaccaacatggaggcgcaactaattaggcagatggaaagcgagggcatcttctccccctcagagcttgaaacacctaacctggccgggcgtgtgctcgactggctggagaaacatggagtagaacgattgaagcgcatggctataagtggtgacgattgtgtggtcaaaccaattgacgatagatttgccactgcattaaccgctctgaatgacatgggcaaggtgcggaaggatatcccccagtgggagccgtctaaagggtggaacgactggcagcaagttcctttctgcagccaccactttcatcagctcatcatgaaggatggaagggaaattgtggtcccctgtcgcaatcaggacgagcttgtgggcagagcccgggtatcccagggtgcagggtggtcactgagggagacggcctgcctaggaaaaagctatgcgcaaatgtggcagctgatgtacttccaccgacgtgatctcagattggctgccaacgcaatatgttctgccgttccagtggactgggtccctacctcccgcacaacttggagtatccatgctcaccatcagtggatgaccacagaagatatgctgagcgtgtggaatcgggtttggattgaggaaaacccctggatggaggacaagactcacatctcgtcctggggcgacgtgccatatcttggcaaaagggaagatcaatggtgcgggtctctgattggactcaccgccagagcaacgtgggctacaaatatccaggtcgccataaaccaggtgcgccggttaatcggtaatgagaactacctggactacatgacctcaatgaagaggtttaagaatgagagcgatcccgaaggcgcgttgtggtga

SEQ ID NO: 13664 - RNA, 9879 nt, synthetic construct
  misc_feature 1..9879: note = derived and/or modified CDS sequence (opt3) from DENV-1__FJ410227__SS-prME
  source 1..9879: mol_type = other RNA
agcgtgaccatgctgctaatgcttatgcccacagcactggctttccacttgactacgcgaggcggggaacctcatatgatcgtctccaagcaggaaagggggaaatctttactgtttaagacctcagccggtgttaacatgtgcacactaattgcaatggacctcggcgagttctgtgaagatactatgacctacaaatgcccacggataacagaagcggaaccggacgatgtggactgttggtgcaatgctaccgatacttgggtaacatatgggacctgtagtcagacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaagacgcaaactttgtttgccgccgaacattcgtggatagaggctggggtaatgggtgtggactgtttggcaaaggctccttgataacttgcgctaagttcaagtgcgtaaccaaactcgaggggaagattgtgcagtacgaaaacctgaaatattcagtcatcgtgacagttcacaccggagaccagcatcaagtgggtaatgagagtactgaacacggcacgacagccaccattactccccaggcgcctagcaccgagatccagttaacagactacggggccctgaccctcgattgttctccaaggactggacttgactttaacgaaatggtcctgttgacaatgaaggagaaatcctggctagtgcataagcagtggttcctggatctcccgctgccctggacgtcaggcgcaagcaccagtcaagagacttggaatcggaaagaccttctggtaacatttaagaccgctcacgccaagaaacaggaagttgtggtcttgggttctcaggagggggctatgcacacagccctcactggcgcaaccgaaatccaaacgtccggaaccacaactattttcgccggccatctgaagtgccgtttaaaaatggataagctgaccctaaaagggatgagctatgtgatgtgtacaggatcgttcaagctcgagaaggaagtcgctgagactcagcacggtaccgtgctggttcagataaaatacgagggcacggacgcgccttgcaagatcccattttctacacaggatgaaaaaggggtgacccaaaacggacgccttattactgcaaatcccatcgtaacagacaaggagaaacctgtcaacatagaagccgagccacccttcggcgagtcctatattgtgatcggtgctggggaaaaggccttgaagctgtcatggtttaaaaagggcagtagcatcggaaaaatgttcgaggcaaccgccagaggcgctaggcggatggccattctcggggatactgcatgggactttggatccatcggtggcgttttcacctctgtggggaagctggtccatcagatttttggaacagcgtacggcgtgcttttcagcggtgtatcatggacgatgaaaatagggatcggcgtgctgttgacctggctcggactgaatagtcgatccactagcttatctatgacatgtattgctgttggcctggtcaccctatacctcggggtgatggtgcaggccgattcaggatgcgtcatcaactggaagggccgcgaactgaagtgtggtagtgggatctttgttacaaatgaggtgcacacttggaccgaacagtataaattccaagcagacagcccgaagagactttccgccgctattggaaaagcctgggaggagggcgtgtgcggtataaggtctacgacacggttggaaaacatcatgtggaagcagatttcgaacgagctgaatcatatcctcctggaaaacgacatgaaatttaccgtagtcgtgggcgatgttgcagggattttagctcagggaaagaaaatgatccgccctcagcccatggagtacaagtatagctggaagtcctggggcaaagccaagataatcggggcggacgtgcaaaatactaccttcattatcgatggaccaaacacacctgaatgtcccgacgatcagagagcctggaatatttgggaggtcgaggactacggctttggtatcttcactaccaacatatggctgaaacttagggattcatatacacaggtgtgcgaccaccgtttgatgagtgctgcaattaaggattctaaagccgttcacgctgacatggggtactggatcgaaagcgagaagaatgaaacgtggaagctcgcccgggcatccttcattgaggtgaaaacctgtatctggccaaagtcacatactctgtggagcaacggagtactagaatctgagatgataatccccaaaatttatggcggtcctatctcccagcacaattaccgaccaggctactttacacaaaccgcggggccgtggcatctgggaaagctcgagctggatttcgacctttgcgaaggcactacagtcgtggtggatgagcactgcgggaacagaggacccagtttgaggaccacgactgtcaccggcaaaattatccacgaatggtgttgccgcagctgtacactgcctccattacggtttaagggtgaggacgggtgctggtatggaatggagataagacccgttaaggaaaaagaggaaaatctcgtgaagtctatggtatccgccggctcaggtgaggtggacagtttcagcctgggccttctgtgtatttcgatcatgatcgaagaggtcatgaggtcccgctggtctcgaaaaatgttgatgaccgggactctcgctgtgtttttcctgctaattatgggacagctgacatggaacgatctcatccggctgtgcattatggttggcgccaatgcaagcgaccgtatggggatgggaaccacataccttgctttgatggccacttttaagatgagacctatgttcgcagtgggcctgttatttaggcgcctcacctcacgggaggtcctgcttctgacgataggtctaagtctcgtggcctccgttgaactgccaaactctttggaggaactgggggatggattagctatgggcatcatgattctcaaactgcttacagacttccagagccatcaactgtgggcgaccttgctctccctgacttttatcaagaccacattctcactacactatgcctggaagactatggcaatggtgctgagcattgtcagtctttttcccctctgtctgtctaccacgtcccagaaaacaacctggttgccggtactgttaggcagcctcgggtgcaagcctctgactatgttccttatcgctgagaataaaatatggggaagaaagtcgtggccactgaacgaaggtatcatggccgtgggcattgtttcaatcttgctctctagtctgctcaagaatgatgtgcccctggccgggcctcttattgctggaggcatgctcatcgcatgttacgtcatatccggtagctctgccgacctgagcttggagaaggcggctgaggtgtcctgggaagaggaagccgagcattcaggggcaagtcacaatattttagtagaagtgcaggatgacggaacaatgaaaatcaaggatgaggagagggacgataccctgactatcctcctgaaggccacacttctggctgtcagcggcgtttatcccttgtctattccagcaaccctattcgtgtggtacttttggcagaaaaagaaacaacgatccggcgtgctgtgggacacgccttcacccccagaagtcgagcgcgccgtgctcgatgacgggatatatcggatcatgcagagaggactgcttggtaggagtcaggttggcgtaggggtgttccaggaaaacgtctttcatactatgtggcacgtgacccgtggagcggttttaatgtaccaaggcaagcgcctggagccgagctgggcttccgtgaaaaaggacctcatttcttacggtgggggatggcggttgcagggctcgtggaatacaggcgaggaagtccaggtgatcgccgtagagcctgggaagaaccccaaaaatgtccagaccgcaccaggaacattcaagactagcgaaggtgaggtgggcgccattgctctggattttaaacccgggacctcaggatcccctatcgttaacagagaaggcaagatagtgggtctctatgggaatggagtcgtgacgacaagtggcacttacgtttctgccatcgcacaagctaaagccagccaggagggcccactgcccgagattgaagacgaggtgttcaggaagcgaaaccttaccatcatggatctgcaccctgggtccggaaagacacggcgctatttgccggcgattgtcagagaagccatcaaaaggaagctacggaccctgatactcgcaccaactcgagtggtagcttcagagatggccgaggctttaaaaggtatgcccattagataccagaccacagcagtgaagtctgagcatacgggcaaagagatcgttgacctgatgtgccacgccacttttaccatgcgccttctgagccctgtcagggtgccaaattataacatgatcattatggatgaagcccatttcacagaccccagttccatcgctgcgcgtgggtacataagcacccgggtgggaatgggcgaggcagccgctatttttatgactgccacacctccgggttctgtcgaagcattcccccaatcaaatgccgtaatccaggatgaggaaagagacattccagagaggtcctggaacagtgggtatgagtggatcaccgattttcctggaaagacggtgtggttcgttcccagcataaagtcgggcaatgacattgctaactgtctccgcaaaaatggcaagcgagtgatccagttgtctagaaaaactttcgatacagaataccagaagaccaaaaacaacgactgggactacgtcgtgaccactgatatctccgagatgggggcgaattttcgggccgacagggttattgatccacgccgttgcctgaagcctgtgatcctcaaggacggacccgaaagagtcattctggcaggtccaatgccggtgacagtagctagcgccgcacaacggaggggccgcatagggcgaaaccacaataaagagggagatcagtatatctacatgggccagcctcttaacaatgacgaggatcatgcccactggaccgaagctaagatgctactggacaacattaatacacccgagggtatcatcccagccttgttcgaacccgagagagaaaaatcagcggcaattgatggggagtatcggttaaggggcgaggcccgcaagacttttgtggaactgatgagaaggggagacctccctgtttggctgagttacaaagtcgcttctgagggcttccagtattccgatcggcgttggtgctttgacggggaacgcaacaatcaagtgcttgaggaaaacatggatgtggagatatggacgaaggagggagaaagaaagaagctgagaccaaggtggctcgacgcccggacctacagcgaccccttggctctgcgcgagttcaaggaatttgcagccggtagaaggtcagtcagtggcgatctaatcctggagattgggaaactccctcagcaccttacacagcgggctcagaatgccctggacaacttagttatgttgcataatagcgaacaaggaggccgagcatatagacacgcgatggaggagctgccggatactatcgaaaccctcatgctgcttgccctgattgctgtgctcacaggtggggtaaccttgttctttctgtccggccgcggattaggcaagacttctatcgggctactgtgtgtgatggccagctccgtcctcctttggatggcatcagtggagccacattggatagctgcctctatcattctggagttctttttgatggttctgctcatccccgagcctgacaggcagcggacgccccaggataaccagctggcatacgtggtcattggacttctcttcatgatcctgaccgtagccgctaatgagatgggtttgctggaaacaactaaaaaggacttaggcatagggcacgtggcggccgagaaccaccatcacgcagctatgctagatgttgacctgcatccagccagtgcctggaccctctacgcagtggctacaaccattatcactcctatgatgcgtcacacaattgaaaacacgaccgccaatatctcgcttactgcgatagctaaccaagccgcaatcctgatgggattggataaaggctggcccattagcaagatggacatcggtgtcccactgctcgccctggggtgctattcccaggtgaatcctcttacattaaccgctgcagtcctgatgctcgtggcccattacgcgattatcggcccgggattgcaggctaaggccaccagagaggcacagaaaaggacagccgctggcataatgaagaaccccactgttgatgggattgtggccatcgacctggatccagtagtgtatgacgcaaaatttgaaaagcagctaggacagatcatgctgctcattctttgtacgtctcagatcctgttgatgcgcaccacatgggctctgtgcgagtcaataactctcgccaccggccctctgacaaccttatgggagggtagccccgggaaattctggaatactacgattgcggtctccatggccaacatcttccggggaagttaccttgcaggcgctggtctggccttttctctcatgaaaagcctaggcgggggacgaagaggcacaggggcacaaggagaaaccctgggcgagaagtggaaaaggcagttgaatcagctgtcaaagtccgagttcaacacttataaacgcagtggtattatggaggttgaccggagcgaagctaaggaggggctcaaaagaggagagaccacaaagcacgccgtgtctcgtggcactgccaaacttaggtggtttgtcgaacggaatctggtgaaaccagagggtaaggtaatcgatttgggctgtgggcgcggaggctggtcctactattgcgcggggctgaaaaaggtgaccgaagttaaaggatacacaaagggcggtcctgggcacgaggaacccataccgatggctacgtacggatggaacctcgtgaaattacattcaggcaaggacgtcttctttatcccacctgagaagtgtgataccctgctttgcgacattggcgagagctcgcccaatccaactatcgaagaggggcgaacactgagagtgctaaaaatggtcgaaccctggctcaggggaaaccagttctgtattaagatcctgaatccttatatgccgtctgtggttgagaccttggagcaaatgcagcggaaacacggtggcatgctggtacgcaaccccctcagtagaaattccactcatgaaatgtactgggtgagctgcgggacaggaaacattgtctcagcagtgaatatgacctccaggatgcttctgaaccgatttacgatggcccaccggaagccaacctatgagcgtgatgttgacttaggcgctggtacaagacacgtggccgtcgaacctgaggtggcaaacctggatatcatagggcagcgcattgaaaatatcaaacatgagcacaagtctacttggcattacgacgaggataacccctataagacctgggcctaccacggaagctatgaagtaaaacctagtggctccgctagctctatggtgaatggcgttgtcaagttgctcacaaaaccatgggacgtgatccccatggtgactcagattgcgatgaccgatacaacccctttcgggcaacagagggtctttaaggagaaagttgacactcggacgccaaaggccaagagaggaacagcacagataatggaagtgaccgctaaatggctgtggggtttcctatcacgcaacaagaaacccaggatctgtactcgagaggaatttacccggaaggtaagaagtaatgccgcaattggcgccgtgttcgtcgacgagaaccaatggaactccgctaaagaggccgtggaagatgagaggttttgggaccttgttcatcgcgaacgtgagctgcacaagcaggggaagtgcgcgacatgcgtgtacaacatgatgggaaaacgggaaaagaaactcggcgagttcggtaaggcaaaagggagcagagccatctggtacatgtggctgggagctaggttcttggagtttgaagccctgggcttcatgaatgaggatcactggttttctcgcgaaaactcgctctcaggcgtcgagggggagggacttcataagctgggttatattttacgagacatcagcaaaataccgggcgggaatatgtacgcagatgacacggctggatgggatacccggatcactgaagacgatctgcagaacgaggccaagattacagacatcatggaacctgagcacgctttgctcgccaagtccattttcaaactgacctatcagaataaggtggtaagagttcaaaggccagccaaaaacggcactgtgatggatgtcatcagtcgcagagaccagcggggttctggacaggtgggaacatacggcctaaatacctttacaaacatggaagcgcagcttataaggcaaatggagagcgagggcattttctccccctcagaactggagactcctaacctcgccgggcgtgtgctggattggttggaaaagcatggagtcgagcgattaaaacgcatggctatcagtggtgacgactgtgttgtgaagccaatcgatgacagatttgccaccgcactgacggctctcaatgatatgggcaaggtacggaaagacattccccagtgggaaccgtctaaggggtggaacgattggcaacaggtgcctttctgcagccaccactttcatcaacttataatgaaagacggaagggagatcgtcgtgccctgtcgcaatcaggatgagctggttggcagagcccgggtgtcccagggtgcagggtggtcactaagggaaaccgcctgcctgggaaagagctatgcgcagatgtggcaactcatgtacttccaccgacgtgacttgagactggctgccaacgcaatttgttctgccgtcccagtggattgggtacctacatcccgcactacctggagtatccatgctcaccatcagtggatgacaactgaggacatgcttagcgtttggaatcgggtgtggattgaagagaacccctggatggaagataaaacccacatctcgtcctggggcgacgtcccatatctgggcaagagggaggaccagtggtgcgggtctctcataggattaacggccagagcaacatgggctaccaatatccaagtggccattaaccaggttcgccggctgatcggtaatgagaactacttggattacatgacttcaatgaagaggtttaaaaatgaaagcgaccccgagggcgcgctgtggtga

SEQ ID NO: 13665 - RNA, 9879 nt, synthetic construct
  misc_feature 1..9879: note = derived and/or modified CDS sequence (opt3) from DENV-1__FJ859029__SS-prME
  source 1..9879: mol_type = other RNA
agcgtgaccatgctgctcatgcttatgcccactgccctggctttccacttgactacgagaggaggggaacctcatatgatcgtctccaagcaggaaaggggaaagtctttactgtttaagacctcagctggtgttaacatgtgcactctaattgccatggacctcggcgagttctgtgaagatactatgacctacaaatgcccgcggataaccgaagcggaaccggacgatgtggactgttggtgcaatgctaccgatacttgggtaacctatgggacctgtagtcagacgggagaacaccgccgagacaagcgtagcgtggccctggcaccccatgtcggccttggtctggagactagaaccgaaacatggatgtcctctgagggggcctggaaacagatccagaaggtggaaacttgggctttgaggcaccctggatttaccgttattgcactcttcctggcccatgctatcggcacgtcgattacccagaagggcatcatatttatcctgctcatgttagtgacgccatcaatggccatgcggtgcgtcgggattggaagccgcgatttcgtggagggtctgagtggcgcgacttgggtagacgttgtgcttgagcacgggtcctgtgtcacaaccatggcaaaagataagcccactttggacatcgaactgctaaaaacagaggtgaccaaccctgccgtgctcagaaagctgtgcattgaagctaaaatctctaatacgaccacagatagtaggtgtccaactcaaggagaggccacccttgtcgaagaacaggacgcaaactttgtttgccggcgcacattcgtggatcgaggctggggtaatgggtgtggactgtttggcaagggctccttgataacttgcgctaagttcaaatgcgtaaccaagctcgaggggaaaacagtgcagcacgaaaacctgaagtactcagtcattgtgaccgttcatactggagaccagcaccaagtgggtaatgagagtacggaacatggcacaaccgccactatcacaccccaggcgcctagcacagagattcagttaaccgactatggggccctgactctcgattgttctccaagaacaggacttgactttaacgaaatggtcctgttgacgatgaaagagaagtcctggctagtgcacaaacagtggttcctggatctcccgctgccctggacctcaggcgcaagcacaagccaagagacatggaataggaaggaccttctggtaacctttaagacagctcacgccaaaaagcaggaagttgtggtcttgggttctcaggagggggctatgcatactgccctcaccggcgcaacggaaatccaaacctccggaacaactaccatcttcgccggccacctgaaatgccggttaaagatggataaactgacactaaaggggactagctacgtgatgtgtaccggatcgttcaagctcgagaaagaagtcgctgagacgcagcatggtacagtgctggttcagattaagtatgagggcaccgacgcgccttgcaaaataccattttctactcaggatgaaaagggggtgacacaaaacggacgtcttatcaccgcaaatcccattgtaactgacaaagagaagcctgtcaacatcgaagccgagccacccttcggcgagtcctacatagtgattggtgctggggaaaaggccttgaaactgtcatggtttaagaaaggcagtagcatcggaaagatgttcgaggcaaccgcccgcggcgctagaaggatggccatcctcggggatacagcatgggactttggatccattggtggcgttttcacgtctgtggggaaactggtccaccagatctttggaaccgcgtatggcgtgcttttcagcggtgtatcatggactatgaagattgggataggcgtgctgttgacatggctcggactgaatagtcggtccaccagcttatctatgacatgtatcgctgttggcctggtcactctatacctcggggtgatggtgcaggccgattcaggatgcgtcattaactggaagggccgagaactgaaatgtggtagtgggatctttgttaccaatgaggtgcatacgtggacagaacagtacaagttccaagcagacagcccgaaacgcctttccgccgctatcggaaaggcctgggaggagggcgtgtgcggtattagatctgcaaccaggttggaaaacataatgtggaaacagatctcgaacgagctgaatcacattctcctggaaaacgacatgaagtttactgtagtcgtgggcgatgttgctgggatcttagcccagggcaagaagatgattcggcctcagcccatggagtataagtacagctggaaatcctggggcaaggcgaaaatcataggggccgacgtgcaaaataccacattcatcattgatggaccaaacactcctgaatgtcccgacgatcagcgcgcttggaatatctgggaggtcgaggactatggctttggtattttcaccacaaacatctggctgaaacttagagattcatacacacaggtgtgcgaccacaggttgatgagtgcagccataaaagattctaaggctgttcatgccgacatggggtattggattgaaagcgagaagaatgaaacctggaaactcgcacgtgcgtccttcatcgaggtgaagacttgtatttggccaaaatcacacacactgtggagcaacggagtactagaatctgagatgatcatacccaagatctacggcggtcctatttcccagcataattatcggccaggctactttacccaaactgccgggccgtggcacctgggaaaactcgagctggatttcgacctttgcgaaggcacaaccgtcgtggtggatgagcactgcgggaaccgaggacccagtttgagaacgactaccgtcacaggcaagatcattcatgaatggtgttgcaggagctgtaccctgcctccattacgctttaagggtgaggacgggtgctggtacggaatggagatccggcccgttaaagaaaaggaggaaaatctcgtgaaatctatggtatccgctggctcaggtgaggtggacagtttcagcctgggccttctgtgtatatcgattatgatcgaagaggtcatgagatccaggtggtctcgcaagatgttgatgactgggacactcgccgtgtttctgctactgatcatgggacagctcacctggaacgatctgattcgactttgcatcatggttggcgcaaatgctagcgaccggatggggatgggaacaacttatttggccctgatggcaaccttcaaaatgcgtcctatgtttgccgtgggcttactcttcagaaggctgacgtcacgcgaggtccttctgctaacaattggtctcagtctggtggcttccgttgaattgccaaactctctggaggaattaggggatggactcgcgatgggcataatgatcctgaaacttctgaccgactttcagagccaccaattgtgggccactctcctgtccctaaccttcattaagacaactttttcactgcattacgcatggaaaaccatggctatggtgcttagcatcgtcagtctcttccccctgtgtttgtctacgacatcccagaagaccacttggctgccggtattactcggcagcctggggtgcaaacctcttacaatgtttctgattgccgagaataagatctggggacggaaatcgtggccattgaacgaaggtataatggccgtgggcatcgtttcaattctcctgtctagtctactgaagaacgatgtgccccttgctgggcctctcatcgcaggaggcatgctgattgcctgttatgtcatctccggtagctctgcggacttgagcttagagaaagctgccgaggtgtcctgggaagaggaagcagagcactcaggggccagtcataatatactggtagaagtgcaggatgacggaaccatgaagattaaggatgaggagagagacgatactctcacaatcctgcttaaagctaccctgttggcagtcagcggcgtttaccccctatctatcccagccacgctgttcgtgtggtatttctggcagaagaaaaagcaaaggtccggcgtgctctgggacactccttcacccccagaagtcgagcgagcggtgctggatgacgggatttaccgcataatgcagcggggacttttaggtagaagtcaggttggcgtaggggtgtttcaggaaaacgtcttccacaccatgtggcacgtgacaaggggagctgttctgatgtatcaaggcaaacgtctcgagccgagctgggcctccgtgaagaaggacttgatctcttacggtgggggatggcgcctgcagggctcgtggaataccggcgaggaagtccaggtgattgcagtagagcctgggaaaaaccccaagaatgtccagacagccccaggaacttttaaaaccagcgaaggtgaggtgggcgctatcgccctcgatttcaagcccgggacgtcaggatcccctattgttaaccgggaaggcaaaatcgtgggtctgtacgggaatggagtcgtgacaacaagtggcacctatgtttctgcaatagctcaagccaaggcgagccaggagggcccacttcccgagatcgaagacgaggtgtttagaaagaggaacctgacaattatggatttgcatcctgggtccggaaaaacccgacggtacctaccggccatcgtccgcgaagcaattaagagaaaactgaggactctcatcttagctccaacccgggtggtagcctcagagatggctgaagcactgaagggtatgcccatacgatatcagacaacggccgtgaaaggcgagcacactgggaaggagattgttgaccttatgtgccatgccaccttcacaatgagactgctctctcctgtccgcgtgccaaattacaacatgatcatcatggatgaagctcactttaccgaccccagcagtattgcggcaaggggatatatctccactcgtgtgggcatgggtgaggccgctgccatattcatgacagcaacccctccggggagcgtcgaagcctttccccaatctaatgctgtaattcaggatgaggaacgggacatcccagagagatcatggaactccggatacgagtggattacggatttccctggcaagactgtgtggtttgttcccagtatcaaaagcggcaatgacatagcgaactgtttgaggaagaatgggaaacgcgtgattcagctgtcgcgaaagacattcgataccgaatatcagaaaaccaagaacaacgactgggactacgtcgtgactacagatatctctgagatgggagccaatttcagagcagaccgggttatcgatccaaggcgctgcctcaagcctgtgattctgaaagacggtcccgaacgtgtcatccttgctggcccaatgccggtgaccgtagcctccgcagcccaaagacgggggaggattggacgcaaccataataaggagggcgatcagtacatatatatgggtcagcctctaaacaatgacgaggatcacgctcactggacagaagccaaaatgctgttggacaacatcaatactcccgaggggattatcccagcgttatttgaacccgagcgagaaaagagcgcagccatcgatggcgagtacagactgcggggagaggctaggaaaacgttcgtggaactcatgcgcagaggcgacctgcctgtttggctttcatataaggtcgccagtgaggggtttcagtactctgataggcggtggtgcttcgacggagaacgtaacaatcaagtgctggaggaaaacatggatgtggagatttggaccaaagagggtgaacgcaagaagctccgaccaagatggttggacgctaggacatattccgaccccctggcactacgggagtttaaagagttcgccgctggccgcagaagcgtctcaggggatctgatactcgagatcggaaaacttcctcagcatctgactcagagggcccagaatgcattagacaacttggttatgctgcacaatagtgaacaaggcggtcgggcgtaccgacatgccatggaggagctcccggataccattgaaacactgatgcttctggctctcatcgccgtgttgaccgggggcgtaactctgtttttcttaagcggaagaggcctagggaaaacgtccattggactgctctgtgtgatggcatctagcgcacttctgtggatggcctccgtcgagccacactggatcgcagcctcaataatcttggaatttttcctgatggtgctcctgattcccgagcctgaccgccagaggacaccccaggataaccagcttgcttatgttgtgatcggtctcctgtttatgattttgacagtcgcggccaatgagatgggcctgttagaaactaccaagaaagacctagggatcggacacgtagcagtggagaaccatcaccatgctgccatgctggatgttgacctccacccagcctctgcatggacactttacgctgtggccaccactataattacacctatgatgcggcatacgatcgaaaacaccactgcgaatattagtctgacagctatcgccaaccaagcagccatattgatgggcctggataagggttggcccatctcgaagatggacattggggtcccactcctggctcttggctgctacagccaggtgaatcctttaaccctgaccgcagccgtcctcatgttggtggcgcactatgctatcattggaccgggcctgcaggccaaagcaacacgtgaggcccaaaagagaactgctgccgggatcatgaaaaaccccacggttgatggaatagtggcaattgacctagatccagtagtgtacgacgctaagttcgaaaaacagctgggccagatcatgctccttgtcctgtgtacctcccagatcttgctgatgaggacaacttgggccctctgcgagtctattaccctggcgacaggtcctttaaccactctttgggaggggtcacccggaaagttttggaatacgacaatcgccgttagcatggcaaacatattccgcggctcctatctggctggtgccggcctcgcattcagtctaatgaagtctctagggggaggccggcgagggaccggagctcaaggcgaaactttgggtgagaaatggaagagacagctgaatcagctcagcaaatcagaatttaacacctacaagaggtccgggattatggaggtggaccgcagtgaagccaaagagggacttaagcggggcgagacaactaagcacgccgtcagcagaggtaccgcgaaactgcgttggttcgtggaaaggaatttggtaaagccagagggcaaagtgatcgatctggggtgtggacggggcgggtggtcttattactgcgctggactcaagaaagttacagaagtgaagggctatacgaaaggtgggcctggacatgaggaacccattccgatggcaacctacggctggaacttagtcaagctgcactccggcaaggacgtgtttttcatcccacctgagaaatgtgatactcttctgtgcgacataggggagtcaagccccaatccaacaatcgaagagggacgcaccctacgagtcctcaagatggtggaaccctggctgagaggtaaccagttttgtattaaaatcttgaatccttacatgccgtcggttgtagagactctggagcaaatgcagaggaagcatggcgggatgctcgtgcggaaccccctttctcgcaatagtacacacgaaatgtattgggtctcctgcggaaccggcaacattgtgagcgccgttaatatgacgtcaagaatgctgttaaacaggttcaccatggctcaccgaaaaccaacatacgagcgggatgtggacctgggtgccgggactcgtcatgtcgcagtggaacctgaggtagccaacttggatatcattggacagagaatcgaaaatataaagcacgagcataagtccacctggcactatgacgaggataacccctacaaaacatgggcttatcatggctcttacgaagcgaagcctagcggcagtgcctccagcatggtgaatggggttgtcaaactcctgactaagccatgggacgtgattcccatggtgacccagatcgcaatgacagataccactccttttggacaacagcgcgtcttcaaagagaaggttgacacgaggacaccaaaggctaaacggggtaccgcccagatcatggaagtgactgcaaagtggctatggggctttctttctagaaacaaaaagccccgcatttgtaccagggaggagttcacacgaaaagtacggtcaaatgccgctataggggccgtgtttgtcgacgagaaccaatggaatagtgcgaaggaggcagtggaagatgagagattctgggacctggttcacagggaacgcgagctccacaagcagggaaaatgcgccacgtgcgtgtataacatgatgggcaagcgtgagaagaagctgggtgagtttgggaaagctaagggatcccgggccatctggtacatgtggttgggcgcaagattcctggagttcgaagctctcggctttatgaatgaggatcattggttcagcagggaaaactctctttcgggggtcgagggagagggtctgcacaaattaggctacattctgcgcgacatctcaaagattccagggggaaatatgtatgccgatgacaccgctggctgggatactcgaatcacagaagacgatttgcagaacgaggccaagataaccgacatcatggaacctgagcatgcactcctggcgaaaagcatttttaagctaacttaccagaataaagtggtacgggttcaaagaccagccaagaacggtacagtgatggatgtcatctccaggcgcgaccagagagggagtggacaggtgggcacctatggccttaatacattcactaacatggaagctcagctgattcggcaaatggagtctgaggaaatctttagcccctccgagctcgaaacccctaacctggccgggagggtgttggattggttagagaaacacggagtcgaacgtctgaagcgaatggcaatatcaggtgacgactgtgttgtgaagccaattgatgaccgcttcgctacggccctcaccgcacttaatgatatgggcaaagtaagaaaggacatcccccagtgggagccgagtaaagggtggaacgattggcaacaggtgcctttttgctctcaccatttccaccaactgatcatgaaggacggacgggagattgtcgtgccctgtaggaatcaggatgagctggttggccgcgccagagtgagccagggtgcggggtggtccctgcgggagacagcttgcctcggaaaatcatacgcccagatgtggcaattgatgtattttcataggcgagacctgcgtcttgcagccaacgctatatgtagcgccgtcccagtggattgggtacctacttctagaaccacatggtccatccacgcacatcaccagtggatgactaccgaagacatgctgagtgtttggaatcgcgtgtggattgaggaaaacccctggatggaggataagacgcacatcagctcgtggggcgacgtcccatacctcggcaagcgggaggaccagtggtgcgggtccttaattggactgacagctagggccacctgggcgactaatatccaagtggctataaaccaggttagacgcttgatcggtaatgaaaactatctggattacatgacatctatgaaacggttcaagaatgagtcagaccccgaaggcgccctctggtga

SEQ ID NO: 13666 - RNA, 9879 nt, synthetic construct
  misc_feature 1..9879: note = derived and/or modified CDS sequence (opt3) from DENV-1__FJ547065__SS-prME
  source 1..9879: mol_type = other RNA
agcgtgaccatgctgctcatgcttatgcccaccgcactggctttccacttgactacgcggggaggggaacctcatatgatcgtctccaagcaggaaaggggaaaatctttactgtttaagacctcagccggtgttaacatgtgcacgctaattgccatggacctcggcgaactgtgtgaagatactatgacctacaaatgcccacggattacagagaccgaaccggacgatgtggactgttggtgcaatgcgactgatacatgggtgacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaggacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaggcccctacaaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccgggagcttcaaactggagaaggaagtcgccgagacgcagcacggtacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattgtgatcggtgccggggaaaaagctctgaagctctcctggttcaagaaaggctcaagtatcggaaagatgtttgaggccaccgcaagaggcgccaggcggatggctattctgggggatacagcctgggacttcggaagcatcggtggcgtttttacgtccgtggggaaacttgtccatcagattttcggaaccgcatacggcgtgctgttttctggtgtaagctggactatgaagatagggatcggcgtgttgctcacatggctgggattaaattcacgaagtacctccctgagcatgacatgtattgcggttggcctagtcactctctacctgggggtgatggtgcaggctgattctggatgcgtcatcaactggaaaggccgcgaacttaagtgtggttcagggatcttcgttaccaatgaggtgcacacgtggacagaacaatataagtttcaggccgacagtccgaaaagattgagcgcagccattggaaaggcttgggaggagggcgtgtgcggtataaggtccgccacccggctggaaaacatcatgtggaaacagatttctaacgagctcaatcatatcctgttagaaaacgacatgaagttcactgtagtcgtgggcgatgttgcagggattctggctcagggcaaaaagatgatccgccctcaacccatggagtacaaatattcgtggaaaagctggggcaaggccaagataatcggggcggacgtgcagaataccacatttattatcgatggaccaaacactcctgaatgtcccgacgatcttagagcctggaatatttgggaggtcgaggactacggcttcggtatctttaccacaaacatatggttgaagctcagggattcctatacacaggtgtgcgaccaccgtctgatgtcagctgcaattaaagatagtaaggccgttcacgctgacatggggtactggatcgaatctgagaaaaatgaaacctggaagctagcccgggcatccttcattgaggtgaagacttgtatctggccaaaatcccatacactgtggtcaaacggagtactcgaaagcgagatgataatccccaagatttatggcggtcctatctctcagcacaattaccgaccaggctacttcacccaagcggccgggccgtggcatctgggaaaacttgagttggattttgacctgtgcgaaggcactacagtcgtggtggatgagcactgcgggaacagaggaccctccttaaggaccacgactgtcaccggcaagattatccacgaatggtgttgccgcagttgtacactccctccactgcggttcagaggtgaggacgggtgctggtatggaatggagataaggcccgttaaagaaaaggaggaaaatcttgtaaagagcatggtatctgctggctccggtgaggtggactcatttagtctgggcttgctctgtattagcatcatgatcgaagaggtcatgcgctcgcgatggtcccggcgtatgctgatgaccgggactctagccgtgttctttctgctcattatgggacagctgacatggaacgatcttatcagattgtgcattatggttggcgcaaatgcttctgacaggatggggatgggaaccacatacctggccttaatggcaactttcaaaatgcgccctatgtttgccgtgggcctcctgttccggagacttaccagcagggaggtcctgctactcacgataggtctgtcattggtggctagtgttgaactgccaaactccttagaggaactcggggatggactggcgatgggcatcatgattcttaagctgttgacagactttcagtctcatcaactctgggccaccctgctaagcctgactttcatcaaaaccacattttcccttcactatgcatggaagactatggctatggtgctctcaattgtcagcctgttccccttgtgtctgagtaccacgtctcagaaaacaacctggttaccggtactcctgggctcccttgggtgcaagcctctgactatgtttttgatcgccgagaataagatatggggacgacgcagctggccactcaacgaaggtatcatggccgtgggcattgtttcgatcctgctatcatctctgcttaaaaacgatgtgcccctcgctgggcctctgattgcaggaggcatgttgatcgcctgttacgtcataagtggttccagcgcggacttatctctggagaaggctgccgaggtgagctgggaagaggaagcagagcattccggggcctcacacaatattctcgtagaagtgcaggatgacggaacaatgaaaatcaaggatgaggagcgggacgataccctgactatccttctgaaagctacattgctagcagtcagtggcgtttatcccctgagcattccagccaccctcttcgtgtggtacttctggcagaagaaaaagcaaagatctggcgtgctgtgggacacgccttcacccccagaagtcgagagggcggtgcttgatgacgggatatatcgtatcatgcagcgcggattactgggtcggagccaggttggcgtaggggtgtttcaggaaaacgtcttccatactatgtggcacgtgaccagaggagctgttctcatgtaccaaggcaagaggttggagccgagttgggccagcgtgaaaaaggacctgatttcctacggtgggggatggcgactccagggctcttggaatacaggcgaggaagtccaggtgatcgcagtagagcctgggaaaaaccccaagaatgtccagaccgccccaggaacatttaaaactcccgaaggtgaggtgggcgctattgccctggatttcaagcctgggacctcgggaagcccaatcgttaaccgggaaggcaagatagtgggtctttatgggaatggagtcgtgacgacatcaggcacttacgtttccgcaatcgctcaagccaaagcgagtcaggagggccccctgcctgagattgaagacgaggtgtttcgcaagagaaacttgaccatcatggatctacacccggggtctggaaaaacaaggcggtatctgccagccattgtccgagaagcaatcaagagaaaactccgcaccttaatactggctcccactagggtggtagccagcgagatggctgaagcacttaagggtatgcctattcgttaccagaccacagccgtgaagtccgagcatacgggcaaagagatcgttgacctgatgtgccacgccactttcaccatgcggctcttgtcaccagtcagagtgcccaattataacatgatcattatggatgaagctcattttacagacccttctagcatcgcggcaagggggtacataagtacccgcgtgggaatgggcgaggccgctgccattttcatgactgcaacaccgcccggttccgtcgaagcctttccacaaagcaatgctgtaatccaggatgaggaacgagacattcctgagagatcttggaactcagggtatgagtggatcaccgatttccccggaaagacggtgtggtttgttccatccataaaaagtggcaatgacattgcgaactgtctgcggaagaatggcaaaagggtgatccagctcagccgcaagactttcgatacagaataccagaagacccgtaacaacgactgggactacgtcgtgaccactgatatctcggagatgggggccaatttcagagcagaccgggttattgatcctaggcgctgcctgaaacccgtgatccttaaggacggaccagaacgagtcattctagctggtccgatgcctgtgacagtagcctctgcagcccaaagacggggcaggatagggcgcaaccacaataaagagggagatcagtatatctacatgggccagcccctgaacaatgacgaggatcatgctcactggaccgaagccaagatgttgttagacaacattaatacaccagagggtatcatccccgcgctgtttgaacctgagagagaaaaatccgcagccattgatggggagtataggctccggggcgaggctcgtaagactttcgtggaactgatgcgccgaggagaccttccagtttggctgagctacaaggtcgcctcagagggctttcagtatagtgatagaaaatggtgcttcgacggggaaaggaacaatcaagtgctcgaggaaaacatggatgtggagatatggacgaaggagggagaacggaaaaagttgcgccccagatggctggacgctaggacctactctgaccctctagcactgcgggagtttaaagagttcgccgctggtcgaagatccgtcagcggcgatctcatccttgagattgggaagctgccgcagcacttaacacagcgcgcccagaatgcattggacaacctggttatgctccataattcagaacaaggaggcagggcgtatcggcacgccatggaggagctgccagatactatcgaaacccttatgctgctcgctttgattgccgtgctgacaggtggggtaaccttatttttcctaagtggccgtggactgggcaaaactagcatcgggctcctttgtgtgatggcatcctctgtcctgttgtggatggctagcgtggagccccattggatagccgcatccatcattctggaatttttcctcatggttctgcttatccctgagcccgacagacagaggacgccacaggataaccagctcgcctacgtggtcattggactgttgtttatgatcctgaccgtagctgcgaatgagatgggtttactagaaacaactaagaaggacctgggcatagggcacgtggccgttgagaaccaccatcacgcagctatgctcgatgtggaccttcatcctgcctcagcctggaccctgtacgcagtcgctacaaccattatcactcccatgatgcgccacacaattgaaaacacgaccgccaatatctctttgactgcgatagctaaccaagccgcaatcctgatgggactcgataaaggctggccaattagtaagatggacatcggtgtgcctctgcttgccttagggtgctattcgcaggtcaatccgctgacactcaccgctgcagtgttgatgctggttgcccattacgcgattatcggccccggactacaggctaaagccacccgggaggcacaaaagcgaacagccgctggcataatgaaaaacccaactgtggatgggattgtagccatcgacctggatcctgtggtctatgacgcaaagttcgaaaagcagctcggacagatcatgcttctgattttgtgtacgagccagatcctgctcatgagaaccacatgggctctgtgcgagtccataactttagccaccggcccccttacaaccctgtgggagggttctccagggaaattttggaatactacgattgcggtttcaatggccaacatcttcaggggaagctacctcgcaggcgctggtctagccttctccctgatgaagagtttgggcgggggacgccggggcacaggggcacaaggagaaaccctgggcgagaaatggaagagacagctcaatcagctttctaaaagcgaatttaacacttataagcgttcaggtattatggaggtggacaggtccgaagctaaggaggggctgaaacggggagagaccacaaagcacgccgtcagtcgcggcactgccaaattgcgatggttcgtggaaagaaatctggtaaagcctgagggtaaagtgatcgatctcggctgtgggaggggaggctggagctactattgcgcggggttaaagaaggttaccgaagtgaaaggatacacaaagggcggtcccgggcacgaggaaccgataccaatggctacgtacggatggaacctggtcaaacttcattctggcaaggacgtgtttttcatccctcccgagaaatgtgataccctgctatgcgacattggcgagtcctcaccaaatcccactatcgaagaggggcggacactccgcgtcctgaagatggtggaaccttggttgagaggaaaccagttttgtattaaaatcctgaatccgtatatgcccagcgttgtagagaccctcgagcaaatgcagaggaagcacggtggcatgcttgtgcgaaacccactgtcgagaaattctactcatgaaatgtactgggtcagttgcgggacaggaaacattgtgtccgcagttaatatgaccagccgtatgttactgaacagattcacgatggcccaccgcaagcctacctatgagagggatgtggacttgggcgctggtacacggcacgtcgccgtggaacccgaggtagcaaacctcgatatcatagggcagagaattgaaaatatcaaacatgagcacaagtcaacttggcattacgacgaggataacccttataaaacctgggcctaccacggatcctatgaagtgaagccatctggcagcgctagttccatggttaatggcgtcgtgaaactgctaacaaagccctgggacgtgatccctatggtcactcagattgcgatgaccgatacaaccccatttgggcaacagcgcgttttcaaggagaaagtggacactaggacgcccaaggccaaacgaggaacagcacagataatggaagtaaccgctaagtggctttggggttttctgagccggaacaaaaagccgagaatctgtactagggaggagttcacccgcaaggtgcgttctaatgccgcaattggcgccgtctttgtggacgagaaccaatggaactcagctaaagaggccgttgaagatgagcggttctgggacctcgtgcatagagaaagggagctgcacaagcaggggaaatgcgcgacatgcgtctacaacatgatgggaaagcgcgagaaaaagttgggcgagtttggtaaggcaaaagggagtcgagccatctggtacatgtggctgggagctcggttcctcgagttcgaagcccttggctttatgaatgaggatcactggttctccagagaaaacagcctgtctggcgtggagggggagggattacataagctgggttatattttgagggacatctcgaaaatacctggcgggaatatgtacgcagatgacacggctggatgggatacccgcatcactgaagacgatctccagaacgaggccagaattacagacatcatggaaccagagcacgctctgctagccaagtcaatttttaaacttacctatcagaataaggtagttcgggtgcaaaggcccgccaaaaatggcactgtcatggatgtgatcagccgtcgagaccagcgcggttccggacaggtgggaacatacggcctgaataccttcacaaacatggaagcgcagctcataagacaaatggagagtgagggcatattttctcctagcgaactggagactccaaacttggccgaacgggtcttagattggctggagaagtatggggttgaaaggctcaagcgcatggctatctccggagacgactgtgtggtaaaacccatcgatgacagattcgccaccgcacttacggctctgaatgatatgggtaaggtgcggaaagacattccgcagtgggagccttcaaagggctggaacgattggcagcaggtccccttttgcagtcatcacttccaccaactaataatgaaagacgggagggagatcgtggttccatgtcgaaatcaggatgaactggtgggacgtgccagagtctctcagggcgcaggttggagcctccgcgagaccgcctgcttggggaagtcctacgcgcagatgtggcaactgatgtattttcatcggagggaccttagactggctgccaacgcaatttgttcagccgtgcctgtagattggatccccacaagccgcactacctggtctattcacgctcatcaccagtggatgacaactgaagacatgctctccgtttggaatcgggtgtggatcgaggaaaacccatggatggaggataagacccatataagtagctggggagacgtcccctacttaggcaaaagggaggaccagtggtgcggctcgctgatcgggttgacggcccgagcaacatgggctaccaatattcaagtggccatcaaccaggttagacggctgattggaaatgaaaactacctcgattatatgacttccatgaagaggttcaaaaatgagtctgaccctgaaggtgcgctttggtga

SEQ ID NO: 13667 - RNA, 9879 nt, synthetic construct
  misc_feature 1..9879: note = derived and/or modified CDS sequence (opt3) from DENV-1__FJ410230__SS-prME
  source 1..9879: mol_type = other RNA
agcgtgaccatgctgctcatgcttatgcccacagccctggctttccacttgactacgagaggaggggaacctcatatgatcgtctccaagcaggaaagaggaaaatctttactgtttaagacctcagccggtgttaacatgtgcacactgattgccatggacctcggcgagctgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgatcggcgccacggaaattcagacctctggaacaactaccatatttgcaggccatttaaaatgccgtctgaagatggataaactaacactcaaggggatgtcctatgtgatgtgtactgggagcttcaaactggagaaggaacttgccgagacccagcacggtacggtcttggtgcagatcaagtacgagggcacagacgctccttgcaaaattccattctcgacccaagatgaaaagggggttactcagaacggacgcctgatcacagcgaatcccatagtgaccgacaaagagaagcctgtaaacattgaagcagagccaccctttggcgagtcttatatcgtcatcggtgccggggaaaaagctctcaagctgtcctggttcaagaaaggctcaagtattggaaagatgtttgaggccactgcaagaggcgccaggcggatggctatccttggggataccgcctgggacttcggaagcattggtggcgtgtttacatccgttgggaaactggtgcatcagatattcggaacggcatacggcgtcttgttttctggtgtgagctggaccatgaagatcgggattggcgtactcctgacttggttaggactaaattcacgaagtacatccctaagcatgacctgtatcgcggtgggcctcgttacactgtaccttggggtcatggtgcaggctgattctggatgcgtgatcaactggaaaggccgcgaattgaagtgtggttcagggattttcgtcactaatgaggttcacacctggacggaacaatataagtttcaggccgacagtccgaaaagactgagcgcagccataggaaaggcttgggaggagggcgtgtgcggtatcaggtccgccacacggctcgaaaacattatgtggaaacagatctctaacgagctgaatcatattttactggaaaacgacatgaagttcaccgtggtagtcggcgatgtggcagggatccttgctcagggcaaaaagatgatacgccctcaacccatggagcacaaatactcgtggaaaagctggggcaaggccaagatcattggggcggacgttcagaatactacctttatcattgatggaccaaacacacctgaatgtcccgacgatcagagagcctggaatatctgggaggtggaggactatggcttcggtatatttactaccaacatttggttgaagctcagggattcctacacacaggtctgcgaccaccgtctgatgtcagctgcaatcaaagatagtaaggccgtgcatgctgacatggggtattggattgaatctgagaaaaatgaaacgtggaagctagcccgggcatccttcatcgaggttaagacctgtatatggccaaaatcccacactctgtggtcaaacggagtgctcgaaagcgagatgatcattcccaagatctacggcggtcctatttctcaacataattatcgaccaggctacttcacacagaccgcggggccgtggcacctgggaaaacttgagttggattttgacctgtgcgaaggcactacagtagtcgtggatgagcactgcgggaacagaggaccctccttaaggaccacgactgtgaccggcaagatcatacatgaatggtgttgccgcagttgtacactccctccactgcggttcagaggtgaggacgggtgctggtacggaatggagattaggcccgtcaaagaaaaggaggaaaatcttgttaagagcatggtgtctgccggctccggtgaggtagactcatttagtctgggcttgctctgtatcagcatcatgattgaagaggtgatgcgctcgcgatggtcccggaaaatgctgatgaccgggactctagctgtcttctttctgctcatcatgggacagctgacatggaacgatcttattcgtttgtgcataatggtgggcgccaatgcatctgacagaatggggatgggaaccacatatctggctttaatggccactttcaagatgaggcctatgtttgcagttggcctcctgttccgccggcttaccagcagagaggtgctgctactcacgatcggtctgtcattggtcgccagtgtggaactgccaaactccttagaggaactcggggatggactggctatgggcattatgatccttaaactgttgacagactttcaatctcaccagctctgggcgaccctgctaagcctgactttcattaagaccacattttcccttcattacgcctggaaaactatggcaatggttctctcaatcgtgagcctgttccccttgtgtctgagtaccacgtctcagaagacaacctggttaccggtcctcctgggctcccttgggtgcaagcctctgactatgtttttgatagctgagaataaaatctggggaaggcgaagctggccactcaacgaaggtattatggccgtaggcatcgtgtcgattctgctatcatctctgcttaagaacgatgttcccctcgccgggcctctgatcgctggaggcatgttgatagcatgttatgtgattagtggttccagcgccgacttatctctggagaaagcggctgaggtcagctgggaagaggaagccgagcactccggggcatcacataatatcctcgtggaagtacaggatgacggaacaatgaagatcaaagatgaggagcgcgacgataccctgactattcttctgaaggccacattgctagctgtgagtggcgtctaccccctgagcataccagcaaccctcttcgtttggtatttctggcagaaaaagaagcagcggtctggcgtgctgtgggacacgccttcacccccagaagtggagagagccgtccttgatgacgggatctacaggattatgcagcgtggattactgggtcgcagccaggtgggcgttggggtatttcaagaaaacgtgttccacactatgtggcacgtcacccggggagcggtgctcatgtatcagggcaaaagattggagccgagttgggctagcgttaagaaagacctgatctcctacggtgggggatggaggctccagggctcttggaatacaggcgaggaagtgcaggtcattgccgtggagcctgggaagaaccccaaaaatgtacaaaccgcaccaggaacatttaagactcccgaaggtgaggtcggcgccatcgctctggatttcaagcctgggacctcgggaagcccaatagtgaaccgagaaggcaaaatcgttggtctttacgggaatggagtggtcacgacatcaggcacttatgtgtccgccattgcacaggctaaggccagtcaggagggccccctgcctgagatcgaagacgaggtttttcggaaacgcaacttgaccattatggatctacatccggggtctggaaagacaagaaggtacctgccagcgatcgtgcgggaagccataaaacgaaagctcagaaccttaattctggcacccactcgcgtcgtggctagcgagatggccgaagctcttaagggtatgcctatcaggtatcaaaccacagcagtaaaatccgagcacacgggcaaggagatcgtggacctgatgtgccatgccactttcaccatgcgtctcttgtcaccagttcgggtccccaattacaacatgattatcatggatgaagcccactttacagacccttctagcatagctgcgagagggtatattagtaccagggtgggaatgggcgaggcagccgctatcttcatgactgccacaccgcccggttccgtggaagcatttccacagagcaatgccgtcattcaggatgaggaacgcgacatccctgagcgatcttggaactcagggtacgagtggataaccgatttccccggaaaaacggtatggtttgtgccatccattaagagtggcaatgacatcgctaactgtctgaggaaaaatggcaagcgggttatccagctcagcaggaagactttcgatacagaatatcagaaaaccaagaacaacgactgggactacgtggtcaccactgatatttcggagatgggggcgaatttccgcgccgaccgtgtgatcgatcctagacggtgcctgaaacccgttattcttaaggacggaccagaaagggtgatactagcaggtccgatgcctgtcacagtggcttctgccgcacagcgccgaggcagaatcgggcggaaccataataaagagggagatcagtacatttatatgggccagcccctgaacaatgacgaggatcacgcccactggaccgaagctaagatgttgttagacaacatcaatacaccagagggtatcattcccgccctgtttgaacctgagagggaaaagtccgcggcaatagatggggagtaccgcctcagaggcgaggccaggaaaactttcgtagaactgatgcggcgtggagaccttccagtgtggctgagctataaggttgcttcagagggctttcaatacagtgatcgccgatggtgcttcgacggggaaagaaacaatcaggtcctcgaggaaaacatggatgtggagatctggacgaaagagggagaaaggaagaaattgcggccccgctggctggacgccagaacctattctgaccctctagctctgagggagtttaaggagttcgcagccggtcggcgatccgtgagcggcgatctcattcttgagatcgggaaactgccgcagcatttaacacagagagctcaaaatgccttggacaacctggtcatgctccacaattcagaacagggaggccgcgcatacaggcatgcgatggaggagctgccagatactattgaaacccttatgctgctcgccttgatcgctgttctgacaggtggggtgaccttatttttcctaagtggccggggactgggcaagactagcatagggctcctttgtgtaatgtcctctagcgtgctgttgtggatggcctccgtcgagccccactggatcgcagcttcaattatcctggaatttttcctcatggtgctgcttattcctgagcccgaccgtcagagaacgccacaggataaccaactcgcctatgttgtgatcggactgttgtttatgatactgaccgtcgcagccaatgagatgggtttactagaaacaactaagaaagacctgggcattgggcacgtagctgtggagaaccatcaccatgcggccatgctcgatgttgaccttcaccctgcatctgcttggaccctgtacgccgtggccacaaccatcattactcccatgatgaggcatacaatcgaaaacacgaccgcaaatataagtttgactgctatcgccaaccaggcggctattctgatgggactcgataagggctggccaatctcgcgcatggacattggtgtccctctgcttgccttagggtgctacagccaggtgaatccgctgacactcaccgcagccgtcttgatgctggtggctcactatgcaatcataggccccggactacaagccaaagcgacccgggaggctcagaagcgaacagccgcaggcattatgaaaaacccaactgttgatgggatcgtggccatcgacctggatcctgtagtgtacgacgctaagttcgaaaagcagctcggacagattatgcttctgatcttgtgtacgtcccaaatactgctcatgagaaccacatgggccctgtgcgagtctattactttagcaaccggcccccttacaaccctgtgggagggttcaccagggaaattttggaatactacgatcgctgtcagcatggccaacattttcaggggatcctatctcgcgggcgccggtctagcattcagtctgatgaagtctttgggcgggggacgccggggcacaggggctcagggagaaaccctgggcgagaaatggaagagacagctcaatcagcttagcaaatcagaatttaacacttacaagcgttccggtatcatggaggttgacaggagtgaagccaaggaggggctgaaacggggagagaccacaaagcacgcagtgagccgcggcactgctaaattgcgatggttcgtcgaaagaaatctggtgaagcctgagggtaaagtaatagatctcggctgtgggaggggaggctggtcttattactgcgccgggttaaagaaggtgaccgaagttaaaggatatacaaagggcggtcccgggcatgaggaaccgatcccaatggccacgtacggatggaacctggtgaaacttcactccggcaaggacgtctttttcattcctcccgagaaatgtgataccctgctatgcgacatcggcgagtcaagcccaaatcccactattgaagaggggcggacactccgcgtgctgaagatggtcgaaccttggttgagaggaaaccaattttgtatcaaaattctgaatccgtacatgccctcggtggttgagaccctcgagcagatgcagaggaagcatggtggcatgcttgtacgaaacccactgtctcggaatagtactcacgaaatgtattgggtgtcctgcgggacaggaaacatcgtcagcgcggtgaatatgacctcacgtatgttactgaacagattgacgatggctcaccgcaagcctacctacgagagggatgttgacctcggcgcaggtacacggcatgtggccgtcgaacccgaggtggctaacctggatataattgggcagagaatcgaaaatatcaaacacgagcataagtccacttggcactatgacgaggataacccttacaaaacctgggcctatcatggatcttacgaagtaaagccaagcggcagtgcatccagcatggtgaatggcgttgtcaaactacttacaaagccctgggacgtgattcctatggtgactcaaatagccatgaccgatacaaccccattcgggcagcagcgcgtctttaaggagaaagttgacactaggacgcccaaggctaaacgaggaacagcgcaaatcatggaagtgaccgccaagtggctgtggggtttcctctctcggaacaaaaagccgagaatttgtactagggaggaatttacccgcaaggtacgttcaaatgcagctatcggcgccgtgttcgtcgacgagaaccagtggaatagtgcaaaagaggccgtggaagatgagcggttttgggacctggttcacagagaaagggagttgcacaagcaggggaaatgcgctacatgcgtgtataacatgatgggaaagcgcgagaaaaagctgggcgagttcggtaaggccaaagggtcccgagcgatttggtacatgtggctcggagcacggtttcttgagttcgaagccctgggcttcatgaatgaggatcattggtttagcagagaaaactctttatcgggcgtcgagggggagggactgcacaagttgggttacatcctcagggacatatcaaaaatccctggcgggaatatgtatgctgatgacacggccggatgggatacccgcattactgaagacgatctgcagaacgaggcaagaatcacagacattatggaaccagagcatgctctacttgccaagagcatcttcaaactgacctaccaaaataaggtggtacgggttcagaggcccgctaaaaacggcactgtgatggatgtcatatcccgtcgagaccagcgcggtagtggacaggtgggaacatatggcctcaatacctttacaaacatggaagcccaactgattagacagatggagtctgagggcatcttcagcccttccgaattggagactccaaacttagcagaacgggtgctggattggctcgagaagtacggggtcgaaaggcttaagcgcatggcgatctcaggagacgactgtgttgtgaaacccattgatgacagatttgccaccgctctgacggccctaaatgatatgggtaaggtacggaaagacataccgcagtgggagcctagtaagggctggaacgattggcagcaagtgcccttctgctctcaccactttcatcagctgatcatgaaagacgggagggagattgtcgtgccatgtcgaaatcaggatgaactcgttggacgtgcaagagtgagccagggcgctggttggtccttgcgcgagaccgcctgcctggggaagtcatatgcacaaatgtggcagcttatgtacttccaccggagggacctgagactcgccgcgaacgctatctgtagcgccgtccctgtggattggattcccacatctcgcactacctggtccatccatgcacaccatcagtggatgacaactgaagacatgttaagtgtatggaatcgggtttggatagaggaaaacccatggatggaggataagacccacatcagctcgtggggagacgtgccctatctgggcaaaagggaggaccaatggtgcggctccttgattgggctgacggcccgagctacatgggccaccaatatccaggtcgcaattaaccaggtgagacggctcatcggaaatgaaaactaccttgattacatgacttctatgaagaggtttaaaaatgagtcagaccctgaaggtgctctgtggtga

SEQ ID NO: 13668 - RNA, 9879 nt, synthetic construct
  misc_feature 1..9879: note = derived and/or modified CDS sequence (opt3) from DENV-1__FJ410231__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagctgtgtgaagatactatgacctacaaatgcccacggataacagaggtggaaccggacgatgtagactgttggtgcaataccactgatacatgggtgacctatgggacgtgtagtcaaactggagagcaccgccgagacaagcgtagcgtcgcgcttgctccccatgtgggcctgggtttggagaccagagccgaaacatggatgtcctctgagggggcatggaaacagatccagaaggttgaaacttgggccctcaggcaccctggattcaccgtgattgctctgtttctggcacatgccatcggcacatcgattacccagaagggcatcatattcatcctcttaatgctggtcacgccatcaatggctatgcggtgcgtggggattggaagccgcgattttgtagagggtcttagtggcgccacttgggttgacgtggtcttggagcacgggtcctgtgtgacaaccatggcgaaagataagcccactctggacatcgaactactcaaaacagaggtgaccaaccctgcagtcctgagaaagctttgcattgaagccaaaatctctaatacgaccacagatagcaggtgtccaactcaaggagaggctaccctggttgaagagcaggacgccaacttcgtgtgccggcgcacatttgtagatcgaggctggggtaatgggtgtggattgttcggcaagggctccctcataacttgcgcaaagtttaaatgcgtgaccaagctggaggggaaaattgtccagtacgaaaacttaaagtattcagtgatcgttacagtgcacaccggagaccagcatcaagtcggtaatgagagtactgaacacggcacgacagctaccattactccccaggcccctaccagcgagatccagctgacagactacggggcgctcacccttgattgttctccaagaactggactggacttcaacgaaatggtgttgctaacaatgaaagagaagtcctggctggtacataaacagtggtttctcgatctgccgcttccctggacgtcaggcgccagcaccagtcaagagacttggaataggcaggacctgttggttacattcaagaccgcacacgctaagaaacaggaagtggtcgtgctcggttctcaagagggggccatgcacacagctctgactggcgccaccgaaatccagacgtccggaaccacaactatttttgcaggccatttaaagtgccggctgaaaatggataagctaaccctcaaagggatgagctatgtcatgtgtacaggatcgttcaagctggagaaggaagtggccgagactcagcacggtaccgttcttgtgcagataaaatacgagggcacggacgctccttgcaagatcccattctctacacaagatgaaaaaggggtaacccagaacggacgtttgattactgcgaatcccatcgtcacagacaaggagaaacctgtgaacatagaagcagagccaccctttggcgagtcctatattgttatcggtgccggggaaaaggctctgaagctctcatggttcaaaaagggcagtagcatcggaaaaatgtttgaggccaccgcacgcggcgccagaaggatggctattctgggggatactgcctgggacttcggatccatcggtggcgtgtttacctctgtcgggaagcttgtgcatcagattttcggaacagcatacggcgtactgtttagcggtgtgtcatggacgatgaaaatagggatcggcgttttgctcacctggctgggattaaatagtcggtccactagcctgtctatgacatgtattgcggtcggcctagtgaccctctacctgggggtgatggtccaggctgattcaggatgcgttatcaactggaagggccgagaacttaagtgtggtagtgggatcttcgtgacaaatgaggtgcacacttggaccgaacaatataaatttcaggccgacagcccgaagcgcttgtccgcagccattggaaaagcttgggaggagggcgtatgcggtataagatctgccacgaggctggaaaacatcatgtggcggcagatttcgaacgagctcaatcatatcctgttagaaaacgacatgaagttcacagtcgtggttggcgatgtggtcgggattctggcacagggaaaaaagatgatccgccctcaacccatggagcacaaatacagctggaagtcctggggcaaggctaaaataatcggggccgacgtgcagaataccacttttattatcgatggaccaaacacccctgaatgtcccgacgatcagagagcgtggaatatttgggaggttgaggactatggcttcggtatctttacaactaacatatggcttaagttgagggattcatacacccaggtgtgcgaccaccgtctcatgagtgccgctattaaagattctaaggcagtacatgccgacatggggtattggatcgaaagcgagaaaaatgaaacatggaagctggctcgggcctccttcattgaggtcaagacgtgtatctggccaaaatcacacaccctatggagcaacggagtgctggaatctgagatgataatccccaagatttacggcggtcctatctcccaacataattatcgaccaggctacttcactcagacagcagggccgtggcacctcggaaaactggagcttgattttgacttgtgcgaaggcaccactgtggtcgttgatgagcactgcgggaacagaggacccagtctgaggacaaccacggtgactggcaagattatccatgaatggtgttgccgcagctgtaccttacctccactccggttcaaaggtgaggacgggtgctggtacggaatggagataagacccgtaaaggaaaaggaggaaaatctggtgaaatctatggtctccgcgggctcaggtgaggtggacagttttagccttggcctgttgtgtatttcgatcatgatcgaagaggttatgaggtcccgctggtctcgaaagatgctcatgacagggaccctggccgtgttctttctactgattatgggacagctcacttggaacgatctgatccggagctgcattatggtcggcgctaatgcctcagaccgtatggggatgggaacaacctatcttgcattgatggctacattcaaaatgagacctatgtttgccgtgggcctgttattcaggcgcctcactagtcgggaggttctgcttctgaccataggtctatccctcgtggcatctgtcgaactgccaaacagcttggaggaactgggggatggattagccatgggcatcatgattctcaagctgcttacggactttcaatcctaccagctgtgggctacattgctctcactgaccttcatcaaaactacctttagcctacactatgcgtggaagacaatggccatggtactgagtattgtgtctcttctccccctgtgtttgtccactaccagccagaagacgacatggctgccggttttactcggctcgctggggtgcaaacctcttaccatgttcctgatcgcagagaataagatatggggaagaaaatcatggccattgaacgaaggtatcatggctgtgggcattgtctctatcctcctgagttccctactgaagaacgatgtgccccttgccgggcctctcattgccggaggcatgctgatcgcttgttacgtaataagcggttctagcgcagacttgtccttagagaaagccgcggaggtgtcatgggaagaggaagctgagcatagtggggccagccacaatattctggtcgaagttcaggatgacggaactatgaagatcaaagatgaggagagggacgatacactcaccatcctgcttaaggcaactctgttggccgtgtctggcgtgtatcccctatccattccagctacactgtttgtctggtacttctggcaaaagaaaaagcagcgatcaggcgtgctctgggacacccctagtcccccagaagttgagcgcgcagtactggatgacgggatatatcggatcatgcagagaggacttttaggtaggagccaggtgggcgtcggggtgttccaagaaaacgtttttcatacgatgtggcacgtgactcgtggagccgtcctgatgtaccagggcaaacgcctcgagccgtcctgggcgtctgtgaagaaagacttgatttcgtacggtgggggatggcggctgcagggcagctggaataccggcgaggaagtacaggtcatcgctgtggagcctgggaagaaccccaagaatgttcaaacagccccaggaaccttcaaaacacccgaaggtgaggtgggcgcaattgccctcgattttaagcctgggacttcaggatccccaatcgtcaacagagaaggcaaaatagtgggtctgtatgggaatggagttgtgaccacgagtggcacatacgtctctgctatcgcccaggcaaaggctagccaggagggcccccttcctgagattgaagacgaggtgttcaggaaacgaaacctgactatcatggatttgcacccggggtccggaaagacccggcgctatctaccagccattgtaagagaagcgatcaagaggaaactgcggacactcatattagcccccacccgagtggttgcatcagagatggctgaagccctgaagggtatgcctattagataccaaactaccgctgtcaaatctgagcatacaggccgcgagatcgtggaccttatgtgccacgcaacgtttactatgaggctgctcagcccagtgcgtgtccccaattataacatgatcattatggatgaagcccatttcaccgaccctagttccatcgccgctcgggggtacataagcacaagagtaggaatgggcgaggcggcagccatttttatgaccgctactccgcccggttctgtggaagccttcccacagtcaaatgcagttatccaggatgaggaaagggacattcctgagcgctcctggaacagtgggtatgagtggatcacagattttcccggaaagaccgtgtggttcgtcccaagcataaaatcgggcaatgacattgccaactgtttgcgaaagaatggcaagagagtgatccagctgtctcggaaaacgtttgatactgaataccaaaagacaaaaaacaacgactgggactacgttgtgaccaccgatatctccgagatgggggctaatttcagggcggaccgcgtcattgatcctcgtagatgcctcaagcccgtgatcctgaaagacggaccagaacgggtaattcttgccggtccgatgcctgtgactgttgcaagcgctgcccagaggcgcggccgaatagggagaaaccacaataaggagggagatcagtatatctacatgggccagcccctaaacaatgacgaggatcatgcacactggacagaagccaagatgctgttggacaacattaataccccagagggtatcatccccgctttattcgaacctgagcgggaaaaatcagccgcgattgatggggagtataggctgcgcggcgaggcaagaaagacatttgtcgaactcatgaggcggggagacctgccagtgtggcttagttacaaagtggcctctgagggcttccaatattccgatcgtcgctggtgctttgacggggaacgaaacaatcaggtcctggaggaaaacatggatgttgagatatggactaaggagggagaaagaaaaaagctcaggccccggtggttggacgctcgcacgtacagcgaccctctggccctaagagagttcaaagaatttgctgcaggtaggcggtcagtgagtggcgatctgatcctcgagattgggaagcttccgcagcacctgacccagcgagcccaaaatgctttagacaacttggtaatgctgcataatagcgaacagggaggcagagcctatcgccacgcaatggaggagctcccagatacaatcgaaactctgatgcttctggcgctcattgccgtgttgaccggtggggtcacactgttctttttatccggcaagggactaggcaaaacctctatcgggctgctctgtgtgatggctagctccgcccttctgtggatggcatcagttgagccccattggatagctgcctctatcattttggaattctttctgatggtgctcctgatccctgagcccgacaggcagcggactccacaggataaccaacttgcatacgtcgtaattggactcctgttcatgatcttgacggtggccgctaatgagatgggtctgttagaaaccacaaagaaagacctaggcatagggcacgttgcggtggagaaccaccatcacgccactatgctggatgtcgacctccatcctgcaagtgcttggaccctttacgccgtggccacaaccattatcactcccatgatgcgtcacacaattgaaaacacgaccgcaaatatctcgctgactgctatagccaaccaggcggctatcttgatgggactggataagggctggccaattagcaaaatggacatcggtgtccctctcctggcccttgggtgctattcccaggtgaatccgttaacactgaccgcagccgttctcatgttggtggctcattacgcaattatcggccccggactgcaagccaaggcgaccagagaggctcagaagaggacagccgcaggcataatgaaaaacccaactgtagatgggattgtggccatcgacctagatcctgtcgtttatgacgctaagtttgaaaaacagctgggacagatcatgctccttattctgtgtacgtctcaaatcttgctgatgcgcaccacatgggccctctgcgagtcaataactctggcaaccggccccttaacaaccctttgggagggtagcccagggaagttctggaatactacgattgctgtgtccatggccaacatctttcggggaagttacctggcgggcgccggtctcgcattctctctaatgaaaagcctgggcgggggacgaagaggcacaggggctcagggagaaaccttgggcgagaagtggaagaggcagctgaatcagctctcaaaatccgaattcaacacttataagcgcagtggtattatggaggtcgaccggagcgaagccaaagaggggcttagacgtggagagaccacaaagcacgcagtgtctaggggcactgctaaactgcggtggtttgtagaacgcaatttggtgaagcctgagggtaaggttatcgatctgggctgtgggcgaggaggctggtcctactattgcgccgggctcaaaaaggtgaccgaagtcaaaggatacacaaagggcggtcccgggcacgaggaaccgataccaatggccacgtacggatggaacttagtgaaactgcattcaggcaaggacgtcttctttatccctcccgagaaatgtgatacccttctgtgcgacattggcgagagctcgccaaatcccactatcgaagaggggagaacactaagggtgctcaagatggttgaaccttggctgcggggaaaccaattctgtattaagatcttgaatccgtatatgccctctgtagtggagaccctggagcagatgcagcgcaaacacggtggcatgctcgtcagaaacccacttagtaggaattccactcatgaaatgtactgggtgagctgcgggacaggaaacattgtttcagcggtgaatatgacctcccgaatgctgttaaaccggtttacgatggctcaccgtaagcctacctatgagagagatgtcgacctgggcgcaggtacacgccacgtggccgtagaacccgaggtggctaacttggatatcatagggcagaggattgaaaatatcaaacatgagcacaagtctacttggcattacgacgaggataacccttataaaacctgggcctaccacggaagctatgaagttaagccaagtggctccgcaagctctatggtcaatggcgtggtgaagctcctgacaaaaccctgggacgtcatccctatggttactcaaattgccatgaccgatacaaccccattcgggcagcagcgggtgtttaaggagaaagtagacactagaacgcccaaggctaaacgcggaacagcgcaaataatggaagtgaccgccaagtggctatggggtttcctttcaaggaacaagaaaccgcgaatctgtactcgggaggaatttaccagaaaggtcaggagtaatgcagctattggcgccgtgttcgttgacgagaaccagtggaattccgcaaaagaggccgtggaagatgagcgcttttgggacctggtccatcgtgaacgggagctccacaagcaggggaaatgcgctacatgcgtgtacaacatgatgggaaagagagaaaagaaactgggcgagttcggtaaggccaaagggagcagggcgatctggtacatgtggttgggagcacgctttctggagttcgaagccctcggcttcatgaatgaggatcactggttttctcgagaaaactcgctttcaggcgtagagggggagggactgcataagttaggttatattctgcgggacatcagcaaaatacctggcgggaatatgtacgctgatgacacggccggatgggataccagaatcactgaagacgatttgcagaacgaggcaaagattacagacatcatggaaccagagcacgctctcctggccacctccattttcaaactaacttatcaaaataaggttgtgagggtccagcgccccgctagaaacggcacagtgatggatgtgatcagtcggagggaccagcgtggttctgggcaggtcggaacctacggccttaatacatttactaacatggaagcccaactgatacgacagatggagagcgagggcattttctccccttcagaactcgagaccccaaacctggcagaacgcgttttggattggttagagaagcatggggtggaaagactgaaacggatggcgatcagtggagacgactgtgtagtgaagcccatcgatgacaggtttgccacggctctctctgcccttaatgatatgggtaaagtccgcaaggacattccgcagtgggagcctagcaaaggctggaacgattggcagcaagtgcccttctgctcccaccactttcatcagctgataatgaaggacgggagagagatcgttgtgccatgtcggaatcaggatgaactagtcggaagggcacgagtgtcacagggcgctggttggagcctgcgtgagaccgcctgcctcgggaagtcttatgcacaaatgtggcagttgatgtacttccacagacgcgacctgcggcttgccgcgaacgctatttgttccgccgtacctgttgattgggtgcccacaagtaggactacctggagcatccatgcacaccatcagtggatgacaactgaagacatgctgtcggtctggaatagagtgtggattgaggaaaacccatggatggaggataaaacccacatctcctcttggggagacgttccctatctcggcaagcgcgaggaccaatggtgcggctcattaatagggctgacggcccgggctacatgggccaccaatatccaggtggcaattaaccaggtcaggcgattgatcggaaatgaaaactacctggattacatgactagcatgaaaagatttaagaatgagagtgaccctgaaggtgctctctggtga

SEQ ID NO: 13669 - RNA, 9879 nt, synthetic construct
  misc_feature 1..9879: note = derived and/or modified CDS sequence (opt3) from DENV-1__FJ461323__SS-prME
  source 1..9879: mol_type = other RNA
agcgtgaccatgctgctcatgcttatgcccacagcactggctttccacttgactacgaggggaggggaacctcatatgatcgtctccaagcaggaaaggggaaaatctttactgtttaagacctcagccggtgttaacatgtgcacattaattgccatggacctcggcgagctgtgtgaagatactatgacctacaaatgcccacggataacagaggcggaaccggacgatgtggactgttggtgcaatgctaccgatacttgggtgacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggttctccggcaccctggattcaccgtgattgctctgtttctggcacatgccatcggcacatcgattacccagaagggcatcatattcatcctcttaatgctggtcacgccatcaatggctatgcgctgcgtggggattggaagcagagattttgtagagggtcttagtggcgccacttgggttgacgtggtcttggagcacgggtcctgtgtgacaaccatggcgaaggataaacccactctggacatcgaattgctcaagacagaggtgaccaaccctgcagtcctgaggaaactttgcattgaagccaagatctctaatacgaccacagatagccggtgtccaactcaaggagaggctaccctggttgaagaacaggacgccaacttcgtgtgccgccgaacatttgtagatagaggctggggtaatgggtgtggattgttcggcaaaggctccctcataacttgcgcaaagtttaagtgcgtgaccaaactggaggggaagattgtccagtacgaaaacttaaaatattcagtgatcgttacagtgcacaccggagaccagcatcaagtcggtaatgagagtactgaacacggcacgacagctaccattactccccaggcccctaccacagagatccagctgaccgactacggggcgctcactcttgattgtagcccaaggacaggactggacttcaacgaaatggtgttgctaacgatgaaggagaaatcttggctggtacataagcagtggtttctcgatctgccgcttccctggacctccggcgcctcaactagccaagagacatggaatcggcaggacctgttggttaccttcaaaacagcacacgctaagaagcaggaagtggtcgtgctcggtagtcaagagggggccatgcacactgctctgaccggcgccacggaaatccagacctctggaacaactaccatttttgcaggccatttaaaatgccgtctgaagatggataaactaacactcaaggggatgtcctatgtcatgtgtactggatcgttcaaactggagaaggaagtggccgagacccagcacggtacggttcttgtgcagataaagtacgagggcacagacgctccttgcaaaatcccattctcgacccaagatgaaaagggggtaactcagaacggacgcttgattacagcgaatcccatcgtcaccgacaaagagaagcctgtgaacatagaagcagagccaccctttggcgagtcttatattgttatcggtgccggggaaaaagctctgaagctctcctggttcaagaaaggctcaagtatcggaaagatgtttgaggccactgcaagaggcgccaggcggatggctattctgggggataccgcctgggacttcggaagcatcggtggcgtgtttacatccgtcgggaaacttgtgcatcagattttcggaacggcatacggcgtactgttttctggtgtgagctggaccatgaagatagggatcggcgttttgctcacttggctgggattaaattcacgaagtacatccctgagcatgacctgtattgcggtcggcctagtgacactctacctgggggtgatggtccaggctgattctggatgcgttatcaactggaaaggccgcgaacttaagtgtggttcagggatcttcgtgactaatgaggtgcacacctggacggaacaatataagtttcaggccgacagtccgaaaagattgagcgcagccattggaaaggcttgggaggagggcgtatgcggtataaggtccgccacacggctggaaaacatcatgtggaaacagatttctaacgagctcaatcatatcctgttagaaaacgacatgaagctgaccgtcgtggttggcgatgtggcagggattcttggacagggcaaaaagatgatccgccctcaacccatggagtacaaatattcgtggaaaagctgggggaaggctaaaataatcggagccgacgcgcagaatactaccttcattatcgatggcccaaacacacctgaatgtcccgacgatcagagagcctggaatatttgggaggtcgaggactacggttttgggatcttcactaccaacatatggttgaagctcagggattcctatacacaggtgtgcgaccaccgtctgatgtcagctgcaattaaagatagtaaggccgttcacgctgacatgggatactggatcgaatctgagaaaaatgaaacgtggaagctagcccgggcatcctttattgaggtgaagacctgtatctggccaaaatcccatactctgtggtcaaacggcgtactcgaaagcgagatgataatccccaagatttatggtggccctatctctcaacacaattaccgaccagggtacttcacacagaccgcgggaccgtggcatctgggcaaacttgagttggatttcgacctgtgcgaagggactacagtcgtggtggatgagcactgcggaaacagaggcccctccttaaggaccacgactgtcaccggtaagattatccacgaatggtgttgccgcagttgtacactccctccactgcggtttagaggggaggacggatgctggtatggcatggagataaggcccgttaaagaaaaggaggaaaatcttgtaaagagcatggtatctgccggttccggcgaggtggactcattcagtctggggttgctctgtattagcatcatgatcgaagaggtcatgcgctcgcgatggtcccggaaaatgctgatgaccggaactctagctgtgtttttcctgctcattatgggccagctgacatggaacgatcttatccgtttgtgcattatggttggggccaatgcatctgacagaatgggaatgggcaccacatacctggctttaatggccacttttaagatgaggcctatgttcgcagtgggtctcctgtttcgccggcttaccagcagagaggtcctgctactcacgatagggctgtcattggtggccagtgttgaactgccaaactccttagaggaactcggagatggcctggctatgggcatcatgattcttaaactgttgacagacttccaatctcatcagctctgggcgaccctgctaagcctgacttttatcaagaccacattctcccttcactatgcctggaaaactatggcaatggtgctctcaattgtcagcctgtttcccttgtgtctgagtaccacgtctcagaagacaacctggttaccggtactcctggggtcccttggatgcaagcctctgactatgttcttgatcgctgagaataaaatatggggtagaaagagctggccactcaacgaaggcatcatggccgtggggattgtttcgatcctgctatcatctctgcttaaaaacgatgtgcccctcgccggacctctgattgctggcggtatgttgatcgcatgttacgtcataagtgggtccagcgccgacttatctctggagaaggcggctgaggtgagctgggaagaggaagccgagcattccggagcatcacacaatattctcgtagaagtgcaggatgacggcacaatgaaaatcaaggatgaggagcgagacgataccctgactatccttctgaaagccacattgctagctgtcagtggcgtttatcccctgagcattccagcaaccctctttgtgtggtacttctggcaaaagaagaaacagcgctctggggtgctgtgggacacgccttcacccccagaagtcgagcgggccgtgcttgatgacggaatatatagaatcatgcagaggggtttactgggccgtagccaggttggggtaggagtgttccaagaaaacgtctttcatactatgtggcacgtgacccgcggcgcggttctcatgtaccagggtaagcggttggagccgagttgggctagcgtgaaaaaggacctgatttcctacgggggaggctggagactcaggggctcttggaatacaggggaggaagtccaggtgatcgccgtagagcctggcaaaaatcccaagaatgtccagaccgcaccaggtacattcaagactcccgaaggcgaggtgggggccattgctctggattttaaacctggaacctcgggcagcccaatcgttaaccgagaaggtaagatagtggggctttatggaaatggcgtcgtgacgacatcaggcacttacgtttccgccatcgcacaagctaaagccagtcaggaggggcccctgcctgagattgaagacgaggtgttccggaagcgcaacttgaccatcatggatctacacccgggatctggtaaaacaagaaggtatctgccagcgattgtccgggaagccatcaagcgaaagctcagaaccttaatactggcacccactcgcgtggtagctagcgagatggccgaagctcttaaaggcatgcctattaggtaccagaccacagcagtgaagtccgagcatacggggaaagagatcgttgacctgatgtgccacgccacttttaccatgcgtctcttgtcaccagtccgggtgcccaattataacatgatcattatggatgaagcccatttcacagacccttctagcatcgctgcgagaggatacataagtaccagggtgggcatgggtgaggcagccgctatttttatgactgccacaccgcccgggtccgtcgaagcattcccacaaagcaatgccgtaatccaggatgaggaacgcgacattcctgagcgatcttggaactcaggatatgagtggatcaccgattttcccggcaagacggtgtggttcgttccatccataaaaagtggcaatgacattgctaactgtctgagaaagaatgggaagcgggtgatccagctcagcaggaaaacttttgatacagaataccagaagaccaaaaacaacgactgggactacgtcgtgaccactgatatctcggagatgggagcgaatttccgcgccgaccgtgttattgatcctagacggtgcctgaagcccgtgatccttaaagacggtccagaaagggtcattctagcaggcccgatgcctgtgacagtagcttctgccgcacaacgccgagggagaataggacggaaccacaataaggagggcgatcagtatatctacatgggtcagcccctgaacaatgacgaggatcatgcccactggaccgaagctaagatgttgttagacaacattaatacaccagaggggatcatccccgccctgttcgaacctgagagggaaaaatccgcggcagtggatggcgagtatcgcctcagaggagaggccaggaagacttttgttgaactgatgcggcgtggcgaccttccagtctggctgagctacaaagtggcttcagaggggttccagtatagtgatcgccgatggtgctttgacggagaaagaaacaatcaagtgctcgaggaaaacatggatgtcgagatttggacgaaggagggtgaaaggaaaaagttgcggccccgctggctggacgccagaacctactctgaccctctagctctgagggagttcaaagaatttgcagccggccggcgatccgttagcggggatctcatacttgagatcggaaagctgccgcagcacttaacacagagagctcagaatgccttggacaacctggtgatgctccataattcagaacaaggcggtcgcgcatataggcacgcgatggaggagctgccagatactattgaaacccttatgctgctcgccttgatcgctgtactgacagggggcgtgaccttattctttctaagtggacggggcctggggaagactagcattggactcctttgtgtcatggcctcctctgtgctgttgtggatggcaagcgttgagccccattggatcgctgcctccataatcctggagttctttctcatggtgctgcttattcctgagcccgaccgtcagagaacgccacaggataaccagctcgcatacgtcgtaatcggtctgttgttcatgattctgaccgtggccgctaatgagatgggcttactagaaacaactaaaaaggacctggggatcggacacgttgcggtggagaaccaccatcacgccgcaatgctcgatgtcgaccttcatcctgcttcagcctggaccctgtacgccgtggcaacaaccataattactcccatgatgaggcacacaatcgaaaacacgaccgctaatatttctttgactgccatcgcgaaccaagctgccatactgatgggcctcgataaaggttggccaatcagtaagatggacattggggtccctctgcttgcattaggctgctatagccaggtgaatccgctgacactcaccgccgctgttttgatgctggtggcacattacgccatcattggacccggcctacaggcgaaagctacccgcgaggcccaaaagcggacagcagccgggatcatgaagaacccaactgtagatggaatagtggctattgacctggatcctgtcgtttatgacgccaaatttgaaaagcagctcggccagatcatgcttctgatcttgtgtacgagccagattctgctcatgcgaaccacatgggcactgtgcgagtccatcactttagctaccggtccccttacaaccctgtgggaggggtctccaggaaaattctggaatactacgatagccgtgtcaatggcgaacatttttagaggcagctacctcgccggtgcaggcctagctttctccctgatgaagagtctagggggaggcaggcgcgggacaggagcccaaggcgaaaccctgggtgagaaatggaagcggcagctcaatcagctttctaagagcgagttcaacacttataaaagatcagggatcatggaggtcgaccgttccgaagcaaaggagggactgaaaaggggcgagaccacaaagcacgctgtgagtcggggtactgccaaattgcgctggtttgtagaacgaaatctggtgaagcctgagggcaaggttattgatctcgggtgtggaagaggcgggtggagctactattgcgccggactaaagaaggtgaccgaagtcaaaggctacacaaagggtgggcccggacacgaggaaccgatcccaatggcgacgtacggctggaacctggtgaaacttcattctggcaaggacgtcttctttatacctcccgagaaatgtgataccctgctatgcgacatcggggagtcctcaccaaatcccactattgaagagggaaggacactccgggtgctgaagatggttgaaccttggttgcgcggtaaccagttctgtatcaagattctgaatccgtatatgcccagcgtagtggagaccctcgagcaaatgcagagaaaacacggcgggatgcttgtcaggaacccactgtcgcgaaattctactcatgaaatgtactgggtgagttgcggaacaggcaacatcgtttccgctgtgaatatgaccagccggatgttactgaaccgttttacgatggcacacagaaagcctacctatgagcgcgatgtcgacttgggtacagggactaggcacgtggccgtagaacccgaggtggctaacctcgatattatcggacagcggatagaaaatattaaacatgagcacaagtcaacctggcattacgacgaggataacccttataaaacatgggcctaccacggctcctatgaagttaagccatctggcagcgcaagttccatggtcaatggggtggtgaagctgctaactaaaccctgggacgtcatccctatggttacccagatcgccatgacagataccactccattcggacaacagagagtgtttaaggagaaagtagacacgcgcacacccaaggctaaaaggggtaccgcgcagattatggaagtgactgcccgatggctttggggcttcctgagccggaacaagaagccgagaatatgtaccagggaggaatttacacgcaaagtccgttctaatgcagctatcggggccgtgttcgttgacgagaaccaatggaactcagcaaaggaggccgtggaagatgagcggttttgggacctcgtccatagagaaagggagctgcacaaacagggaaagtgcgctacgtgcgtgtacaacatgatgggcaaacgcgaaaagaagttgggtgagttcgggaaagccaagggaagtcgagcgatttggtacatgtggctgggcgcacggtttctcgagttcgaagcccttggcttcatgaatgaggatcactggttttccagagaaaacagcctgtctggggtagagggagagggtttacataaactgggctatatcttgagggacatttcgaagatccctgggggaaatatgtacgctgatgacaccgccggctgggatactcgcataacagaagacgatctccagaacgaggcaaaaatcaccgacattatggaaccagagcacgctctgctagccaaggctatcttcaaacttacttatcagaataaggttgtgagagtccaacggcccgccaagaacggtacagtgatggatgtgatttcaaggcgtgaccagcgagggagcggacaggtcggcacctacggcctgaatacatttactaacatggaagcacagctcatccgccaaatggagtccgaggggatattcagtccttctgaactggagaccccaaacttggcggaaagagccttagattggctggagaaatatggagttgaacggctcaagaggatggctattagcggtgacgactgtgtggtaaaacccatcgatgaccgctttgccacggcacttaccgctctgaatgatatgggcaaggtgagaaaagacatcccgcagtgggagccttccaaggggtggaacgattggcagcaggtccccttctgctcacatcactttcaccaactaattatgaaggacggacgggagatagtggttccatgtaggaatcaggatgaactggtgggccgagcccgtgtcagtcagggtgcagggtggtctctcagagagacagcctgcttgggaaaaagctacgcgcagatgtggcaactgatgtatttccatcgccgggaccttaggctggctgccaacgcaatctgttccgccgtgcctgtagattgggttcccacttcaagaaccacatggagcattcacgctcatcaccagtggatgactaccgaagacatgctctctgtgtggaatcgcgtctggatcgaggaaaacccatggatggaggataagacgcatatttccagttgggaggacgtgccctacttaggcaaacgggaagaccagtggtgcggcagcctgatcgggttgacagccagggcaacctgggctactaatatacaagttgccatcaaccaggtgcgaagactgattggaaatgagaactacctcgattatatgacatcgatgaagcggtttaaaaatgaaaccgaccctgagggtgcgctttggtga

SEQ ID NO: 13670 - RNA, 9879 nt, synthetic construct
  misc_feature 1..9879: note = derived and/or modified CDS sequence (opt3) from DENV-1__FJ461325__SS-prME
  source 1..9879: mol_type = other RNA
agcgtgaccatgctgctcatgcttatgcccaccgccctggctttccacttgactacgcggggaggggaacctcatatgatcgtctccaagcaggaaaggggaaaatctttactgtttaagacctcagccggtgttaatatgtgcacgctaattgccatggacctcggcgaactgtgtgaagatactatgacctacaaatgcccacggattacagaaaccgaaccggacgatgtggactgttggtgcaatgcgactgatacatgggtgacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaggacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaggcccctacaaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccgggagcttcaaactggagaaggaagtcgccgagacgcagcacggtacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattgtgatcggtgccggggaaaaagctctgaagctctcctggttcaagaaaggctcaagtatcggaaagatgtttgaggccaccgcaagaggcgccaggcggatggctattctgggggatacagcctgggacttcggaagcatcggtggcgtttttacgtccgtggggaaacttgtccatcagattttcggaaccgcatacggcgtgctgttttctggtgtaagctggactatgaagatagggatcggcgtgttgctcacatggctgggattaaattcacgaagtacctccctgagcatgacatgtattgcggttggcctagtcactctctacctgggggtgatggtgcaggctgattctggatgcgtcatcaactggaaaggccgcgaacttaagtgtggttcagggatcttcgttaccaatgaggtgcacacgtggacagaacaatataagtttcaggccgacagtccgaaaagattgagcgcagccattggaaaggcttgggaggagggcgtgtgcggtataaggtccgccacccggctggaaaacatcatgtggaaacagatttctaacgagctcaatcatatcctgttagaaaacgacatgaagttcactgtagtcgtgggcgatgttgcagggattctggctcagggcaagaagatgatccgccctcaacccatggagtacaaatattcgtggaaaagctggggcaaggccaagataatcggggcggacgtgcagaataccacatttattatcgatggaccaaacactcctgaatgtcccgacgatcagagagcctggaatatttgggaggtcgaggactacggcttcggtatctttaccacaaacatatggcttaagttgagggattcctatacacaggtgtgcgaccaccgtctcatgtcagctgcaattaaagatagtaaggccgttcacgctgacatggggtactggatcgaatctgagaaaaatgaaacctggaagctggcccgggcatccttcattgaggtgaagacttgtatctggccaaaatcccatacactatggtcaaacggagtactggaaagcgagatgataatccccaagatttatggcggtcctatctctcaacacaattaccgaccaggctacttcacccaggcggccgggccgtggcatctcggaaaactggagcttgattttgacttgtgcgaaggcactacagtcgtggtggatgagcactgcgggaacagaggaccctccctgaggaccacgactgtcaccggcaagattatccacgaatggtgttgccgcagttgtacattacctccactccggttcagaggtgaggacgggtgctggtatggaatggagataaggcccgttaaagaaaaggaggaaaatctggtaaagagcatggtatctgctggctccggtgaggtggactcatttagtcttggcctgttgtgtattagcatcatgatcgaagaggtcatgcgctcgcgatggtcccggcgtatgctcatgaccgggactctggccgtgttctttctactgattatgggacagctcacatggaacgatctgatcagactttgcattatggttggcgcaaatgcttctgacaggatggggatgggaaccacatacttggccctgatggcaactttcaaaatgcgccctatgtttgccgtgggcttactcttccggagactgaccagcagggaggtccttctgctaacgataggtctctcactggtggctagtgttgaattgccaaactccctggaggaattaggggatggactcgcgatgggcatcatgattctgaaacttctgacagactttcaatctcatcagttgtgggccaccctcctgagcctaactttcatcaaaaccacattttccctgcactatgcatggaagactatggctatggtgctttcaattgtcagcctcttccccctgtgtttgagtaccacgtctcagaaaacaacctggctgccggtattactcggctccctggggtgcaagcctcttactatgtttctgatcacagagaataagatatggggacgacgcagctggccattgaacgaaggtatcatggccgtgggcattgtttcgatcctcctgtcatctctactgaaaaacgatgtgccccttgccgggcctctcattgctggaggcatgctgatcgcatgttacgtcataagtggttccagcgccgacttgtctttagagaaggcggctgaggtgagctgggaagaggaagccgagcattccggggcatcacacaatattctggtagaagtgcaggatgacggaaccatgaaaatcaaggatgaggagcgggacgatactctcacaatcctgcttaaagccaccctgttggctgtcagtggcgtttatcccctaagcattccagcaacgctgttcgtgtggtacttctggcaaaagaaaaagcagagatctggcgtgctctgggacactccttcacccccagaagtcgagagggccgtgctggatgacgggatatatcgtatcatgcagcgcggacttttaggtcggagccaggttggcgtaggggtgtttcaagaaaacgtcttccataccatgtggcacgtgacaagaggagcggttctgatgtaccagggcaagaggctcgagccgagttgggctagcgtgaaaaaggacttgatttcctacggtgggggatggcgactgcagggctcttggaataccggcgaggaagtccaggtgatcgccgtagagcctgggaaaaaccccaagaatgtccaaacagcaccaggaacttttaaaacccccgaaggtgaggtgggcgccattgctctcgatttcaagcctgggacgtcgggaagcccaatcgttaaccgggaaggcaagatagtgggtctgtatgggaatggagtcgtgacaacttcaggcacctacgtttccgccatcgcacaggctaaagccagtcaggagggcccccttcctgagattgaagacgaggtgtttcgcaagagaaacctgacaatcatggatttgcacccggggtctggaaaaaccaggcggtatctaccagcgattgtccgagaagccatcaagagaaaactgcgcactctcatattagcacccaccagggtggtagctagcgagatggccgaagctctgaagggtatgcctattcgttaccaaacaacggcagtgaagtccgagcatactggcaaagagatcgttgaccttatgtgccacgccaccttcacaatgcggctgctctcaccagtcagagtgcccaattataacatgatcattatggatgaagcccattttaccgacccttctagcatcgctgcgagggggtacataagtactcgcgtgggaatgggcgaggcagccgctattttcatgacagccaccccgcccggttccgtcgaagcatttccacagagcaatgccgtaatccaggatgaggaacgagacattcctgagagatcttggaactcagggtatgagtggatcacggatttccccggaaagactgtgtggtttgttccatccataaaaagtggcaatgacattgctaactgtttgcggaagaatggcaaaagggtgatccagctgagccgcaagacattcgataccgaataccaaaagaccaaaaacaacgactgggactacgtcgtgactacagatatctcggagatgggggcgaatttccgtgccgacagagttattgatcctcggaggtgcctcaagcccgtgatcctgaaagacggaccagaacgcgtcattcttgcaggtccgatgcctgtgaccgtagcttctgccgcacagcgaagaggccggatagggaggaaccacaataaggagggagatcagtatatctacatgggccagcccctaaacaatgacgaggatcatgcccactggacagaagctaaaatgctgttggacaacattaatactccagagggtatcatccccgccttatttgaacctgagcgcgaaaagtccgcggcaattgatggggagtatagactgaggggcgaggcccggaagacgttcgtggaactcatgcgtcgcggagacctgccagtttggcttagctacaaagtcgcttcagagggctttcaatatagtgatcgaagatggtgcttcgacggggaaaggaacaatcaggtgctggaggaaaacatggatgtggagatatggaccaaggagggagaacggaaaaagctccgccccagatggttggacgccaggacatactctgaccctctggctctacgggagtttaaagagttcgcagccggtcgaagatccgtcagcggcgatctgatcctcgagattgggaaacttccgcagcacctgactcagcgcgctcaaaatgccttagacaacttggttatgctgcataattcagaacagggaggcagggcatatcggcacgcgatggaggagctcccagataccatcgaaacactgatgcttctggccctcattgctgtgttgaccggtggggtaactctgtttttcttaagtggccgtggactaggcaaaacgagcatcgggctgctctgtgtgatggcctcctctgtccttctgtggatggcaagcgtggagccccattggatagctgcctccatcattttggaatttttcctgatggttctcctgatccctgagcccgacagacagaggaccccacaggataaccaacttgcatacgtggtcattggactcctgtttatgatcttgacagtagccgctaatgagatgggtctgttagaaactaccaagaaggacctaggcatagggcacgtggcggttgagaaccaccatcacgccgcaatgctggatgtggacctccatcctgcttcagcctggacactttacgccgtcgcaaccactattatcacacccatgatgcgccacacgattgaaaacaccactgctaatatctctctgacagccatagcgaaccaggctgccatcttgatgggactggataaaggctggccaattagtaagatggacatcggtgtgcctctcctggcacttgggtgctattcgcaggtcaatccgttaaccctgaccgccgctgtgctcatgttggttgcacattacgccattatcggccccggactgcaagcgaaagctacacgggaggcccagaagcgaactgcagccggcataatgaaaaacccaacggtggatgggattgtagctatcgacctagatcctgtggtctatgacgccaagttcgaaaagcagctgggacagatcatgctccttattctgtgtaccagccaaatcttgctgatgagaacaacttgggcactctgcgagtccataaccctggctacaggccccttaaccactctttgggagggttctccagggaaattttggaatacgacaattgccgtttcaatggcgaacatcttcaggggaagctacctggccggcgcaggtctcgctttctccctaatgaagagtctgggcgggggacgccggggcaccggggcccagggagaaactttgggcgagaaatggaagagacagctgaatcagctctctaaaagcgaatttaacacctataagcgttcaggtattatggaggtggacaggtccgaagcaaaggaggggcttaaacggggagagacaactaagcacgctgtcagtcgcggcaccgccaaactgcgatggttcgtggaaagaaatttggtaaagcctgagggtaaagtgatcgatctgggctgtgggaggggaggctggagctactattgcgccgggctcaagaaggttacagaagtgaaaggatacacgaagggcggtcccgggcacgaggaaccgataccaatggcgacctacggatggaacttagtcaaactgcattctggcaaggacgtgtttttcatccctcccgagaaatgtgatactcttctgtgcgacattggcgagtcctcaccaaatcccacaatcgaagaggggcggaccctacgcgtcctcaagatggtggaaccttggctgagaggaaaccaattttgtattaaaatcttgaatccgtatatgcccagcgttgtagagactctggagcagatgcagaggaagcacggtggcatgctcgtgcgaaacccactttcgagaaattctacacatgaaatgtactgggtcagttgcgggaccggaaacattgtgtccgctgttaatatgacgagccgtatgctgttaaacagattcaccatggcacaccgcaagcctacatatgagagggatgtggacctgggcgccggtactcggcacgtcgctgtggaacccgaggtagccaacttggatatcatagggcagagaattgaaaatatcaaacatgagcacaagtcaacctggcattacgacgaggataacccttataaaacatgggcataccacggatcctatgaagtgaagccatctggcagcgccagttccatggttaatggcgtcgtgaaactcctgactaagccctgggacgtgatccctatggtcacccaaattgctatgacagataccactccatttgggcagcagcgcgttttcaaggagaaagtggacacgaggacacccaaggcgaaacgaggaaccgcccaaataatggaagtaactgcaaagtggctatggggttttcttagccggaacaaaaagccgagaatctgtaccagggaggagttcacacgcaaggtgcgttctaatgctgccattggcgcagtctttgtggacgagaaccagtggaactcagccaaagaggctgttgaagatgagcggttctgggacctggtgcatagagaaagggagctccacaagcaggggaaatgcgccacgtgcgtctacaacatgatgggaaagcgcgagaagaagctgggcgagtttggtaaggcgaaagggagtcgagcaatctggtacatgtggttgggagcccggttcctggagttcgaagctctcggctttatgaatgaggatcactggttctccagagaaaacagcctttctggcgtggagggggagggactgcataagttaggttatattctgagggacatctcgaaaatacctggcgggaatatgtacgccgatgacaccgcaggatgggatactcgcatcacagaagacgatttgcagaacgaggctagaattaccgacatcatggaaccagagcacgccctcctggctaagtcaatttttaaactaacttatcaaaataaggtagttcgggtgcagaggcccgccaaaaacggcacagtcatggatgtgatcagccgtcgagaccagcgcggttccggacaggtgggaacctacggccttaatacattcactaacatggaagcacaactgataagacagatggagagtgagggcatattttctcctagcgaactcgagaccccaaacctggcggaacgggtcttggattggttagagaagtatggggttgaaaggctgaagcgcatggccatctccggagacgactgtgtggtaaaacccatcgatgacagattcgctacggccctcaccgcacttaatgatatgggtaaggtgcggaaagacattccgcagtgggagccttcaaagggctggaacgattggcagcaagtccccttttgcagtcatcacttccaccagctgataatgaaagacgggagggagatcgtggttccatgtcgaaatcaggatgagctagtgggacgtgctagagtctctcagggcgccggttggagcctgcgcgagacagcatgcctcgggaagtcctacgcccaaatgtggcagttgatgtattttcatcggagggacctgagacttgcggctaacgccatttgttcagcagtgcctgtagattggatccccactagccgcaccacatggtctattcacgcccatcaccagtggatgactaccgaagacatgctgtccgtttggaatcgggtgtggatcgaggaaaacccatggatggaggataagacgcatataagtagctggggagacgtcccctacctcggcaaaagggaggaccaatggtgcggctcgttaatcgggctgacagctcgagccacctgggcaactaatattcaggtggctatcaaccaggttagacggttgattggaaatgaaaactacctggattatatgacatccatgaagaggttcaaaaatgagtctgaccctgaaggtgccctctggtga

SEQ ID NO: 13671 - RNA, 9879 nt, synthetic construct
  misc_feature 1..9879: note = derived and/or modified CDS sequence (opt3) from DENV-1__FJ410232__SS-prME
  source 1..9879: mol_type = other RNA
agcgtgaccatgctgctcatgcttatgcccaccgccctggctttccacttgactacgagaggaggggaacctcatatgatcgtctccaagcaggaaaggggaaaatctttactgtttaagacctcagccggtgttaacatgtgcacattaattgccatggacctcggcgagctgtgtgaagatactatgacctacaaatgcccacggatcacagaggcggaaccggacgatgtggactgttggtgcaatgctaccgatacttgggtaacatatgggacctgtagtcagacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttacagcactgtttctggcccatgctattggcacctcgatcacgcagaagggcattatcttcatactcttaatgctggtgactccatcaatggccatgcgctgcgtcgggatcggaagcagagattttgtggagggtcttagtggcgcgacatgggtagacgttgtgttggagcacgggtcctgtgtcaccactatggcaaaggataaacccacactggacattgaattgctcaagaccgaggtgacgaaccctgccgtgctgaggaaactttgcatcgaagctaagatttctaataccacaactgatagccggtgtccaacccaaggagaggccacactggtcgaagaacaggacgcaaacttcgtttgccgccgaacttttgtggatagaggctggggtaatgggtgtggattgttcggcaaaggctccctcataacctgcgctaagtttaagtgcgtaacaaaactggaggggaagatagtgcagtacgaaaacttaaaatattcagtcattgtgaccgttcacactggagaccagcatcaagtgggtaatgagagtacggaacacggcacaaccgccactatcacaccccaggcgcctacaaccgagattcagctgactgactacggggccctcacacttgattgtagcccaaggacgggactggacttcaacgaaatggtcttgctaaccatgaaggagaaatcttggctggtgcataagcagtggtttctcgatctgccgcttccctggacttccggcgcatcaacaagccaagagacctggaatcggcaggacctgttggtaacattcaaaactgctcacgccaagaagcaggaagttgtggtcctcggtagtcaagagggggctatgcacaccgccctgacgggcgcaaccgaaatccagacatctggaactaccacaatctttgccggccatttaaaatgccgtctgaagatggataaactaactctcaaggggatgtcctatgtgatgtgtaccggtagcttcaaactggagaaggaagtcgctgagacgcagcacggtacagtgcttgttcagattaagtacgagggcaccgacgcgccttgcaaaataccattctcgactcaagatgaaaagggggtgacacagaacggacgcttgatcaccgcaaatcccattgtaactgacaaagagaagcctgtcaacatcgaagccgagccaccctttggcgagtcttatatagtgattggtgctggggaaaaagccctgaagctctcctggttcaagaaaggctcaagtatcggaaagatgtttgaggcaaccgccagaggcgctaggcggatggccatcctgggggatacagcatgggacttcggaagcattggtggcgtttttacgtccgtggggaaacttgtccatcagatcttcggaaccgcgtacggcgtgctgttttctggtgtaagctggactatgaagattgggataggcgtgttgctcacatggctgggattaaattcacgaagtacctccctgagcatgacatgtatcgctgttggcctagtcactctctacctgggggtgatggtgcaggccgattctggatgcgtcattaactggaaaggccgcgaacttaagtgtggttcagggatcttcgttaccaatgaggtgcacacgtggacagaacaatataagtttcaggcagacagtccgaaaagattgagcgccgctatcggaaaggcctgggaggagggcgtgtgcggtattaggtccgcaacccggctggaaaacataatgtggaaacagatctctaacgagctcaatcatattctgttagaaaacgacatgaagctgactgtagtcgtgggcgatgttgctgggatccttggacagggcaaaaagatgattcgccctcaacccatggagtacaaatattcgtggaaaagctgggggaaggccaaaatcataggagcggacgcccagaataccacattcatcattgatggcccaaacactcctgaatgtcccgacgatcagagagcttggaatatctgggaggtggaggactacggttttgggattttcaccacaaacatctggttgaagctcagggattcctatacgcaggtctgcgaccaccgtctgatgtcagcagccataaaagatagtaaggctgtgcacgccgacatgggatactggattgaatctgagaaaaatgaaacctggaagctagcacgggcgagctttatcgaggttaagacttgtatttggccaaaatcccatacactgtggtcaaacggcgtgctcgaaagcgagatgatcatacccaagatctatggtggccctatttctcaacacaattaccgaccagggtacttcacccagactgccggaccgtggcatctgggcaaacttgagttggatttcgacctgtgcgaagggacaaccgtagtcgtggatgagcactgcggaaacagaggcccctccttaaggacgactaccgtgacaggtaagatcattcacgaatggtgttgccgcagttgtaccctccctccactgcggtttagaggggaggacggatgctggtatggcatggagatcaggcccgtcaaagaaaaggaggaaaatcttgttaagagcatggtgtctgctggttccggcgaggtagactcattcagtctggggttgctctgtataagcattatgatcgaagaggtgatgcgctcgcgatggtcccggaaaatgctgatgactggaacactagccgtctttttcctgctcatcatgggccagctgacctggaacgatcttattcgtttgtgcatcatggtgggggcaaatgcttctgacagaatgggaatgggcacaacttacctggccttaatggcaacctttaagatgaggcctatgttcgccgttggtctcctgtttcgccggcttacgagcagagaggtgctgctactcacaattgggctgtcattggtcgctagtgtggaactgccaaactccttagaggaactcggagatggcctggcgatgggcataatgatccttaaactgttgaccgacttccaatctcatcagctctgggccactctgctaagcctgacctttattaagacaactttctcccttcactatgcatggaaaaccatggctatggttctctcaatcgtgagcctgtttcccttgtgtctgagtacgacatctcagaagaccacttggttaccggtcctcctggggtcccttggatgcaagcctctgacaatgttcttgattgccgagaataaaatctggggtaggaagtcctggccactcaacgaaggcataatggccgtagggatcgtgtcgattctgctatcatctctgcttaaaaacgatgttcccctcgctggacctctgatcgcaggcggtatgttgattgcctgttacgtgatcagtgggtccagcgcggacttatctctggagaaggctgccgaggtcagctgggaagaggaagcagagcattccggagcctcacacaatatactcgtggaagtacaggatgacggcaccatgaaaattaaggatgaggagcgagacgatactctgacaatccttctgaaagctaccttgctagcagtgagtggcgtctatcccctgagcatcccagccacgctctttgtttggtacttctggcaaaagaagaaacagcgctctggggtgctgtgggacactccttcacccccagaagtggagcgggcggtccttgatgacggaatttatagaataatgcagaggggtttactgggccgtagccaggtgggggttggagtattccaagaaaacgtgtttcataccatgtggcacgtcacacgcggcgctgtgctcatgtaccagggtaagcggttggagccgagttgggccagcgttaaaaaggacctgatctcctacgggggaggctggagactcaggggctcttggaataccggggaggaagtgcaggtcattgcagtggagcctggcaaaaatcccaagaatgtacagacagccccaggtactttcaagacccccgaaggcgaggtcggggctatcgccctggattttaaacctggaacgtcgggcagcccaattgtgaaccgagaaggtaagatcgttgggctttatggaaatggcgtggtcacaacttcaggcacctacgtgtccgcaatagctcaagccaaagcgagtcaggaggggcccctgcctgagatcgaagacgaggttttccggaagcgcaacttgacaattatggatctacacccgggatctggtaaaaccagaaggtatctgccagccatcgtgcgggaagcaattaagcgaaagctcagaactttaatcctggctcccacccgcgtcgtggccagcgagatggctgaagcacttaaaggcatgcctataaggtaccagacaacggccgtaaagtccgagcatactgggaaagagattgtggacctgatgtgccacgccacctttacaatgcgtctcttgtcaccagttcgggtccccaattataacatgatcatcatggatgaagctcatttcaccgacccttctagcattgcggcaagaggatacatcagtactagggtgggcatgggtgaggccgctgccatatttatgacagcaaccccgcccgggtccgtggaagccttcccacaaagcaatgctgtcattcaggatgaggaacgcgacatccctgagcgatcttggaactcaggatatgagtggattacggattttcccggcaagactgtatggttcgtgccatccatcaaaagtggcaatgacatagcgaactgtctgagaaagaatgggaagcgggttattcagctcagcaggaaaacatttgataccgaataccagaagaccaaaaacaacgactgggactacgtggtcactacagatatctcggagatgggagccaatttccgcgcagaccgtgtgatcgatcctagacggtgcctgaagcccgttattcttaaagacggtccagaaagggtgatcctagctggcccgatgcctgtcaccgtggcctctgcagcccaacgccgagggagaattggacggaaccacaataaggagggcgatcagtatatatacatgggtcagcccctgaacaatgacgaggatcatgctcactggacagaagccaagatgttgttagacaacatcaatactccagaggggattatccccgcgctgttcgaacctgagagggaaaaatccgcagccgtagatggcgagtatcgcctcagaggagaggctaggaagacgtttgtggaactgatgcggcgtggcgaccttccagtttggctgagctacaaagtcgcctcagaggggttccagtatagtgatcgccgatggtgctttgacggagaaagaaacaatcaagtgctcgaggaaaacatggatgtggagatctggaccaaggagggtgaaaggaaaaagttgcggccccgctggctggacgctagaacatactctgaccctctagcactgagggagttcaaagaatttgccgctggccggcgatccgtcagcggggatctcattcttgagataggaaagctgccgcagcacttaactcagagagcccagaatgcattggacaacctggttatgctccataattcagaacaaggcggtcgcgcgtataggcacgccatggaggagctgccagataccatcgaaacacttatgctgctcgctttgattgccgtgctgaccgggggcgtaactttattctttctaagtggacggggcctggggaagacgagcatcggactcctttgtgtgatggcatcctctgtcctgttgtggatggctagcgtggagccccattggattgccgcatccatcatactggagttctttctcatggttctgcttatccctgagcccgaccgtcagagaaccccacaggataaccagctcgcctacgtggtcattggtctgttgttcatgatcctgacagtagctgcgaatgagatgggcttactagaaactaccaaaaaggacctggggattggacacgtggccgttgagaaccaccatcacgcagctatgctcgatgtggaccttcatcctgcctcagcctggacactgtacgcagtcgctaccactatcataacacccatgatgaggcacacgattgaaaacaccactgccaatatctctttgacagcgattgctaaccaagccgcaatcctgatgggcctcgataaaggttggccaataagtaagatggacatcggggtgcctctgcttgccttaggctgctattcgcaggtcaatccgctgaccctcaccgctgcagtgttgatgctggttgcccattacgcgattatcggacccggcctacaggctaaagccacacgcgaggcacaaaagcggactgccgctgggattatgaagaacccaacggtggatggaatcgtagccatagacctggatcctgtggtctatgacgcaaaatttgaaaagcagctcggccagattatgcttctgatcttgtgtaccagccagatcctgctcatgcgaacaacttgggctctgtgcgagtccattaccttagccacaggtccccttaccactctgtgggaggggtctccaggaaaattctggaatacgacaatcgcggtttcaatggccaacatatttagaggcagctacctcgcaggagctggcctagccttctccctgatgaagagtctagggggaggcaggcgcgggaccggagcacaaggcgaaactctgggtgagaaatggaagcggcagctcaatcagctttctaagagcgagttcaacacctataaaagatcagggattatggaggtggaccgttccgaagctaaggagggactgaaaaggggcgagacaactaagcacgccgtcagtcggggtaccgccaaattgcgctggtttgtggaacgaaatctggtaaagcctgagggcaaggtgatcgatctcgggtgtggaagaggcgggtggagctactattgcgcgggactaaagaaggttacagaagtgaaaggctacacgaagggtgggcccggacacgaggaaccgattccaatggctacctacggctggaacctggtcaaacttcattctggcaaggacgtgttctttatccctcccgagaaatgtgatactctgctatgcgacataggggagtcctcaccaaatcccacaatcgaagagggaaggaccctccgggtcctgaagatggtggaaccttggttgcgcggtaaccagttctgtattaagatcctgaatccgtatatgcccagcgttgtagagactctcgagcaaatgcagagaaaacacggcgggatgcttgtgaggaacccactgtcgcgaaattctacacatgaaatgtactgggtcagttgcggaaccggcaacattgtgtccgcagttaatatgacgagccggatgttactgaaccgttttaccatggcccacagaaagcctacatatgagcgcgatgtggacttgggtactgggaccaggcacgtcgctgtggaacccgaggtagccaacctcgatatcattggacagcggatcgaaaatataaaacatgagcacaagtcaacatggcattacgacgaggataacccttataaaacttgggcataccacggctcctatgaagtgaagccatctggcagcgccagttccatggttaatggggtcgtgaagctgctaaccaaaccctgggacgtgattcctatggtcacacagatcgctatgaccgatactacgccattcggacaacagagagtttttaaggagaaagtggacacacgcacccccaaggcgaaaaggggtactgcccagatcatggaagtaaccgcacgatggctttggggcttcctgagccggaacaagaagccgagaatttgtacaagggaggaatttacgcgcaaagtgcgttctaatgctgccataggggcagtcttcgtggacgagaaccaatggaactcagccaaggaggctgttgaagatgagcggttttgggacctcgtgcatagagaaagggagctgcacaaacagggaaagtgcgcaacctgcgtctacaacatgatgggcaaacgcgaaaagaagttgggtgagttcgggaaagcgaagggaagtcgagcaatctggtacatgtggctgggcgcccggtttctcgagttcgaagctcttggcttcatgaatgaggatcactggttttccagagaaaacagcctgtctggggtggagggagagggtttacataaactgggctatattttgagggacatctcgaagattcctgggggaaatatgtacgccgatgacactgcaggctgggatacacgcatcaccgaagacgatctccagaacgaggctaaaataactgacatcatggaaccagagcacgccctgctagctaaggccattttcaaacttacatatcagaataaggtagttagagtgcaacggcccgcaaagaacggtaccgtcatggatgtgatctcaaggcgtgaccagcgagggagcggacaggtgggcacatacggcctgaatacttttaccaacatggaagcgcagctcattcgccaaatggagtccgaggggatcttcagtccttctgaactggagacgccaaacttggccgaaagagctttagattggctggagaaatatggagtcgaacggctcaagaggatggccataagcggtgacgactgtgttgtgaaacccattgatgaccgctttgcaaccgctcttacagccctgaatgatatgggcaaggtaagaaaagacatcccgcagtgggagccttccaaggggtggaacgattggcaacaggtgcccttctgctcacatcactttcaccaactaatcatgaaggacggacgggagattgtcgtgccatgtaggaatcaggatgaactggttggccgagcacgtgtgagtcagggtgccgggtggtctctcagagagactgcgtgcttgggaaaaagctacgctcagatgtggcaactgatgtatttccatcgccgggaccttaggctggccgcaaacgccatatgttccgctgtccctgtggattgggtacccacctcaagaacaacttggagcatccacgcccatcaccagtggatgaccacggaagacatgctctctgtttggaatcgcgtgtggattgaggaaaacccatggatggaggataagacacatatctccagttgggaggacgtcccctacttaggcaaacgggaagaccagtggtgcggcagcctgattgggttgaccgcaagggctacttgggccacaaatatccaagtggcgataaaccaggttcgaagactgatcggaaatgagaactacctcgattatatgacctcgatgaagcggtttaaaaatgaatccgaccctgagggtgctctttggtga

SEQ ID NO: 13672 - RNA, 9879 nt, synthetic construct
  misc_feature 1..9879: note = derived and/or modified CDS sequence (opt3) from DENV-1__FJ461327__SS-prME
  source 1..9879: mol_type = other RNA
agcgtgaccatgctgctcatgcttatgcccaccgcactggctttccacttgactacgcggggaggggaacctcatatgatcgtctccaagcaggaaaggggaaaatctttactgtttaagacctcagccggtgttaacatgtgcacgctaattgccatggacctcggcgaactgtgtgaagatactatgacctacaaatgcccacggataacagaaaccgaaccggacgatgtggactgttggtgcaatgcgactgatacatgggtgacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaggacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaggcccctacaaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccgggagcttcaaactggagaaggaagtcgccgagacgcagcacggtacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattgtgatcggtgccggggaaaaagctctgaagctctcctggttcaagaaaggctcaagtatcggaaagatgtttgaggccaccgcaagaggcgccaggcggatggctattctgggggatacagcctgggacttcggaagcatcggtggcgtttttacgtccgtggggaaacttgtccatcagattttcggaaccgcatacggcgtgctgttttctggtgtaagctggactatgaagatagggatcggcgtgttgctcacatggctgggattaaattcacgaagtacctccctgagcatgacatgtattgcggttggcctagtcactctctacctgggggtgatggtgcaggctgattctggatgcgtcatcaactggaaaggccgcgaacttaagtgtggttcagggatcttcgttaccaatgaggtgcacacgtggacagaacaatataagtttcaggccgacagtccgaaaagattgagcgcagccattggaaaggcttgggaggagggcgtgtgcggtataaggtccgccacccggctggaaaacatcatgtggaaacagatttctaacgagctcaatcatatcctgttagaaaacgacatgaagttcactgtagtcgtgggcgatgttgcagggattctggctcagggcaagaagatgatccgccctcaacccatggagtacaaatattcgtggaaaagctggggcaaggccaagataatcggggcggacgtgcagaataccacatttattatcgatggaccaaacactcctgaatgtcccgacgatcagagagcctggaatatttgggaggtcgaggactacggcttcggtatctttaccacaaacatatggcttaagttgagggattcctatacacaggtgtgcgaccaccgtctcatgtcagctgcaattaaagatagtaaggccgttcacgctgacatggggtactggatcgaatctgagaaaaatgaaacctggaagctggcccgggcatccttcattgaggtgaagacttgtatctggccaaaatcccatacactatggtcaaacggagtactggaaagcgagatgataatccccaagatttatggcggtcctatctctcaacacaattaccgaccaggctacttcacccaggcggccgggccgtggcatctcggaaaactggagcttgattttgacttgtgcgaaggcactacagtcgtggtggatgagcactgcgggaacagaggaccctccctgaggaccacgactgtcaccggcaagattatccacgaatggtgttgccgcagttgtacattacctccactccggttcagaggtgaggacgggtgctggtatggaatggagataaggcccgttaaagaaaaggaggaaaatctggtaaagagcatggtatctgctggctccggtgaggtggactcatttagtcttggcctgttgtgtattagcatcatgatcgaagaggtcatgcgctcgcgatggtcccggcgtatgctcatgaccgggactctggccgtgttctttctactgattatgggacagctcacatggaacgatctgatcagactttgcattatggttggcgcaaatgcttctgacaggatggggatgggaaccacatacttggccctgatggcaactttcaaaatgcgccctatgtttgccgtgggcttactcttccggagactgaccagcagggaggtccttctgctaacgataggtctctcactggtggctagtgttgaattgccaaactccctggaggaattaggggatggactcgcgatgggcatcatgattctgaaacttctgacagactttcaatctcatcagttgtgggccaccctcctgagcctaactttcatcaaaaccacattttccctgcactatgcatggaagactatggctatggtgctttcaattgtcagcctcttccccctgtgtttgagtaccacgtctcagaaaacaacctggctgccggtattactcggctccctggggtgcaagcctcttactatgtttctgatcgccgagaataagatatggggacgacgcagctggccattgaacgaaggtatcatggccgtgggcattgtttcgatcctcctgtcatctctactgaaaaacgatgtgccccttgctgggcctctcattgcaggaggcatgctgatcgcctgttacgtcataagtggttccagcgcggacttgtctttagagaaggctgccgaggtgagctgggaagaggaagcagagcattccggggcctcacacaatattctggtagaagtgcaggatgacggaacaatgaaaatcaaggatgaggagcgggacgataccctcactatcctgcttaaagctacactgttggcagtcagtggcgtttatcccctaagcattccagccaccctgttcgtgtggtacttctggcaaaagaaaaagcagagatctggcgtgctctgggacacgccttcacccccagaagtcgagagggcggtgctggatgacgggatatatcgtatcatgcagcgcggacttttaggtcggagccaggttggcgtaggggtgtttcaagaaaacgtcttccatactatgtggcacgtgaccagaggagctgttctgatgtaccagggcaagaggctcgagccgagttgggccagcgtgaaaaaggacttgatttcctacggtgggggatggcgactgcagggctcttggaatacaggcgaggaagtccaggtgatcgcagtagagcctgggaaaaaccccaagaatgtccaaaccgccccaggaacatttaaaactcccgaaggtgaggtgggcgctattgccctcgatttcaagcctgggacctcgggaagcccaatcgttaaccgggaaggcaagatagtgggtctgtatgggaatggagtcgtgacgacatcaggcacttacgtttccgcaatcgctcaggccaaagcgagtcaggagggcccccttcctgagattgaagacgaggtgtttcgcaagagaaacctgaccatcatggatttgcacccggggtctggaaaaacaaggcggtatctaccagccattgtccgagaagcaatcaagagaaaactgcgcaccctcatattagctcccactagggtggtagccagcgagatggctgaagcactgaagggtatgcctattcgttaccaaaccacagccgtgaagtccgagcatacgggcaaagagatcgttgaccttatgtgccacgccactttcaccatgcggctgctctcaccagtcagagtgcccaattataacatgatcattatggatgaagctcattttacagacccttctagcatcgcggcaagggggtacataagtacccgcgtgggaatgggcgaggccgctgccattttcatgactgcaacaccgcccggttccgtcgaagcctttccacagagcaatgctgtaatccaggatgaggaacgagacattcctgagagatcttggaactcagggtatgagtggatcaccgatttccccggaaagacggtgtggtttgttccatccataaaaagtggcaatgacattgcgaactgtttgcggaagaatggcaaaagggtgatccagctgagccgcaagactttcgatacagaataccaaaagaccaaaaacaacgactgggactacgtcgtgaccactgatatctcggagatgggggccaatttccgtgcagacagagttattgatcctcggaggtgcctcaagcccgtgatcctgaaagacggaccagaacgcgtcattcttgctggtccgatgcctgtgacagtagcctctgcagcccagcgaagaggccggatagggaggaaccacaataaggagggagatcagtatatctacatgggccagcccctaaacaatgacgaggatcatgctcactggaccgaagccaaaatgctgttggacaacattaatacaccagagggtatcatccccgcgttatttgaacctgagcgcgaaaagtccgcagccattgatggggagtatagactgaggggcgaggctcggaagactttcgtggaactcatgcgtcgcggagacctgccagtttggcttagctacaaagtcgcctcagagggctttcaatatagtgatcgaagatggtgcttcgacggggaaaggaacaatcaggtgctggaggaaaacatggatgtggagatatggacgaaggagggagaacggaaaaagctccgccccagatggttggacgctaggacctactctgaccctctggcactacgggagtttaaagagttcgccgctggtcgaagatccgtcagcggcgatctgatcctcgagattgggaaacttccgcagcacctgacacagcgcgcccaaaatgcattagacaacttggttatgctgcataattcagaacagggaggcagggcgtatcggcacgccatggaggagctcccagatactatcgaaaccctgatgcttctggctctcattgccgtgttgacaggtggggtaaccctgtttttcttaagtggccgtggactaggcaaaactagcatcgggctgctctgtgtgatggcatcctctgtccttctgtggatggctagcgtggagccccattggatagccgcatccatcattttggaatttttcctgatggttctcctgatccctgagcccgacagacagaggacgccacaggataaccaacttgcctacgtggtcattggactcctgtttatgatcttgaccgtagctgcgaatgagatgggtctgttagaaacaactaagaaggacctaggcatagggcacgtggccgttgagaaccaccatcacgcagctatgctggatgtggacctccatcctgcctcagcctggaccctttacgcagtcgctacaaccattatcactcccatgatgcgccacacaattgaaaacacgaccgccaatatctctctgactgcgatagctaaccaggccgcaatcttgatgggactggataaaggctggccaattagtaagatggacatgggtgtgcctctcctggcccttgggtgctattcgcaggtcaatccgttaacactgaccgctgcagtgctcatgttggttgcccattacgcgatcattggccccggactgcaagctaaagccacccgggaggcacagaagcgaacagccgctggcatcatgaaaaacccaactgtggatgggatagtagccattgacctagatcctgtggtctatgacgcaaagttcgaaaagcagctgggacagatcatgctccttatcctgtgtacgagccaaattttgctgatgagaaccacatgggctctctgcgagtccatcactctggccaccggccccttaacaaccctttgggagggttctccagggaaattttggaatactacgatagcggtttcaatggccaacattttcaggggaagctacctggcaggcgctggtctcgccttctccctaatgaagagtctgggcgggggacgccggggcacaggggcacagggagaaaccttgggcgagaaatggaagagacagctgaatcagctctctaaaagcgaatttaacacttataagcgttcaggtatcatggaggtggacaggtccgaagctaaggaggggcttaaacggggagagaccacaaagcacgccgtcagtcgcggcactgccaaactgcgatggttcgtggaaagaaatttggtaaagcctgagggtaaagtgattgatctgggctgtgggaggggaggctggagctactattgcgcggggctcaagaaggttaccgaagtgaaaggatacacaaagggcggtcccgggcacgaggaaccgatcccaatggctacgtacggatggaacttagtcaaactgcattctggcaaggacgtgtttttcatacctcccgagaaatgtgatacccttctgtgcgacatcggcgagtcctcaccaaatcccactattgaagaggggcggacactacgcgtcctcaagatggtggaaccttggctgagaggaaaccaattttgtatcaaaattttgaatccgtatatgcccagcgttgtagagaccctggagcagatgcagaggaagcacggtggcatgctcgtgcgaaacccactttcgagaaattctactcatgaaatgtactgggtcagttgcgggacaggaaacatcgtgtccgcagttaatatgaccagccgtatgctgttaaacagattcacgatggcccaccgcaagcctacctatgagagggatgtggacctgggcgctggtacacggcacgtcgccgtggaacccgaggtagcaaacttggatattatcgggcagagaatagaaaatattaaacatgagcacaagtcaacttggcattacgacgaggataacccttataaaacctgggcctaccacggatcctatgaagtgaagccatctggcagcgctagttccatggttaatggcgtcgtgaaactcctgacaaagccctgggacgtgatccctatggtcactcaaatcgcgatgaccgatacaaccccatttgggcagcagcgcgttttcaaggagaaagtggacactaggacgcccaaggccaaacgaggaacagcacaaattatggaagtaaccgctaagtggctatggggttttcttagccggaacaaaaagccgagaatatgtactagggaggagttcacccgcaaggtgcgttctaatgccgcaatcggcgccgtctttgtggacgagaaccagtggaactcagctaaagaggccgttgaagatgagcggttctgggacctggtgcatagagaaagggagctccacaagcaggggaaatgcgcgacatgcgtctacaacatgatgggaaagcgcgagaagaagctgggcgagtttggtaaggcaaaagggagtcgagccatttggtacatgtggttgggagctcggttcctggagttcgaagccctcggctttatgaatgaggatcactggttctccagagaaaacagcctttctggcgtggagggggagggactgcataagttaggttatatcctgagggacatttcgaaaatccctggcgggaatatgtacgcagatgacacggctggatgggatacccgcataactgaagacgatttgcagaacgaggccagaatcacagacattatggaaccagagcacgctctcctggccaagtcaatctttaaactaacctatcaaaataaggtagttcgggtgcagaggcccgccaaaaatggcactgtcatggatgtgattagccgtcgagaccagcgcggttccggacaggtgggaacatacggccttaataccttcacaaacatggaagcgcaactgatcagacagatggagagtgagggcatattttctcctagcgaactcgagactccaaacctggccgaacgggtcttggattggttagagaagtatggggttgaaaggctgaagcgcatggctatttccggagacgactgtgtggtaaaacccatcgatgacagattcgccaccgcactcacggctcttaatgatatgggtaaggtgcggaaagacatcccgcagtgggagccttcaaagggctggaacgattggcagcaagtccccttttgcagtcatcacttccaccagctgattatgaaagacgggagggagatagtggttccatgtcgaaatcaggatgagctagtgggacgtgccagagtctctcagggcgcaggttggagcctgcgcgagaccgcctgcctcgggaagtcctacgcgcaaatgtggcagttgatgtattttcatcggagggacctgagacttgctgccaacgcaatctgttcagccgtgcctgtagattggattcccacaagccgcactacctggtctatccacgctcatcaccagtggatgacaactgaagacatgctgtccgtttggaatcgggtgtggattgaggaaaacccatggatggaggataagacccatatcagtagctggggagacgtcccctacctcggcaaaagggaggaccaatggtgcggctcgttaatagggctgacggcccgagcaacatgggctaccaatatccaggtggccattaaccaggttagacggttgatcggaaatgaaaactacctggattatatgacttccatgaagaggttcaaaaatgagtctgaccctgaaggtgcgctctggtga

SEQ ID NO: 13673 - RNA, 9879 nt, synthetic construct
  misc_feature 1..9879: note = derived and/or modified CDS sequence (opt3) from DENV-1__FJ461328__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagctgtgtgaagatactatgacctacaaatgcccacggataacagaggcggaaccggacgatgtggactgttggtgcaatgctaccgatacttgggtaacatatgggacctgtagtcaaacgggagagcaccgccgagagaagcgtagcgtggcccttgcaccccatgtcggcctgggtttggaaactagaaccgagacatggatgtcctctgaaggggcctggaaacagatccagagggtggagacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagactttgtggagggtcttagtggcgcgacttgggtagatgttgtgttggaacacgggtcctgtgtcacaaccatggcaaaggacaaacccactctggatatcgagctactcaagacagaagtgaccaaccctgccgtgctgaggaaactttgcattgaggctaagatctctaatacgaccacagacagccggtgtccaactcaaggagaagccaccctggtcgaggagcaggatgcaaacttcgtttgccgccgaacatttgtggacagaggctggggtaatgggtgtggattgttcggcaaaggctccctcctgacttgcgctaagtttaagtgcgtaaccaaattagaagggaagatagtgcagtacgagaacctgaaatattcagtcattgtgacagttcacaccggagatcagcatcaagtgggtaatgaaagtactgagcacggcacgacagccaccatcactccccaggcgcctaccacagaaattcagctcaccgactacggggcccttactctggactgtagcccaaggacaggattggatttcaacgagatggtcctactgacgatgaaggagaaatcttggctcgtgcataagcagtggtttctggaccttccgctgccctggacctccggcgcatcaactagccaagaaacatggaatcggcaggatttgctcgtaaccttcaaaacagctcacgccaagaagcaggaggttgtggtcctgggtagtcaagaaggggctatgcacactgccttaaccggcgcaacggagatccagacctctggaacaactaccatctttgccggccatctgaaatgccgtctaaagatggacaaactcacactgaaggggatgtcctatgtgatgtgtactggaagcttcaaacttgaaaaggaggtcgctgagacccagcacggtacggtgttggttcagattaagtacgaaggcacagatgcgccttgcaaaataccattctcgacccaagacgagaagggggtgactcagaacggacgcctgatcacagcaaatcccattgtaaccgataaagaaaagcctgtcaacatcgaggccgagccaccctttggcgaatcttatatagtgattggtgctggggagaaagccctcaagctgtcctggttcaagaaaggctcaagtatcggaaagatgtttgaagcaactgccagaggcgctaggcggatggccatccttggggacaccgcatgggatttcggaagcattggtggcgtttttacatccgtggggaaactggtccatcagatcttcggaacggcgtacggcgtgttgttttctggtgtaagctggaccatgaagattgggataggcgtgctcctgacttggttaggactgaattcacgaagtacatccctaagcatgacctgtatcgctgttggcctcgtcacactgtaccttggggtgatggtgcaggccgactctggatgcgtcattaactggaaaggccgcgagttgaagtgtggttcagggatcttcgttactaatgaagtgcacacctggacggagcaatataagtttcaggcagatagtccgaaaagactgagcgccgctatcggaaaggcctgggaggaaggcgtgtgcggtattaggtccgcaacacggctcgagaacataatgtggaaacagatctctaacgaactgaatcatattttactggagaacgacatgaagttcaccgtagtcgtgggcgacgttgctgggatccttgtgcagggaaaaaagatgattcgccctcaacccatggaatacaaatattcgtggaagagctggggcaaggccaaaatcataggggcggatgtccagaattccacttttatcattgacggaccaaacacccctgagtgtcccgatgaccagagagcctggaatatctgggaggtggaagattacggcttcggtatttttacaactaacatctggttgaagctcagggactcatatacccaggtttgcgatcaccgtctgatgagtgctgcaataaaagactctaaggccgtgcacgctgatatggggtactggattgagagcgaaaaaaatgagacatggaagctagcccgggcatccttcatcgaagtaaagacgtgtatttggccaaaatcacataccctgtggagcaacggagtcctcgagtctgagatgatcatacccaagatccacggcggtcctatttcccaacataattatcgaccaggctacttcactcagacagcggggccgtggcacctgggaaaacttgaattggactttgatctgtgcgagggcaccactgtggtggtcgacgaacactgcgggaacagaggacccagtttaaggacaaccacggttactggcaagatcattcatgagtggtgttgccgcagctgtaccctccctccactgcggttcagaggtgaggatgggtgctggtacggaatggaaatcaggcccgtgaaagagaaggaagagaatcttgtaaagtctatggtgtccgccggctcaggtgaagtcgacagttttagcctgggcttgctctgtatatcgattatgatcgaggaggtgatgcgctcccgatggtctcggaaaatgctgatgacagggaccctagctgttttctttctgctcatcatgggacagctgacttggaacgaccttattcgtttgtgcatcatggtgggcgccaatgcaagcgatagaatggggatgggaacaacctatctggctttaatggccacattcaagatgaggcctatgtttgcagtcggcctcctgttccgccggcttacttcaagagaagtgctgctactcaccattggtctgagtttggttgcctccgtggagctgccaaactctttagaagagctcggggacggactggctatgggcataatgatccttaaactgttgacggattttcaaagctaccagctctgggcgacactgctatccctgaccttcattaagactaccttttcacttcactatgcctggaaaacaatggcaatggtcctcagcatcgtaagtctgttccccttgtgtctgtctactacctcccagaagacgacatggttaccggtgctcctgggcagccttgggtgcaagcctctgaccatgtttttgattgctgaaaataaaatctggggaaggaagtcgtggccactcaacgagggtataatggccgttggcatcgtgtcaattctgctatctagtctgcttaaaaacgacgtccccctcgccgggcctctgatcgctggaggcatgttgattgcatgttacgtgatctccggtagctctgccgatttaagcctggagaaggcggctgaagtatcctgggaggaagaggccgaacattcaggggcaagtcacaatatactcgtggaggtccaggacgatggaactatgaaaattaaggacgaggaacgagatgacacactgaccatccttctgaaagccactttgctagctgttagcggcgtgtatcccctgtctatcccagcaacactcttcgtgtggcatttctggcaaaagaagaaacagcgctccggcgtcctgtgggataccccttcacccccagaggtggaacgggccgttcttgacgatgggatttacagaataatgcagaggggattactgggtcgtagtcaggtaggcgtgggggtctttcaagagaacgtgttccacacgatgtggcacgttactcgcggagcggtgctcatgtatcagggcaagcggttggagccgagctgggcttccgtcaaaaaggacctgatctcttacggtgggggatggagatttcagggctcgtggaataccggcgaagaggtgcaggtaattgccgtcgaacctgggaaaaaccccaagaatgtgcaaacagcaccaggaaccttcaagacacccgagggtgaagttggcgccatcgctctcgactttaaacctgggactagcggatcaccaattgtgaacagggagggcaagatcgtcggtctgtacgggaatggagtggttaccacgtccggcacatatgtgagtgccatagcacaggctaaagcctctcaggagggcccccttcctgaaatcgaggatgaagtcttccgaaagcggaacctgactattatggacttgcatccggggagcggaaaaacccgcagatacctaccagcgatcgtgagggaggccattaagcggaagctgcgaacactcatcttagcacccaccagagtagtggcttccgaaatggccgaggctctgaaaggtatgcctatacgctatcaaactaccgcagttaagtcagagcacacaggcaaagaaattgtcgatcttatgtgccatgccacgtttactatgaggctgctctctccagtgcgtgtgcccaattacaacatgatcatcatggacgaggcccacttcaccgatcctagcagtattgctgcgcgggggtatatctccacaagagtcggaatgggcgaagcagccgctatatttatgaccgccactccgcccggtagcatggaggcattcccacagtctaatgccgtaattcaggacgaagagagggatatccctgagcgctcatggaactccgggtacgaatggattacagactttcccggaaagaccgtgtggttcgttccaagtatcaaagctggcaatgatatagcgaactgtttgcgaaagaatggcaagagagtgattcagctgagccggaaaacgttcgacactgagtatcaaaagacaaaaaacaacgattgggactacgtcgtgaccaccgacatctcggaaatgggggccaattttagggcagatcgcgttatcgaccctcgtagatgcctcaagcccgtgattctgaaagatggaccagagcgggtcatccttgctggtccgatgcctgtgactgtagcctctgcagcccagaggcgcggccgaattgggagaaaccataataaggagggagaccagtacatatatatgggccagcccctaaacaatgatgaagaccacgctcactggacagaggccaagatgctgttggataacatcaataccccagaaggtattatccccgcgttattcgagcctgaacgggagaaatccgcagccatcgacggggagtacaggctgcgcggcgaagctagaaagacatttgtggagctcatgaggcggggagatctgccagtttggcttagctataaagtcgcctcagaaggcttccaatacagtgaccgtcgctggtgctttgatggggagcgaaacaatcaggtgctggaagagaacatggacgtggagatttggactaaggaaggagagagaaaaaagctcaggccccggtggttggatgctcgcacgtattctgaccctctggcactaagagaattcaaagagtttgccgctggtaggcggtccgtcagcggcgacctgatactcgaaatcgggaagcttccgcagcatctgacccagcgagcccaaaatgcattagataacttggttatgctgcacaattcagagcagggaggcagagcgtaccgccatgccatggaggaactcccagacacaattgagactctgatgcttctggctctcatcgccgtgttgaccggtggggtaacactgttctttttaagtggcaagggactaggcaaaaccagcattgggctgctctgtgtgatggcatcctctgtccttctgtggatggctagcgtggaaccccactggatcgccgcatccataatcttggagttctttctgatggttctcctgattcctgagcccgataggcagcggactccacaggacaaccaacttgcctatgtggtcatcggactcctgttcatgattttgacggtagctgcgaatgaaatgggtctgttagagaccacaaagaaagatctaggcatcgggcacgtggccgttgaaaaccatcaccatgcagctatgctggacgtggatctccaccctgcctcagcctggactctttacgcagtcgctaccacaataattacccccatgatgcgtcatactatcgagaacacaacggccaatatttctctgaccgcgatcgctaaccaggccgcaatattgatgggactggacaagggctggccaatcagtaaaatggatattggtgtgcctctcctggcccttgggtgctactcgcaggtcaatccgttaactctgacagctgcagtgctcatgttggttgcccactatgcgatcattggccccggactgcaagctaaggccaccagagaagcacagaagaggaccgccgctggcatcatgaaaaacccaacaatagacgggattgtggccatcgatctagaccctgtagtgtacgatgcaaagtttgagaaacagctgggacagatcatgctccttattctgtgtactagccaaatcttgctgatgcgcacgacctgggctctctgcgagtccataacactggccactggccccttaaccacactttgggaaggttctccagggaagttctggaataccactattgcggtctcaatggccaacatcttccggggaagctatctggcaggcgctggtctcgccttttccctaatgaaaagtctgggcgggggacgaagaggcacgggggcacagggagagacattgggcgaaaagtggaagaggcagctgaatcagctctctaaaagcgagttcaacacctacaagcgctcaggtattatggaagttgaccggtccgaggctaaagaggggcttaagagaggagaaactaccaaacacgccgtgagtcgtggcacagccaagctgaggtggtttgtcgagcggaatttggtgaagcctgaaggtaaagtaatcgacctgggctgtgggcgcggaggctggagctattactgcgcggggctcaagaaagtgactgaggttaagggatataccaaaggcggtcccgggcatgaagagccgataccaatggctacatacggatggaacttagtgaagctgcactctggcaaagatgtcttctttatccctcccgagaagtgtgacacgcttctgtgcgatattggcgaatcctcaccaaatcccaccatcgaggaagggcgaactctaagagtgctcaagatggtcgagccttggctgaggggaaaccaattctgtattaaaatcttgaatccgtacatgcccagcgtggttgagacactggaacagatgcagcggaagcatggtggcatgctcgtacgcaacccactttcgagaaattctacccacgagatgtattgggtgagttgcgggactggaaacattgtctccgcagtgaatatgacaagcaggatgctgttaaaccgatttaccatggcccaccggaaacctacgtacgaacgtgacgttgatctgggcgctggtaccagacatgtggccgtcgagcccgaagtggcaaacttggacatcatagggcagcgcattgagaatatcaagcacgagcataaatcaacatggcactatgatgaagacaacccttacaagacttgggcctatcatggatcctacgaggtaaagccatctggcagcgctagttccatggtgaatggcgttgtcaaactcctgaccaagccctgggatgtgatccctatggtgacacaaattgcgatgactgacaccacaccattcgggcagcagagggtctttaaagaaaaggttgatacccggactcccaaagccaagagaggaacggcacaaataatggaggtgacagctcgctggctatggggtttccttagcaggaacaagaaaccgcgaatctgtacccgggaagagtttactagaaaggtaaggtctaatgccgcaattggcgccgtgttcgtcgacgagaaccagtggaattcagctaaagaagccgtggaggacgatcgcttttgggacctggttcaccgtgaacgggagctccacaagcaggggaaatgcgcgacctgcgtgtataacatgatgggaaagagagaaaagaaactgggcgagttcggtaaggcaaaagggagtagggccatctggtacatgtggttgggagctcgcttcctggagtttgaagccctcggcttcatgaatgaggatcattggttttcccgagaaaacagcctttctggcgtcgagggggagggactgcacaagttaggttacattctgcgggacatctcgaaaatacctggcgggaatatgtatgcagatgacacagctggatgggatacgagaatcaccgaagacgatttgcagaacgaggccaagattactgacatcatggaaccagagcatgctctcctggccaaatcaattttcaagctaacataccaaaataaggtggtaagggttcagcgccccgcaaaaaacggcaccgtgatggatgtcatcagcagacgggaccagaggggttccgggcaggtgggaacttatggccttaatacatttaccaacatggaagcgcaactgatacgtcagatggagagtgagggcattttcctccctaacgaactggagacaccaaatttggccgggcgagtgttagattggctggaaaagtacggagtcgagcgcctcaaaagaatggctatctctggtgacgactgtgttgtgaagcccatcgatgaccggtttgccactgcacttaccgctctgaacgatatgggcaaagtaaggaaggacattccgcagtgggaacctagcaaggggtggaatgattggcagcaagtgcccttctgctcccaccactttcatcagctaataatgaaagacggacgcgagatcgtcgtgccatgtagaaaccaggatgagctggttggccgggccagggtgtcacagggtgcagggtggagtctccgagaaacggcctgcttgggaaagtcttatgcgcaaatgtggcagctgatgtacttccaccgtagagaccttcgcctggctgccaatgcaatttgtagcgccgtccctgtggattgggtacccacctcccggacaacttggtcaatccatgctcaccatcagtggatgaccacagaggacatgctcagcgtttggaacagggtgtggattgaagagaatccatggatggaagataaaactagaatctcttcctgggaggacgtcccctatttaggcaagcgcgaggaccaatggtgcggcagtctgatagggttgaccgcccgggcaacgtgggctacaaacatccaggtggccattaatcaggttaggcgactgatcggaaacgaaaattacagcgattacatgacctcgatgaaaagatttaagaacgagtccgaacctgagggtgcgctctggtga

SEQ ID NO: 13674 - RNA, 9879 nt, synthetic construct
  misc_feature 1..9879: note = derived and/or modified CDS sequence (opt3) from DENV-1__FJ410234__SS-prME
  source 1..9879: mol_type = other RNA
agcgtgacaatgctgctcatgcttatgcccacagcactggctttccacttgactacgagaggaggggaacctcatatgatcgtctccaagcaggaaaggggaaaatctttactgtttaagacatcagccggtgttaatatgtgcacattaattgccatggacctcggagaactgtgtgaagatactatgacctacaaatgcccacggataacagaagcggaaccggacgatgtggactgttggtgcaatgctaccgatacttgggtaacatatgggacctgtagtcagacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaattgctcaagacagaggtgaccaaccctgccgtgctgaggaaactttgcattgaagctaagatctctaatacgaccacagatagccggtgtccaactcaaggagaggccaccctggtcgaagaacaggacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatgtgtactggcagcttcaaactggagaaggaagtcgctgagacccagcacggtacggtgcttgttcagataaagtacgagggcacagacgcgccttgcaaaatcccattctcgacccaagatgaaaagggggtgactcagaacggacgcttgattacagcaaatcccatcgtaaccgacaaagagaagcctgtcaacatagaagccgagccaccctttggcgagtcttatattgtgatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtttttacatccgtggggaaacttgtccatcagattttcggaacggcgtacggcgtgctgttttctggtgtaagctggaccatgaagatagggatcggcgtgttgctcacttggctgggattaaattcacgaagtacatccctgagcatgacctgtattgctgttggcctagtcacactctacctgggggtgatggtgcaggccgattctggatgcgtcatcaactggaaaggccgcgaacttaagtgtggttcagggatcttcgttactaatgaggtgcacacctggacggaacaatataagtttcaggcagacagtccgaaaagattgagcgccgctattggaaaggcctgggaggagggcgtgtgcggtataaggtccgcaacacggctggaaaacatcatgtggaaacagatttctaacgagctcaatcatatcctgttagaaaacgacatgaagctgaccgtagtcgtgggcgatgttgctgggattcttggacagggcaaaaagatgatccgccctcaacccatggagtacaaatattcgtggaaaagctgggggaaggccaaaataatcggagcggacgcccagaatactaccttcattatcgatggcccaaacacacctgaatgtcccgacgatcagagagcttggaatatttgggaggtggaggactacggttttgggatcttcactaccaacatatggttgaagctcagggattcctatacacaggtctgcgaccaccgtctgatgtcagcagccattaaagatagtaaggctgtgcacgccgacatgggatactggatcgaatctgagaaaaatgaaacgtggaagctagcacgggcgagctttattgaggttaagacctgtatctggccaaaatcccatactctgtggtcaaacggcgtgctcgaaagcgagatgataatccccaagatttatggtggccctatctctcaacacaattaccgaccagggtacttcacacagaccgccggaccgtggcatctgggcaaacttgagttggatttcgacctgtgcgaagggactacagtagtcgtggatgagcactgcggaaacagaggcccctccttaaggaccacgactgtgaccggtaagattatccacgaatggtgttgccgcagttgtacactccctccactgcggtttagaggggaggacggatgctggtatggcatggagataaggcccgtcaaagaaaaggaggaaaatcttgttaagagcatggtgtctgctggttccggcgaggtagactcattcagtctggggttgctctgtattagcatcatgatcgaagaggtgatgcgctcgcgatggtcccggaaaatgctgatgaccggaactctagccgtctttttcctgctcattatgggccagctgacatggaacgatcttatccgtttgtgcattatggtgggggcaaatgcttctgacagaatgggaatgggcaccacatacctggccttaatggcaacttttaagatgaggcctatgttcgccgttggtctcctgtttcgccggcttaccagcagagaggtgctgctactcacgatagggctgtcattggtcgctagtgtggaactgccatcctctttagaggaactcggagatggcctggcgatgggcatcatgattcttaaactgttgacagacttccaaagccatcagctctgggccaccctgctatccctgacttttatcaagaccgcattctcacttcactatgcttggaaaacaatggccatggttctcagcattgtgagtctgtttcccttgtgtctgtctactacctcccagaagacgacatggttaccggtcctcctggggagccttggatgcaagcctctgaccatgttcttgatcgccgagaacaaaatatggggtaggaagtcgtggccactcaatgaaggcatcatggctgtagggattgtgtcaatcctgctatctagtctgcttaaaaacgatgttcccctcgcaggacctctgattgccggcggtatgttgatcgcgtgttacgtgatatccgggagctctgctgacttaagcctggagaaggccgcagaggtctcctgggaagaggaagccgagcattcaggagctagtcacaacattctcgtggaagtacaggatgacggcactatgaaaatcaaggatgaggagcgagacgatacactgaccatccttctgaaagcaactttgctagccgtgagcggcgtctatcccctgtctattccagcgacactctttgtttggtacttctggcaaaagaagaaacagcgctccggggtgctgtgggacaccccttcacccccagaagtggagcgggctgtccttgatgacggaatatatagaatcatgcagaggggtttactgggccgtagtcaggtgggggttggagtattccaagaaaatgtgtttcatacgatgtggcacgtcactcgcggcgccgtgctcatgtaccagggtaagcggttggagccgagctgggcatccgttaaaaaggacctgatttcttacgggggaggctggagactcaggggctcgtggaacaccggggaggaagtgcaggtcatcgccgtggagcctggcaaaaatcccaagaacgtacagacagctccaggtaccttcaagacacccgaaggcgaggtcggggccattgcactggattttaaacctggaactagcggctcaccaatcgtgaatcgagaaggtaagatagttgggctttatggaaacggcgtggtcaccacgtccggcacatacgtgagtgctatcgcccaagcgaaagcctctcaggaggggcccctgcctgagattgaagacgaggttttccggaagcgcaatttgactatcatggatctacacccgggaagcggtaaaaccagaaggtatctgccagcaattgtgcgggaagctatcaagcgaaagctcagaacattaatactggcccccacccgcgtcgtggcttccgagatggcagaagcccttaaaggcatgcctattaggtaccagactaccgccgtaaagtcagagcatacagggaaagagatcgtggacctgatgtgccacgctacgtttactatgcgtctcttgtctccagttcgggtccccaactataatatgatcattatggatgaagcgcatttcaccgaccctagcagtatcgcagccagaggatacatatccacaagggtgggcatgggtgaggctgccgcaatttttatgaccgccactccgcccgggagcgtggaggctttcccacaatctaacgcggtcatccaggatgaggaacgcgacattcctgagcgatcatggaactccggatatgagtggatcacagattttcccggcaagaccgtatggttcgtgccaagtataaaaagcggcaacgacattgccaattgtctgagaaagaacgggaagcgggttatccagctctcgaggaaaacgtttgatactgaataccagaagaccaaaaataacgactgggactacgtggtcaccaccgatatctctgagatgggagcaaacttccgcgctgaccgtgtgattgatcctagacggtgcctgaagcccgttatccttaaagacggtccagaaagggtgattctagccggcccgatgcctgtcactgtggcatccgccgctcaacgccgagggagaataggacggaatcacaacaaggagggcgatcagtatatctacatgggtcagcccctgaataacgacgaggatcatgcccactggacagaagcgaagatgttgttagacaatattaacaccccagaggggatcatccccgcactgttcgaacctgagagggagaaaagcgccgctgtagatggcgagtatcgcctcagaggagaggccaggaagacatttgtggaactgatgcggcgtggcgaccttccagtttggctgtcatacaaagtcgctagtgaggggttccagtattctgatcgccgatggtgctttgacggagaaagaaataaccaagtgctcgaggaaaatatggatgtggagatttggactaaggagggtgaaaggaaaaagttgcggccccgctggctggacgcaagaacgtactccgaccctctagccctgagggagttcaaagaatttgctgccggccggcgaagcgtctcaggggatctcatacttgagatcggaaagctgccgcagcacttaacccagagagcacagaacgcgttggacaatctggttatgctccataacagtgaacaaggcggtcgcgcctataggcacgctatggaggagctgccagatacaattgaaactcttatgctgctcgccttgatcgcagtgctgaccgggggcgtaacattattctttctaagcggacggggcctggggaagacctccattggactcctttgtgtgatggcttctagcgtcctgttgtggatggcctccgtggagccccattggatcgcagcctcaataatcctggagttctttctcatggttctgcttattcctgagcccgaccgtcagagaactccacaggataatcagctcgcttacgtggtcatcggtctgttgttcatgattctgacggtagcggccaacgagatgggcttactagaaaccaccaaaaaggacctggggatcggacacgtggcagttgagaatcaccatcacgctgccatgctcgatgtggaccttcatcctgcctctgcatggactctgtacgctgtcgccaccacaataattacccccatgatgaggcacactatcgaaaacacaacggcgaacattagtttgaccgctatcgccaatcaagcagccatactgatgggcctcgataaaggttggccaatctcgaagatggacattggggtgcctctgcttgctttaggctgctatagccaggtcaacccgctgactctcacagcagccgtgttgatgctggttgcgcattacgctatcattggacccggcctacaggccaaagcaacccgcgaggcccaaaagcggaccgctgccgggatcatgaagaatccaacagtggatggaatagtagcaattgacctggatcctgtggtctatgacgctaaatttgaaaagcagctcggccagatcatgcttctgatcttgtgtacttcccagattctgctcatgcgaacgacctgggccctgtgcgagtctatcacattagcgactggtccccttaccacactgtgggaggggtcaccaggaaaattctggaacaccactatagccgttagcatggcaaatatttttagaggctcctacctcgctggtgccggcctagcattcagtctgatgaagtctctagggggaggcaggcgcgggacgggagctcaaggcgaaacactgggtgagaaatggaagcggcagctcaaccagcttagcaagtcagagttcaatacctataaaagatccgggatcatggaggtggaccgtagtgaagccaaggagggactgaaaaggggcgagactaccaagcacgccgtcagccggggtacagcgaaattgcgctggtttgtggaacgaaacctggtaaagcctgagggcaaggtgattgatctcgggtgtggaagaggcgggtggtcttactattgcgctggactaaagaaggttactgaagtgaaaggctacaccaagggtgggcccggacacgaggaaccgatcccaatggcaacatacggctggaatctggtcaaacttcattccggcaaggacgtgttctttatacctcccgagaaatgtgatacgctgctatgcgacatcggggagtcaagcccaaaccccaccattgaagagggaaggactctccgggtcctgaagatggtggaaccttggttgcgcggtaatcagttctgtatcaagattctgaacccgtatatgccctcggttgtagagacactcgagcaaatgcagagaaaacacggcgggatgcttgtgaggaatccactgtctcgaaacagtacccatgaaatgtactgggtctcctgcggaactggcaatatcgtgagcgccgttaacatgacatcacggatgttactgaatcgttttaccatggctcacagaaagcctacgtatgagcgcgatgtggacttgggtaccgggacaaggcacgtcgccgtggaacccgaggtagcaaacctcgatattatcggacagcggatagaaaacattaaacatgagcacaagtccacttggcattacgacgaggataatccttataaaacctgggcctaccacggctcttatgaagtgaagccaagcggcagtgcttccagcatggttaacggggtcgtgaagctgctaacaaaaccctgggacgtgatccctatggtcactcagatcgcgatgaccgatacaaccccattcggacaacagagagtttttaaggagaaagtggacactcgcacgcccaaggccaaaaggggtacagcacagattatggaagtaaccgctcgatggctttggggcttcctgtctcggaataagaagccgagaatatgtactagggaggaatttacccgcaaagtgcgttcaaacgccgcaatcggggccgtcttcgtggacgagaatcaatggaacagtgctaaggaggccgttgaagatgagcggttttgggacctcgtgcatagagaaagggagctgcacaaacagggaaagtgcgcgacatgcgtctacaatatgatgggcaaacgcgaaaagaagttgggtgagttcgggaaagcaaagggatcccgagccatttggtacatgtggctgggcgctcggtttctcgagttcgaagcccttggcttcatgaacgaggatcactggtttagcagagaaaattctctgtcgggggtggagggagagggtttacataaactgggctatatcttgagggacatttcaaagatccctgggggaaacatgtacgcagatgacacggctggctgggatacccgcataactgaagacgatctccagaatgaggccaaaatcacagacattatggaaccagagcacgctctgctagccaaggcaatcttcaaacttacctatcagaacaaggtagttagagtgcaacggcccgcgaagaatggtactgtcatggatgtgattagcaggcgtgaccagcgagggtccggacaggtgggcacatacggcctgaacacctttacaaatatggaagcccagctcatccgccaaatggagagtgaggggatattctctcctagcgaactggagactccaaacttggctgaaagagccttagattggctggagaaatatggagtcgaacggctcaagaggatggcaatttccggtgacgactgtgttgtgaaacccatcgatgaccgctttgctaccgcccttacggcactgaacgatatgggcaaggtaagaaaagacatcccgcagtgggagccttcaaaggggtggaatgattggcaacaggtgcccttctgcagtcatcactttcaccaactaattatgaaggacggacgggagatagtcgtgccatgtaggaaccaggatgaactggttggccgagcccgtgtgtctcagggtgcggggtggagcctcagagagaccgcttgcttgggaaaatcctacgcccagatgtggcaactgatgtatttccatcgccgggaccttaggctggcagccaatgctatctgttcagccgtccctgtggattgggtacccacaagcagaactacctggtctattcacgcacatcaccagtggatgacaactgaagacatgctctccgtttggaaccgcgtgtggatcgaggaaaatccatggatggaggataagacccatattagtagctgggaggacgtcccctacttaggcaaacgggaagaccagtggtgcggctcgctgatcgggttgacggctagggccacatgggcgaccaacatacaagtggctatcaatcaggttcgaagactgattggaaacgagaattacctcgattatatgacttccatgaagcggtttaaaaacgaatctgaccctgagggtgccctttggtga

SEQ ID NO: 13675 - RNA, 9879 nt, synthetic construct
  misc_feature 1..9879: note = derived and/or modified CDS sequence (opt3) from DENV-1__FJ410235__SS-prME
  source 1..9879: mol_type = other RNA
agcgtgaccatgctgctaatgcttatgcccactgcactggctttccacttgactacgcgaggcggggaacctcatatgatcgtctccaagcaggaaaggggaaaatctttactgtttaagacctcagccggtgttaacatgtgcactctaattgccatggacctcggcgagttctgtgaagatactatgacctacaaatgcccgcggataaccgaagcggaaccggacgatgtggactgttggtgcaatgctaccgatacttgggtaacctatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacgtcgattacccagaagggcatcatatttatcctgctcatgttagtgacgccatcaatggccatgcgctgcgtcgggattggaagcagagatttcgtggagggtctgagtggcgcgacttgggttgacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaagacgcaaactttgtttgccgccgaacattcgtggatagaggctggggtaatgggtgtggactgtttggcaaaggctccttgataacttgcgctaagttcaagtgcgtaaccaaactcgaggggaagacagtgcagtacgaaaacctgaaatattcagtcattgtgaccgttcacactggagaccagcatcaagtgggtaatgagagtacggaacacggcacaaccgccactatcacaccccaggcgcctagcacagagattcagttaaccgactacggggccctgactctcgattgttctccaaggacaggacttgactttaacgaaatggtcctgttgacgatgaaggagaaatcctggctagtgcataagcagtggttcctggatctcccgctgccctggacctcaggcgcaagcacaagtcaagagacatggaatcggaaagaccttctggtaacctttaagacagctcacgccaagaaacaggaagttgtggtcttgggttctcaggagggggctatgcacactgccctcaccggcgcaacggaaatccaaacctccggaacaactaccatcttcgccggccatctgaagtgccgtttaaaaatggataagctgacactaaaagggatgagctatgtgatgtgtactggatcgttcaagctcgagaaggaagtcgctgagacccagcacggtacggtgctggttcagattaaatacgagggcacagacgcgccttgcaagataccattttctacccaggatgaaaaaggggtgactcaaaacggacgccttatcacaaccaatcccattgtaactgacaaggagaaacctgtcaacatcgaagcagagccacccttcggcgagtcctatatagtgattggtgccggggaaaaggctttgaagctgtcatggtttaaaaagggcagtagcatcggaaaaatgttcgaggccaccgcaagaggcgccaggcggatggctatcctcggggatacagcctgggactttggatccattggtggcgttttcacgtctgtggggaagctggtccatcagatctttggaaccgcatacggcgtgcttttcagcggtgtatcatggactatgaaaattgggataggcgtgctgttgacatggctcggactgaatagtcgatccaccagcttatctatgacatgtatcgcggttggcctggtcactctatacctcggggtgatggtgcaggctgattcaggatgcgtcattaactggaagggccgcgaactgaagtgtggtagtgggatctttgttaccaatgaggtgcacacgtggacagaacagtataaattccaagccgacagcccgaagagactttccgcagccatcggaaaggcttgggaggagggcgtgtgcggtattaggtctgccacccggttggaaaacataatgtggaagcagatctcgaacgagctgaatcatattctcctggaaaacgacatgaaatttactgtagtcgtgggcgatgttgcagggatcttagctcagggaaagaaaatgattcgccctcagcccatggagtacaagtatagctggaagtcctggggcaaagccaagatcataggggcggacgtgcaaaataccacattcatcattgatggaccaaacactcctgaatgtcccgacgatcagagagcctggaatatctgggaggtcgaggactacggctttggtattttcaccacaaacatctggctgaaacttagggattcatatacacaggtgtgcgaccaccgtttgatgagtgctgcaataaaggattctaaagccgttcacgctgacatggggtactggattgaaagcgagaagaatgaaacctggaagctcgcccgggcatccttcatcgaggtgaaaacttgtatttggccaaagtcacatacactgtggagcaacggagtactagaatctgagatgatcgtccccaaaatatatggcggtcctatctcccagcacaattaccgaccaggctactttacccaaactgcggggccgtggcatctgggaaagctcgagctggatttcgacctttgcgaaggcacaaccgtggtggtcgatgagcactgcgggaacagaggacccagtttgaggacgactaccgttacaggcaaaattatccacgaatggtgttgccgcagctgtaccctgcctccattacggtttaagggtgaggacgggtgctggtatggaatggagattagacccgtgaaggaaaaagaggaaaatctcgtaaagtctatggtgtccgccggctcaggtgaggtcgacagtttcagcctgggccttctgtgtatctcgataatgattgaagaggtgatgaggtcccgctggtctcgaaaaatgttgatgactgggacactcgctgtatttttcctgctaatcatgggacagctgacctggaacgatctcatccggctgtgcattatggtgggcgccaatgcaagcgaccgtatggggatgggaacaacttaccttgctttgatggccacctttaagatgagacctatgttcgcagtcggcctgttatttaggcgcctcacgtcacgggaggtgctgcttctgacaatcggtctaagtctcgttgcctccgtggaactgccaaactctttggaggaactgggggatggattagctatgggcattatgatactcaaactgcttaccgacttccagagccatcaactgtgggcgactttgctctccctgacctttatcaagacaactttctcactacactatgcctggaagaccatggcaatggtcctgagcattgtaagtctttttcccctctgtctgtctacgacatcccagaaaaccacttggttgccggtgctgttaggcagcctcgggtgcaagcctctgacaatgttccttatcgctgagaataaaatttggggaagaaagtcgtggccactgaacgaaggtatcatggccgttggcatagtgtcaatcttgctctctagtctgctcaagaacgatgtccccctggccgggcctcttattgctggaggcatgctcatcgcatgttacgtgatttccggtagctctgccgacctgagcttggagaaggcggctgaggtatcctgggaagaggaagccgagcattcaggggcaagtcacaatatcttagtggaagtccaggatgacggaaccatgaaaataaaggatgaggagagggacgatactctgacaattctcctgaaggccacccttctggctgttagcggcgtgtatcccttgtctatcccagcaacgctattcgtgtggtacttttggcagaaaaagaaacaacgatccggcgtcctgtgggacactccttcacccccagaagtggagcgcgccgttctcgatgacgggatctatcggattatgcagagaggactgcttggtaggagtcaggtaggcgtgggggtcttccaggaaaacgtgtttcataccatgtggcacgttacacgtggagcggtgttaatgtaccaaggcaagcgcctggagccgagctgggcttccgtcaaaaaggacctcatatcttacggtgggggatggcggttgcagggctcgtggaataccggcgaggaagtgcaggtaatcgccgtcgagcctgggaagaaccccaaaaatgtgcagacagcaccaggaactttcaagaccagcgaaggtgaggttggcgccattgctctggattttaaacccgggacgtcaggatcccctatcgtgaacagagaaggcaagattgtcggtctctatgggaatggagtggttacaacaagtggcacctacgtgtctgccatcgcacaagctaaagccagccaggagggcccactgcccgagatagaagacgaggtcttcaggaagcgaaaccttacaatcatggatctgcaccctgggtccggaaagacccggcgctatttgccggcgattgtgagagaagccatcaaaaggaagctacggactctgattctcgcaccaacccgagtagtggcttcagagatggccgaggctttaaaaggtatgcccatcagataccagacaacggcagttaagtctgagcatactggcaaagagatagtcgacctgatgtgccacgccacctttacaatgcgccttctgagccctgtgagggtgccaaattataacatgattatcatggatgaagcccatttcaccgaccccagttccatcgctgcgcgtgggtacattagcactcgggtcggaatgggcgaggcagccgctatctttatgacagccacccctccgggttctgtagaagcattcccccaatcaaatgccataattcaggatgaggaaagagacatcccagagaggtcctggaacagtgggtatgagtggattacggattttcctggaaagactgtgtggttcgttcccagcatcaagtcgggcaatgacatagctaactgtctccgcaaaaatggcaagcgagtgattcagttgtctagaaaaacattcgataccgaataccagaagaccaaaaacaacgactgggactacgtcgtgactacagatatctccgagatgggggcgaattttcgggccgacagggttatcgatccacgccgttgcctgaagcctgtgattctcaaggacggacccgaaagagtcatcctggcaggtccaatgccggtgaccgtagctagcgccgcacaacggaggggccgcattgggcgaaaccacaataaagagggagatcagtatatatacatgggccagcctcttaacaatgacgaggatcatgcccactggacagaagctaagatgctactggacaacatcaatactcccgagggtattatcccagccttgttcgaacccgagagagaaaaatcagcggcaatcgatggggagtatcggttaaggggcgaggcccgcaagacgtttgtggaactgatgagaaggggagacctccctgtttggctgagttacaaagtcgcttctgagggcttccagtattccgatcggcgttggtgctttgacggggaacgcaacaatcaagtgcttgaggaaaacatggatgtggagatttggaccaaggagggagaaagaaagaaactgagaccaaggtggctcgacgcccggacatacagcgaccccttggctctgcgcgagttcaaggaatttgcagccggtagaaggtcagtcagtggcgatctaatactggagatcgggaaactccctcagcaccttactcagcgggctcagaatgccctggacaacttagttatgttgcataatagcgaacaaggaggccgagcatatagacacgcgatggaggagctgccggataccattgaaacactcatgctgcttgccctgatcgctgtgctcaccggtggggtaactttgttctttctgtccggccgcggattaggcaagacgtctattgggctactgtgtgtgatggccagctccgtcctcctttggatggcatcagtggagccacattggatcgctgcctctataatcctggagttctttttgatggttctgctcattcccgagcctgacaggcagcggacaccccaggataaccagctggcatacgtggtcatcggacttctcttcatgattctgacagtagccgctaatgagatgggtttgctggaaactaccaaaaaggacttaggcatcgggcacgtggcggttgagaaccaccatcacgccgcaatgctagatgtggacctgcatccagctagtgcctggacactctacgccgtcgcaaccactataattacacctatgatgcgtcacacgatcgaaaacaccactgctaatatttcgcttacagccatcgcgaaccaagctgccatactgatgggattggataaaggctggcccatcagcaagatggacattggtgtgccactgctcgcactggggtgctattcccaggtcaatcctcttaccttaaccgccgctgtgctgatgctcgttgcacattacgccatcattggcccgggattgcaggcgaaggctacaagagaggcccagaaaaggactgcagccggcatcatgaagaaccccacggtggatgggatagtagctattgacctggatccagtggtctatgacgccaaatttgaaaagcagctaggacagatcatgctgctcatcctttgtacctctcagattctgttgatgcgcacaacttgggcactgtgcgagtcaatcaccctcgctacaggccctctgaccactttatgggagggtagccccgggaaattctggaatacgacaatagccgtttccatggcgaacattttccggggaagttaccttgccggcgcaggtctggctttttctctcatgaaaagcctaggcgggggacgaagaggcaccggggcccaaggagaaactctgggcgagaagtggaaaaggcagttgaatcagctgggtaagtcagagttcaacacctataaacgctccgggatcatggaggtggaccggagtgaagcaaaggagggactcaaaagaggcgagacaactaagcacgctgtcagccgtggtaccgccaaacttaggtggtttgtggaacggaatctggtaaaaccagagggcaaggtgattgatttggggtgtggacgcggcgggtggtcttactattgcgccggactgaaaaaggttacagaagtgaaaggctacacgaagggtgggcctggacacgaggaacccatcccgatggcgacctacggctggaacctcgtcaaattacattccggcaaggacgtgttctttataccacctgagaagtgtgatactctgctttgcgacatcggggagtcaagccccaatccaacaattgaagagggacgaaccctgagagtcctaaaaatggtggaaccctggctcaggggtaaccagttctgtatcaagattctgaatccttatatgccgtcggttgtagagactttggagcaaatgcagcggaaacacggcgggatgctggtgcgcaaccccctctctagaaatagtacacatgaaatgtactgggtctcctgcggaaccggcaacatcgtgagcgctgttaatatgacgtcaaggatgcttctgaaccgatttaccatggcacaccggaagccaacatatgagcgtgatgtggacttaggtgccgggactagacacgtcgctgtggaacctgaggtagccaacctggatattatcggacagcgcatagaaaatattaaacatgagcacaagtccacctggcattacgacgaggataacccctataagacatgggcataccacggctcttatgaagtgaaacctagcggcagtgcctccagcatggttaatggggtcgtgaagttgctcactaaaccatgggacgtgatccccatggtcacccagatcgctatgacagataccactcctttcggacaacagagggtttttaaggagaaagtggacacgcggacaccaaaggcgaagagaggtaccgcccagattatggaagtaactgcaaaatggctgtggggcttcctatctcgcaacaagaaacccaggatatgtacccgagaggaatttacacggaaggtgagatcaaatgctgccatcggggcagtcttcgtggacgagaaccaatggaatagtgccaaagaggctgttgaagatgagaggttttgggaccttgtgcatcgcgaacgtgagctgcacaagcagggaaagtgcgccacgtgcgtctacaacatgatgggcaaacgggaaaagaaactcggtgagttcgggaaggcgaaaggatccagagcaatttggtacatgtggctgggcgccaggttcttggagtttgaagctctgggcttcatgaatgaggatcactggtttagccgcgaaaactctctctcgggggtggagggagagggtcttcataagctgggctatatcttacgagacatttcaaaaatcccagggggaaatatgtacgccgatgacaccgcaggctgggatactcggataacagaagacgatctgcagaacgaggctaagatcaccgacattatggaacctgagcacgccttgctcgctaagagcatcttcaaactgacttatcagaataaggtagttagagtgcaaaggccagccaaaaacggtacagtcatggatgtgatttcccgcagagaccagcgggggagtggacaggtgggcacctacggcctaaatacatttactaacatggaagcacagcttatcaggcaaatggagtctgaggggatattcagcccctccgaactggagacccctaacctcgcgggacgtgtcctggattggttggaaaagcatggtgttgagcgattaaaacgcatggccatttcaggcgacgactgtgtggtaaagccaatcgatgacagatttgctacggccctgaccgcactcaatgatatggggaaggtgcggaaagacatcccccagtgggaaccgagtaagggatggaacgattggcagcaggtccctttctgctctcaccactttcatcaacttattatgaaagacggcagggagatagtggttccctgtcgcaatcaggatgagctggtgggtagagctcgggtcagccagggggccggatggtccctaagggaaacagcatgcctgggcaagtcatatgcccagatgtggcaactcatgtacttccaccgacgtgacttgagactggcggctaacgccatctgtagcgcagtgccagtagattgggttcctacttctcgcaccacatggtccattcatgcccaccatcagtggatgactaccgaggacatgcttagtgtgtggaatcgggtctggatcgaagagaacccctggatggaagataaaacgcacattagctcgtggggcgacgtgccatatctggggaagagggaggaccagtggtgcggatccctcatcggtttaacagctagagccacctgggcaactaatatacaagttgctatcaaccaggtgcgccggctgattggcaatgagaactacttggattacatgacatctatgaagaggtttaaaaatgaatcagaccccgagggggccctgtggtga

SEQ ID NO: 13676 - RNA, 9879 nt, synthetic construct
  misc_feature 1..9879: note = derived and/or modified CDS sequence (opt3) from DENV-1__FJ410236__SS-prME
  source 1..9879: mol_type = other RNA
agcgtgaccatgctgctcatgcttgtccccacagccctggctttccacttgactacgagaggaggggaacctcatatgatcgtttccaagcaggaaagaggaaaatctttactgtttaagacctcagccggtgtgaatatgtgcacacttattgccatggacctcggcgaactgtgtgaagatactatgacctacaaatgcccacggattacagagaccgaaccggacgatgtagactgttggtgcaatgcgactgatacatgggtgacctatgggacgtgtagtcaaactggagagcaccgccgagacaagcgtagcgtcgctcttgcaccccatgtgggcctgggtttggagaccagaacagaaacttggatgtcctctgagggggcatggaaacagatccagagggttgaaacctgggccctccggcaccctggattcacagtgattgctctgtttctggcacatgccatcggcacctcgattacgcagaagggcatcatattcatcctcttaatgctggtcactccatcaatggctatgcgctgcgtggggattggaagcagagattttgtagagggtcttagtggcgccacatgggttgacgtggtcttggagcacgggtcctgtgtgaccactatggcgaaggataaacccacactggacatcgaactgctcaagaccgaggtgacgaaccctgcagtcctgaggaaactttgcattgaagccaagatctctaataccacaactgatagccggtgtccaacccaaggagaggctacactggttgaagaacaagacgccaacttcgtgtgccgccgaacttttgtagatagaggctggggtaatgggtgtggattgttcggcaaaggctccctcataacctgcgcaaagtttaagtgcgtgacaaaactggaggggaagattgtccagtacgaaaacttaaaatattcagtgatcgttaccgtgcacactggagaccagcatcaagtcggtaatgagagtacggaacacggcacaaccgctactattacaccccaagcccctaccaccgagatccagctgactgactacggggcgctcacacttgattgtagcccaaggacgggactggacttcaacgaaatggtgttgctaaccatgaaggagaaatcttggctggtacataagcagtggtttctcgatctgccgcttccctggacttccggcgcctcaacaagccaagagacctggaatcggcaggacctgttggttacattcaaaactgcacacgctaagaagcaggaagtggtcgtgctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtcatgtgtaccggatcgttcaaactggagaaggaagtggccgagacgcagcacggtacagttcttgtgcagataaagtacgagggcaccgacgctccttgcaaaatcccattctcgactcaagatgaaaagggggtaacacagaacggacgcttgattaccgcgaatcccatcgtcactgacaaagagaagcctgtgaacatagaagcagagccaccctttggcgagtcttatattgttatcggtgccggggaaaaagctatgaagctgtcctggttcaagaaaggctcaagtatcggaaagatgtttgaggccaccgcaagaggcgccaggcggatggctattctcggggatacagcctgggacttcggaagcatcggtggcgtgtttacgtccgtcgggaaactggtgcatcagattttcggaaccgcatacggcgtactattttctggtgtgagctggactatgaagatagggatcggcgttctgttgacatggctcggactaaattcacgaagtacctccttaagcatgacatgtattgcggtcggcctggtgactctatacctcggggtgatggtccaggctgattctggatgcgttatcaactggaaaggccgcgaactgaagtgtggttcagggatcttcgtgaccaatgaggtgcacacgtggacagaacaatataagtttcaggccgacagtccgaaaagacttagcgcagccattggaaaggcttgggaggagggcgtatgcggtataaggtccgccacccggttggaaaacatcatgtggaaacagatttctaacgagctgaatcatatcctcctggaaaacgacatgaagttcactgtcgtggttggcgatgtggcagggattttagctcagggcaagaagatgatccgccctcaacccatggagtacaaatattcgtggaaaagctggggcaaggccaagataatcggggcggacgtccagaataccacatttattatcgatggaccaaacactcctgaatgtcccgacgatcagagagcctggaatatttgggaggtggaggactacggcttcggtatctttaccacaaacatatggctgaaacttagggattcctatacgcaggtttgcgaccaccgtttgatgtcagctgcaattaaagatagtaaggccgtgcacgctgacatggggtactggatcgaatctgagaaaaatgaaacctggaagctcgcccgggcatccttcattgaggtaaagacttgtatctggccaaaatcccatacactgtggtcaaacggagtcctagaaagcgagatgataatccccaagatttatggcggtcctatctctcaacacaattaccgaccaggctacttcacccagactgcggggccgtggcatctgggaaaactcgagctggattttgacctttgcgaaggcacaaccgtggtggtcgatgagcactgcgggaacagaggaccctccttgaggacgactaccgttacaggcaagattatccacgaatggtgttgccgcagttgtaccctgcctccattacggttcagaggtgaggacgggtgctggtatggaatggagataaggcccgtgaaagaaaaggaggaaaatctcgtaaagagcatggtgtctgccggctccggtgaggtcgactcatttagtctgggccttctgtgtattagcatcatgatcgaagaggtgatgcgctcgcgatggtcccggaaaatgttgatgactgggacactcgctgttttctttctgctaattatgggacagctgacctggaacgatctcatccgtctgtgcattatggtgggcgccaatgcatctgacagaatggggatgggaacaacttaccttgctttgatggccaccttcaagatgaggcctatgtttgcagtcggcctgttattccgccggctcacgagcagagaggtgctgcttctgacaataggtctatcactcgttgccagtgtggaactgccaaactccttggaggaactgggggatggattagctatgggcatcatgattctcaaactgcttaccgactttcaatctcatcagctgtgggcgactttgctcagcctgaccttcatcaagacaactttttccctacactatgcctggaaaaccatggcaatggtcctgtcaattgtaagccttttccccctctgtctgagtacgacatctcagaagaccacttggttgccggtgctgttaggctccctcgggtgcaagcctctgacaatgtttcttatcgctgagaataaaatatggggaaggcgaagctggccactgaacgaaggtatcatggccgttggcattgtgtcgatcttgctctcatctctgctaaagaacgatgtccccctggccgggcctcttattgctggaggcatgctcatcgcatgttacgtgataagtggttccagcgccgacctgtctttggagaaagcggctgaggtaagctgggaagaggaagccgagcattccggggcatcacacaatattttagtggaagtccaggatgacggaaccatgaagatcaaagatgaggagcgcgacgatactctgacaatcctcctgaaggccacccttctggctgttagtggcgtgtatcccttgagcattccagcaacgctattcgtgtggtacttctggcagaagaagaagcagcggtctggcgtcctgtgggacactccttcacccccagaagtggagagagccgttctcgatgacgggatatataggatcatgcagcgtggactgcttggtcgcagccaggtaggcgtgggggtctttcaagaaaacgtgttccataccatgtggcacgttacacggggagcggtgttaatgtaccagggcaaaagactggagccgagttgggctagcgtcaagaaagacctcatttcctacggtgggggatggaggttgcagggctcttggaataccggcgaggaagtgcaggtaatcgccgtcgagcctgggaagaaccccaaaaatgtgcaaacagcaccaggaacttttaagacccccgaaggtgaggttggcgccattgctctggatttcaagcctgggacgtcgggaagcccaatcgtgaaccgagaaggcaaaatagtcggtctctatgggaatggagtggttacaacttcaggcacctacgtgtccgccatcgcacaggctaaggccagtcaggagggccccctgcctgagattgaagacgaggtctttcggaaacgcaaccttacaatcatggatctgcacccggggtctggaaagaccagaaggtatttgccagcgattgtgcgggaagccatcaaacgaaagctaagaactctgatactcgcacccacccgcgtagtggctagcgagatggccgaggctttaaagggtatgcctattaggtaccaaacaacggcagttaaatccgagcatactggcaaggagatcgtcgacctgatgtgccacgccaccttcacaatgcgtcttctgtcaccagtgcgggtgcccaattataacatgatcattatggatgaagcccattttaccgacccttctagcatcgctgcgagagggtacataagtactagggtcggaatgggcgaggcagccgctattttcatgacagccaccccgcccggttccgtagaagcatttccacagagcaatgccgtgatccaggatgaggaacgcgacattcctgagcgatcttggaactcagggtatgagtggatcacggatttccccggaaaaactgtttggtttgtgccatccataaagagtggcaatgacattgctaactgtctcaggaaaaatggcaagcgggtcatccagttgagcaggaagacattcgataccgaataccagaaaaccaagaacaacgactgggactacgtggttactacagatatctcggagatgggggcgaatttccgcgccgaccgtgtgattgatcctagacggtgcctgaaacccgtcatcctcaaggacggaccagaaagggtgattctggcaggtccgatgcctgtaaccgtggcttctgccgcacagcgccgaggcagaatagggcggaaccacaataaagagggagatcagtatatctacatgggccagccccttaacaatgacgaggatcatgcccactggacagaagctaagatgctactggacaacattaatactccagagggtatcatccccgccttgtttgaacctgagagggaaaagtccgcggcaattgatggggagtatcgcttaagaggcgaggccaggaaaacgttcgttgaactgatgcggcgtggagacctcccagtctggctgagctacaaggtggcttcagagggctttcaatatagtgatcgccgatggtgcttcgacggggaaagaaacaatcaggtgcttgaggaaaacatggatgtcgagatatggaccaaagagggagaaaggaagaaactgcggccccgctggctcgacgccagaacatactctgaccctttggctctgagggagtttaaggagttcgcagccggtcggcgatccgttagcggcgatctaatcctggagattgggaaactcccgcagcaccttactcagagagctcaaaatgccctggacaacttagtgatgttgcataattcagaacagggaggccgcgcatataggcacgcgatggaggagctgccagataccatcgaaacactcatgctgcttgccctgattgctgtactcaccggtggggtgactttgtttttcctgagtggccggggattaggcaagacgagcatcgggctactgtgtgtcatggcctcctctgtgctcctttggatggcaagcgttgagccccattggatagctgcctccatcattctggaatttttcttgatggtgctgctcatccctgagcccgaccgtcagagaaccccacaggataaccaactggcatacgtcgtaattggacttctctttatgatcctgacagtggccgctaatgagatgggtttgctggaaactaccaagaaagacttaggcatagggcacgttgcggtggagaaccaccatcacgccgcaatgctagatgtcgacctgcatcctgcttcagcctggacactctacgccgtggcaaccactattatcacacccatgatgaggcacacgattgaaaacaccactgctaatatctctcttacagccatagcgaaccaggctgccatcctgatgggattggataagggctggccaattagtaaaatggacatcggtgtccctctgctcgcactggggtgctatagccaggtgaatccgcttaccttaaccgccgctgttctgatgctcgtggcacattacgccattatcggccccggattgcaagcgaaggctacacgcgaggcccagaaacggactgcagccggcataatgaagaacccaacggtagatgggattgtggctatcgacctggatcctgtcgtttatgacgccaagttcgaaaaacagctaggacagatcatgctgctcattctttgtaccagccaaatcctgttgatgcgaacaacttgggcactgtgcgagtccataaccctcgctacaggccccctgaccactttatgggagggttctccagggaagttttggaatacgacaattgccgtgtcaatggcgaacatcttcagaggaagctaccttgccggcgcaggtctggctttctccctcatgaaaagtctaggcgggggaaggcgcggcaccggggcccagggagaaactctgggcgagaagtggaaacggcagttgaatcagctgtctaagagcgaatttaacacctataagagatcaggtattatggaggtcgaccgttccgaagcaaaagaggggctcaagaggggagagacaactaaacacgctgtgagtcggggcaccgccaaacttcgctggttcgtagaacgaaatctggtgaaacctgagggtaaggttatcgatttgggctgtgggagaggaggctggagctactattgcgccgggctgaagaaagtgacagaagtcaagggatacacgaaaggcggtcccgggcacgaggaaccgataccaatggcgacctacggatggaacctcgtgaagttacattctggcaaagacgtctttttcatccctcccgagaagtgtgatactctgctttgcgacattggcgagtcctcaccaaatcccacaatcgaagaggggaggaccctgcgggtgctaaaaatggttgaaccttggctccgcggaaaccaattttgtattaagatcctgaatccgtatatgcccagcgtagtggagactttggagcagatgcagagaaagcacggtggcatgctggtcaggaacccactctcgcgaaattctacacatgaaatgtactgggtgagttgcgggaccggaaacattgtttccgctgtgaatatgacgagccggatgcttctgaaccgtttcaccatggcacacagaaaacctacatatgagcgcgatgtcgacttaggcgccggtactaggcacgtggctgtagaacccgaggtggccaacctggatatcatagggcagcggattgaaaatatcaagcatgagcacaaatcaacctggcattacgacgaggataacccttataagacatgggcataccacggatcctatgaagttaaaccatctggcagcgccagttccatggtcaatggcgtggtgaagttgctcactaagccctgggacgtcatccctatggttacccaaattgctatgacagataccactccatttgggcagcagagagtgttcaaagagaaggtagacacgcgcacacccaaagcgaagaggggaaccgcccaaataatggaagtgactgcaaaatggctgtggggttttctaagccgaaacaagaagccgcggatctgtaccagagaggagttcacaaggaaagtccgctctaatgctgccattggcgcagtgtttgttgacgagaaccagtggaactcagccaaggaggctgtggaagatgagcgtttctgggaccttgtccatcgggaaagagagctgcacaaacaggggaagtgcgccacgtgcgtgtacaacatgatgggaaaaagggaaaagaagctcggcgagtttggtaaagcgaaggggagtcgcgcaatctggtacatgtggctgggagcccgattcttggagttcgaagctctgggctttatgaatgaggatcactggttctcccgggaaaacagcctctctggcgtagagggggagggacttcataaactgggttatattttaagagacatctcgaagatacctggcgggaatatgtacgccgatgacaccgcaggatgggatactaggatcacagaagacgatctgcagaacgaggctcgcattaccgacatcatggaaccagagcacgccttgctcgctaaatcaatttttaagctgacttatcaaaataaagttgtgagagtccagcggcccgccaagaacggcacagtgatggatgtgatcagcaggcgtgaccagcgaggttccgggcaggtcggaacctacggcctaaatacattcactaacatggaagcacaacttatacgccagatggagagtgagggcatattttctcctagcgaactggagaccccaaacctcgcggaaagagttctggattggttggagaagtatggggtgaaacggttaaagaggatggccatctccggagacgactgtgtagtgaaacccatcgatgaccgcttcgctacggccctgaccgcactcaatgatatgggtaaggtcagaaaagacattccgcagtgggaaccttcaaagggctggaacgattggcagcaagtgcccttttgcagtcatcacttccaccagcttataatgaaggacgggcgggagatcgttgtgccatgtaggaatcaggatgagctggtcggacgagctcgtgtgtctcagggcgccggttggagcctaagagaaacagcatgcctggggaaatcctacgcccaaatgtggcagctcatgtattttcatcgccgggacttgaggctggcggctaacgccatttgttcagcagtacctgttgattggatccccactagcagaaccacatggtctattcacgcccatcaccagtggatgactaccgaggacatgctttccgtgtggaatcgcgtctggatcgaagagaacccatggatggaagataagacgcatataagtagctggggagacgtgccctacctgggcaaacgggaggaccaatggtgcggctcgctcatcgggttaacagctagggccacctgggcaactaatattcaggttgctatcaaccaggtgcgaagactgattggaaatgagaactacttggattatatgacatccatgaagcggttcaaaaatgaatctgaccctgagggtgccctgtggtga

SEQ ID NO: 13677 - RNA, 9879 nt, synthetic construct
  misc_feature 1..9879: note = derived and/or modified CDS sequence (opt3) from DENV-1__FJ410238__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagttctgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagagcaggacgcaaactttgtttgccgccgaacattcgtggatagaggctggggtaatgggtgtggactgtttggcaaaggctccttgataacttgcgctaagttcaagtgcgtaaccaaactcgaggggaagattgtgcagtacgaaaacctgaaatattcagtcatcgtgacagttcacaccggagaccagcatcaagtgggtaatgagagtactgaacacggcacgacagccaccattactccccaggcgcctagcaccgagatccagttaacagactacggggccctgaccctcgattgttctccaaggactggacttgactttaacgaaatggtcctgttgacaatgaaggagaaatcctggctagtgcataagcagtggttcctggatctcccgctgccctggacgtcaggcgcaagcaccagtcaagagacttggaatcggcaggaccttctggtaacatttaaaaccgctcacgccaagaagcaggaagttgtggtcttgggttctcaagagggggctatgcacacagccctcactggcgcaaccgaaatccagacgtccggaaccacaactattttcgccggccatctgaaatgccgtttaaagatggataaactgaccctaaaggggatgagctatgtgatgtgtacaggatcgttcaaactcgagaaggaagtcgctgagactcagcacggtaccgtgctggttcagataaagtacgagggcacggacgcgccttgcaaaatcccattttctacacaagatgaaaagggggtgacccagaacggacgccttattactgcaaatcccatcgtaacagacaaagagaagcctgtcaacatagaagccgagccacccttcggcgagtcctatattgtgatcggtgctggggaaaaagccttgaagctgtcatggtttaagaaaggcagtagcatcggaaagatgttcgaggcaaccgccagaggcgctaggcggatggccattctcggggatactgcatgggactttggatccatcggtggcgttttcacctctgtggggaaactggtccatcagatttttggaacagcgtacggcgtgcttttcagcggtgtatcatggacgatgaagatagggatcggcgtgctgttgacctggctcggactgaatagtcgatccactagcttatctatgacatgtattgctgttggcctggtcaccctatacctcggggtgatggtgcaggccgattcaggatgcgtcatcaactggaaaggccgcgaactgaagtgtggtagtgggatctttgttacaaatgaggtgcacacttggaccgaacaatataagttccaggcagacagcccgaaaagactttccgccgctattggaaaggcctgggaggagggcgtgtgcggtataaggtctgcaacgcggttggaaaacatcatgtggaaacagatttcgaacgagctgaatcatatcctcctggaaaacgacatgaagttaacagtagtcgtgggcgatgttgctgggattctggcccagggaaaaaagatgatccgccctcaacccatggagtacaaatatagctggaagtcctggggcaaggcgaaaataatcggggccgacgtgcagaataccacttttattatcgatggaccaaacacccctgaatgtcccgacgatcagagagcttggaatatttgggaggtcgaggactacggcttcggtatctttacaactaacatatggcttaagttgagggattcatatacccaggtgtgcgaccaccgtctcatgagtgcagccattaaagattctaaggctgttcacgccgacatggggtactggatcgaaagcgagaaaaatgaaacatggaagctggcacgggcgtccttcattgaggtgaagacgtgtatctggccaaaatcacataccctatggagcaacggagtactggaatctgagatgataatccccaagatttatggcggtcctatctcccaacacaattaccgaccaggctacttcactcagacagccgggccgtggcatctcggaaaactggagcttgattttgacttgtgcgaaggcaccactgtcgtggtggatgagcactgcgggaacagaggacccagtctgaggacaaccacggtcactggcaagattatccacgaatggtgttgccgcagctgtaccttacctccactccggttcaaaggtgaggacgggtgctggtatggaatggagataagacccgttaaggaaaaggaggaaaatctggtgaaatctatggtatccgctggctcaggtgaggtggacagttttagccttggcctgttgtgtatttcgatcatgatcgaagaggtcatgaggtcccgctggtctcgaaagatgctcatgacagggaccctggccgtgttctttctactgattatgggacagctcacttggaacgatctgatccggctttgcattatggttggcgcaaatacaagcgaccgtatggggatgggaaccacatacttggctctgatggccactttcaaaatgagacctatgtttgcagtgggcttactcttcaggcgcctgacctcacgggaggtccttctgctaacgataggtctcagtctggtggcctccgctgaattgccaaactctctggaggaattaggggatggactcgcgatgggcatcatgattctgaagcttctgacagactttcaaagccatcagttgtgggccaccctcctgtccctaactttcatcagaaccacattttcactgcactatgcatggaaaactatggctatggttcttagcattgtgagtctcttccccctgtgtttgtctaccacgtcccagaagacaacctggctgccggtcttactcggcagcctggggtgcaagcctcttactatgtttctgatcgccgagaataaaatatggggaaggaagtcgtggccattgaacgaaggtatcatggccgtaggcattgtgtcaatcctcctgtctagtctactgaaaaacgatgttccccttgctgggcctctcattgcaggaggcatgctgatcgcctgttacgtgatatccggtagctctgcggacttgagcttagagaaggctgccgaggtctcctgggaagaggaagcagagcattcaggggccagtcacaatattctggtggaagtacaggatgacggaacaatgaaaatcaaggatgaggagcgagacgataccctcactatcctgcttaaagctacactgttggcagtgagcggcgtctatcccctatctattccagccaccctgttcgtttggtacttctggcaaaagaagaaacagcgctccggcgtgctctgggacacgccttcacccccagaagtggagcgggcggtcctggatgacgggatatatagaatcatgcagaggggacttttaggtcgtagtcaggtgggcgttggggtatttcaagaaaacgtgttccatactatgtggcacgtcacccgcggagctgtgctgatgtaccagggcaagcggctcgagccgagctgggcctccgttaaaaaggacttgatttcttacggtgggggatggagactgcagggctcgtggaatacaggcgaggaagtgcaggtcatcgcagtggagcctgggaaaaaccccaagaatgtacaaaccgccccaggaacatttaagactagcgaaggtgaggtcggcgctattgccctcgatttcaaacccgggacctcaggatcccctatcgtgaacagggaaggcaagatagttggtctgtatgggaatggagtggtcacgacaagtggcacttacgtgtctgcaatcgctcaggccaaagcgagccaggagggcccacttcccgagattgaagacgaggtttttcgaaagcggaacctgaccatcatggatttgcaccctgggtccggaaaaacacgcagatatctaccggccattgtgagggaagcaatcaagcggcgactgagaaccctcatattagctccaactcgcgtcgtggcctcagagatggctgaagcactgaagggtatgcccattaggtaccaaaccacagccgtaaaatctgagcatacgggcaaggagatcgtggaccttatgtgccacgccactttcaccatgcgtctgctcagccctgttcgggtcccaaattataacatgatcattatggatgaagctcattttacagaccccagttccatcgcggcaagagggtacataagcaccagggtgggaatgggcgaggccgctgccattttcatgactgcaacacctccgggttctgtggaagcctttccccagtcaaatgctgtcatccaggatgaggaacgcgacattccagagcgatcctggaacagtgggtatgagtggatcaccgatttccctggaaaaacggtatggtttgtgcccagcataaagtcgggcaatgacattgcgaactgtttgagaaaaaatggcaagcgggttatccagctgtctaggaagactttcgatacagaataccaaaaaaccaagaacaacgactgggactacgtggtcaccactgatatctccgagatgggggccaatttccgcgcagaccgtgtgattgatccaagacggtgcctcaaacctgttatcctgaaggacggacccgaaagggtgattcttgctggtccaatgccggtcacagtggccagcgcagcccagcgccgaggcagaatagggcggaaccacaataaagagggagatcagtatatctacatgggccagcctctaaacaatgacgaggatcatgctcactggaccgaagccaagatgctgttggacaacattaatacacccgagggtatcatcccagcgttatttgaacccgagagggaaaagtcagcagccattgatggggagtatcgcctgagaggcgaggctaggaaaactttcgtagaactcatgcggcgtggagacctgcctgtgtggcttagttacaaggttgcctctgagggctttcaatattccgatcgccgatggtgcttcgacggggaaagaaacaatcaggtcctggaggaaaacatggatgtggagatatggacgaaagagggagaaaggaagaaactccggccacgctggttggacgctagaacctacagcgaccccctggcactaagggagtttaaggaattcgccgctggtcggcgatcagtgagtggcgatctgatcctcgagattgggaaacttcctcagcacctgacacagagagcccaaaatgcattagacaacttggtcatgctgcataatagcgaacagggaggccgcgtttataggcacgcgatggaggagctcccggatactatcgaaaccctgatgcttctggccctcattgctgtgttgacaggtggggtaaccctgtttttcttatccggccggggactaggcaagacttctatcgggctgctctgtgtgatggccagctccgtccttctgtggatggcatcagtggagccacattggatagctgcctctatcattttggaatttttcctgatggttctcctgatccccgagcctgaccgtcagagaacgccccaggataaccaacttgcatacgtggtcattggactcctgtttatgatcttgaccgtagccgctaatgagatgggtctgttagaaacaactaagaaagacctaggcatagggcacgtggcggttgagaaccaccatcacgccgcaatgctggatgtggacctccatccagctagtgcctggaccctttacgccgtcgcaacaaccattatcactcctatgatgaggcacacaattgaaaacacgaccgctaatatctcgctgactgccatagcgaaccaggctgccatcttgatgggactggataagggctggcccattagcaaaatggacatcggtgtgccactcctggcacttgggtgctattcccaggtcaatcctttaacactgaccgccgctgtgctcatgttggttgcacattacgccattatcggcccgggactgcaagcgaaggctacccgcgaggcccagaaacggacagcagccggcataatgaagaaccccactgtggatgggattgtagctatcgacctagatccagtggtctatgacgccaagttcgaaaaacagctgggacagatcatgctccttattctgtgtacgtctcaaatcttgctgatgcgaaccacatgggcactctgcgagtcaataactctggctaccggccctttaacaaccctttgggagggtagccccgggaagttttggaatactacgattgccgtttccatggcgaacatcttcagaggaagttacctggccggcgcaggtctcgctttctctctaatgaaaagcctgggcgggggaaggcgcggcacaggggcccagggagaaaccttgggcgagaagtggaaacggcagctgaatcagctctcaaagtccgaatttaacacttataagagaagtggtattatggaggtggaccgtagcgaagcaaaagaggggcttaagaggggagagaccacaaaacacgctgtctctcggggcactgccaagctgcgctggttcgtggaacgaaatttggtaaaaccagagggtaaggtgatcgatctgggctgtgggagaggaggctggtcctactattgcgccgggctcaagaaagttaccgaagtgaagggatacacaaaaggcggtcctgggcacgaggaacccataccgatggcgacgtacggatggaacttagtcaagctgcattcaggcaaagacgtgtttttcatcccacctgagaagtgtgatacccttctgtgcgacattggcgagagctcgcccaatccaactatcgaagaggggaggacactacgggtcctcaaaatggtggaaccctggctgcgcggaaaccaattttgtattaagatcttgaatccttatatgccgtctgttgtagagaccctggagcagatgcagagaaagcacggtggcatgctcgtgaggaacccccttagtcgaaattccactcatgaaatgtactgggtcagctgcgggacaggaaacattgtgtcagctgttaatatgacctcccggatgctgttaaaccgtttcacgatggcacacagaaaaccaacctatgagcgcgatgtggacctgggcgccggtacaaggcacgtcgctgtggaacctgaggtagccaacttggatatcatagggcagcggattgaaaatatcaagcatgagcacaaatctacttggcattacgacgaggataacccctataagacctgggcataccacggaagctatgaagtgaaacctagtggctccgccagctctatggttaatggcgtcgtgaagctcctgacaaagccatgggacgtgatccccatggtcactcaaattgctatgaccgatacaaccccttttgggcagcagagagttttcaaagagaaggtggacactcgcacgccaaaagcgaagaggggaacagcccaaataatggaagtaaccgcaaaatggctatggggttttctttcacgaaacaagaagccccggatctgtactagagaggaattcaccaggaaagtgcgcagtaatgctgccattggcgcagtctttgtggacgagaaccagtggaattccgccaaggaggctgttgaagatgagcgtttctgggacctggtgcatcgggaaagagagctccacaaacaggggaagtgcgccacatgcgtctacaacatgatgggaaaaagggaaaagaagctgggcgagtttggtaaagcgaaggggagccgcgcaatctggtacatgtggttgggagcccgattcctggagttcgaagctctcggctttatgaatgaggatcactggttctctcgggaaaactcgctttcaggcgtggagggggagggactgcataaattaggttatattctgagagacatcagcaagataccgggcgggaatatgtacgccgatgacacggcaggatgggataccaggatcactgaagacgatttgcagaacgaggctaaaattacagacatcatggaacctgagcacgccctcctggctaagtccatttttaaactaacctatcaaaataaggtagttcgcgtgcagagaccagccaagaacggcactgtcatggatgtgatcagtcggagggaccagcgtggttctgggcaggtgggaacatacggccttaataccttcacaaacatggaagcacaactgatacgacagatggagagcgagggcattttttccccctcagaactcgagactcctaacctggcggggcgcgtcttggattggttagaaaaacatggagttgagagactgaagcggatggccatcagtggtgacgactgtgtggtaaaaccaatcgatgacaggttcgctaccgccctcacggcacttaatgatatgggcaaggtgcgcaaagacattccccagtgggaaccgtctaaggggtggaacgattggcagcaagtccctttttgcagccaccacttccatcagctgataatgaaggacggaagagagatcgtggttccctgtcggaatcaggatgagctagtgggcagggctcgagtctcccagggtgccgggtggtcactgcgtgaaaccgcatgcctcggaaaaagctatgcccaaatgtggcagttgatgtactttcacagacgcgacctgcggcttgcggctaacgccatttgttctgcagtgccagtagattgggttcctacatccaggactacctggagtatccatgcccaccatcagtggatgacaactgaggacatgctgagcgtgtggaatagagtctggattgaagagaacccctggatggaagataagacccacgtgtcgtcctggggcgacgttccatatctcggcaaacgcgaggaccaatggtgcgggtctttaatcggactgacggctcgggccacatgggcaaccaatatacaggtggctatcaaccaggtcaggcgattgctgggtaatgagaactacctcgattacatgacttcaatgaagagattcaaaaatgaaagcgaccccgagggcgccctttggtga

SEQ ID NO: 13678 - RNA, 9879 nt, synthetic construct
  misc_feature 1..9879: note = derived and/or modified CDS sequence (opt3) from DENV-1__FJ410239__SS-prME
  source 1..9879: mol_type = other RNA
tccgtgaccatgctgctcatgcttatgcccacggccctggctttccacttgactacgagaggaggggaacctcatatgatcgtctccaagcaggaaagaggaaaatctttactgtttaagacctcagccggtgttaatatgtgcacactaattgccatggacctcggcgaactgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccggtagcttcaaactggagaaggaacttgccgagacgcagcacggaacagtcttggtgcagataaagtacgagggcaccgacgctccttgcaaaatcccattctcgactcaagatgaaaagggggttacacagaacggacgcctgattaccgcgaatcccatcgtgactgacaaagagaagcctgtaaacatagaagcagagccaccctttggcgagtcttatattgtcatcggtgccggggaaaaagctctcaagctgtcctggttcaagaaaggctcaagtatcggaaagatgtttgaggccaccgcaagaggcgccaggcggatggctattcttggggatacagcctgggacttcggaagcatcggtggcgtgtttacgtccgcagggaaactggttcatcagattttcggaaccgcgtacggcgtgttgttttctggtgtcagctggactatgaagatagggatcggcgtgctcctgacatggttaggactaaattcacgaagtacctccctaagcatgacatgtattgctgtaggcctcgtgactctgtaccttggggttatggtccaggccgattctggatgcgtgatcaactggaaaggccgcgaattgaagtgtggttcagggatcttcgtgaccaatgaggtccacacgtggacagaacaatataagtttcaggcagacagtccgaaaagactgagcgccgctattggaaaggcctgggaggagggcgtttgcggtataaggtccgcaacccggctcgaaaacatcatgtggaaacagatttctaacgagctgaatcatatcttactggaaaacgacatgaagttcactgtggtggtaggcgatgtcgctgggattcttgcccagggcaaaaagatgatccgccctcaacccatggagtacaaatattcgtggaaaagctggggcaaggcgaagataatcggggccgacgtgcagaataccacatttattatcgatggaccaaacactcctgaatgtcccgacgatcagagagcttggaatatttgggaggttgaggactacggcttcggtatctttaccacaaacatatggttgaagctcagggattcctatacacaggtgtgcgaccaccgtctgatgtcagcagccattaaagatagtaaggctgtccacgccgacatggggtactggatcgaatctgagaaaaatgaaacctggaagctagcacgggcgagcttcattgaggtgaagacttgtatctggccaaaatcccatacactgtggtcaaacggagttctcgaaagcgagatgataatccccaagatttatggcggtcctatctctcaacacaattaccgaccaggctacttcacccagactgccgggccgtggcatctgggaaaacttgagttggattttgacctgtgcgaaggcacaaccgtggtagtcgatgagcactgcgggaacagaggaccctccttaaggacgactaccgtgacaggcaagattatccacgaatggtgttgccgcagttgtaccctccctccactgcggttcagaggtgaggacgggtgctggtatggaatggagataaggcccgtgaaagaaaaggaggaaaatcttgtcaagagcatggtttctgctggctccggtgaggtggactcatttagtctgggcttgctctgtattagcatcatgatcgaagaggtaatgcgctcgcgatggtcccggaaaatgctgatgactgggacactagccgtgttctttctgctcattatgggacagctgacctggaacgatcttatccgtttgtgcattatggtcggcgcaaatgcttctgacagaatggggatgggaacaacttacctggccttaatggcaaccttcaagatgaggcctatgtttgccgtgggcctcctgttccgccggcttacgagcagagaggttctgctactcacaataggtctgtcattggtggctagtgtcgaactgccaaactccttagaggaactcggggatggactggcgatgggcatcatgattcttaaactgttgaccgactttcaatctcatcagctctgggccactctgctaagcctgaccttcatcaagacaactttttcccttcactatgcatggaaaaccatggctatggtgctctcaattgttagcctgttccccttgtgtctgagtacgacatctcagaagaccacttggttaccggtgtttctcggctccctggggtgcaagcctcttacaatgttcctgatcgccgagaataaaatatggggaaggcgaagctggccattgaacgaaggtatcatggccgtcggcattgtatcgatcctcctgtcatctctactgaagaacgatgtgccccttgctgggcctctcattgcaggaggcatgctgatcgcctgttacgttataagtggttccagcgcggacttgtctttagagaaagctgccgaggtgagctgggaagaggaagcagagcattccggggcctcacacaatattctggtcgaagtgcaggatgacggaaccatgaagatcaaagatgaggagcgcgacgatactctcacaatcctgcttaaggctaccctgttggcagtaagtggcgtgtatcccctaagcattccagccacgctgttcgtctggtacttttggcagaaaaagaagcagcggtctggcgttctctgggacactccttcacccccagaagtggagagagcggtgctggatgacgggatatataggatcatgcagcgtggacttttaggtcgcagccaggtcggcgtgggggttttccaagaaaacgtatttcataccatgtggcacgtgacacggggagctgtcctgatgtaccagggcaaaagactcgagccgagttgggccagcgtgaagaaagacttgatttcctacggtgggggatggaggctgcagggctcttggaataccggcgaggaagttcaggtgatcgcagtcgagcctgggaagaaccccaaaaatgtgcaaacagccccaggaactttcaagacccccgaaggtgaggtaggcgctattgccctcgattttaagcctgggacgtcgggaagcccaatcgtcaaccgagaaggcaaaatagtgggtctgtatgggaatggagttgtgacaacttcaggcacctacgtctccgcaatcgctcaggccaaggcgagtcaggagggcccccttcctgagattgaagacgaggtgttccggaaacgcaacctgacaatcatggatttgcacccggggtctggaaagaccagaaggtatctaccagccattgttcgggaagcaatcaaacgaaagctgagaactctcatattagctcccacccgcgtggtcgccagcgagatggctgaagcactgaagggtatgcctattaggtaccaaacaacggccgtgaaatccgagcatactggcaaggagatcgtagaccttatgtgccacgccacctttacaatgcgtctgctctcaccagtgcgggttcccaattataacatgatcattatggatgaagctcatttcaccgacccttctagcatcgcggcaagagggtacataagtactagggtcggaatgggcgaggccgctgccatttttatgacagcaaccccgcccggttccgtggaagccttcccacagagcaatgctgtgatccaggatgaggaacgcgacattcctgagcgatcttggaactcagggtatgagtggatcacggattttcccggaaaaactgtctggttcgtaccatccataaagagtggcaatgacattgcgaactgtttgaggaaaaatggcaagcgggtgatccagctgagcaggaagacattcgataccgaataccagaaaaccaagaacaacgactgggactacgttgtgactacagatatctcggagatgggggccaattttcgcgcagaccgtgtcattgatcctagacggtgcctcaaacccgtgatcctgaaggacggaccagaaagggttattcttgctggtccgatgcctgtgaccgtcgcctctgcagcccagcgccgaggcagaatagggcggaaccacaataaagagggagatcagtatatctacatgggccagcccctaaacaatgacgaggatcatgctcactggacagaagccaagatgctgttggacaacattaatactccagagggtatcatccccgcgttattcgaacctgagagggaaaagtccgcagccattgatggggagtatcgcctgagaggcgaggctaggaaaacgtttgtggaactcatgcggcgtggagacctgccagtatggcttagctacaaggtggcctcagagggcttccaatatagtgatcgccgatggtgctttgacggggaaagaaacaatcaggttctggaggaaaacatggatgtcgagatatggaccaaagagggagaaaggaagaaactccggccccgctggttggacgctagaacatactctgaccctctggcactaagggagttcaaggaatttgccgctggtcggcgatccgtgagcggcgatctgatcctcgagattgggaaacttccgcagcacctgactcagagagcccaaaatgcattagacaacttggtgatgctgcataattcagaacagggaggccgcgcgtataggcacgccatggaggagctcccagataccatcgaaacactgatgcttctggctctcattgccgtcttgaccggtggggttactctgttctttttaagtggccggggactaggcaagacgagcatcgggctgctctgtgtgatggcatcctctgtacttctgtggatggctagcgtggagccccattggatagccgcatccatcattttggagttctttctgatggtcctcctgatccctgagcccgaccgtcagagaaccccacaggataaccaacttgcctacgtggttattggactcctgttcatgatcttgacagtggctgcgaatgagatgggtctgttagaaactaccaagaaagacctaggcatagggcacgtcgccgtagagaaccaccatcacgcagctatgctggatgtggacctccatcctgcctcagcctggacactttacgcagttgctaccactattatcacacccatgatgaggcacacgattgaaaacaccactgccaatatctctctgacagcgatagctaaccaggccgcaatcttgatgggactggataagggctggccaattagtaaaatggacatcggtgtgcctctcctggcccttgggtgctattcgcaggtcaatccgttaaccctgaccgctgcagtgctcatgttggtcgcccattacgcgattatcggccccggactgcaagctaaggccacacgcgaggcacagaaacggactgccgctggcataatgaagaacccaacggtggatgggattgttgccatcgacctagatcctgtggtatatgacgcaaagtttgaaaaacagctgggacagatcatgctccttattctgtgtaccagccaaatcttgctgatgcgaacaacttgggctctctgcgagtccataaccctggccacaggccccttaaccactctttgggagggttctccagggaagttctggaatacgacaattgcggtgtcaatggccaacatcttcagaggaagctacctggcaggcgctggtctcgccttttccctaatgaaaagtctgggcgggggaaggcgcggcaccggggcacagggagaaactttgggcgagaagtggaaacggcagctgaatcagctctctaagagcgagttcaacacctataagagatcaggtattatggaggtcgaccgttccgaagctaaagaggggcttaagaggggagagacaactaaacacgccgttagtcggggcaccgccaagctgcgctggtttgtggaacgaaatttggtcaaacctgagggtaaggtgatcgatctgggctgtgggagaggaggctggagctactattgcgcggggctcaagaaagtaacagaagtgaagggatacacgaaaggcggtcccgggcacgaggaaccgataccaatggctacctacggatggaacttagttaagctgcattctggcaaagacgtgttctttatccctcccgagaagtgtgatactcttctgtgcgacattggcgagtcctcaccaaatcccacaatcgaagaggggaggaccctacgggtcctcaaaatggtggaaccttggctgcgcggaaaccaattctgtattaagatcttgaatccgtatatgcccagcgtcgtggagactctggagcagatgcagagaaagcacggtggcatgctcgttaggaacccactttcgcgaaattctacacatgaaatgtactgggtaagttgcgggaccggaaacattgtgtccgcagtcaatatgacgagccggatgctgttaaaccgttttaccatggcccacagaaaacctacatatgagcgcgatgtggacctgggcgctggtactaggcacgttgccgtggaacccgaggtcgcaaacttggatatcatagggcagcggattgaaaatatcaagcatgagcacaaatcaacctggcattacgacgaggataacccttataagacatgggcctaccacggatcctatgaagtgaaaccatctggcagcgctagttccatggtaaatggcgtggttaagctcctgactaagccctgggacgtcatccctatggtgacccaaattgcgatgacagataccactccattcgggcagcagagagtgtttaaagagaaggtcgacacgcgcacacccaaagccaagaggggaaccgcacaaataatggaagttactgctaaatggctatggggtttccttagccgaaacaagaagccgcggatctgtaccagagaggaatttacaaggaaagtgcgctctaatgccgcaattggcgccgtattcgtggacgagaaccagtggaactcagctaaggaggccgtcgaagatgagcgtttttgggacctggtgcatcgggaaagagagctccacaaacaggggaagtgcgcgacgtgcgtttacaacatgatgggaaaaagggaaaagaagctgggcgagttcggtaaagcaaaggggagtcgcgccatctggtacatgtggttgggagctcgattcctggagtttgaagccctcggcttcatgaatgaggatcactggttttcccgggaaaacagcctttctggcgtggagggggagggactgcataaattaggttatattctgagagacatctcgaagatacctggcgggaatatgtacgcagatgacaccgctggatgggatactaggatcacagaagacgatttgcagaacgaggcccgcattaccgacatcatggaaccagagcacgctctcctggccaaatcaattttcaagctaacttatcaaaataaagtcgtgagagtacagcggcccgcaaagaacggcacagttatggatgtgatcagcaggcgtgaccagcgaggttccgggcaggtcggaacctacggccttaatacatttactaacatggaagcgcaactgatacgccagatggagagtgagggcattttctctcctagcgaactcgagaccccaaacctggccgaaagagtgttggattggttagagaagtatggggtggaacggctgaaaaggatggctatctccggagacgactgtgtcgttaagcccatcgatgaccgctttgccacggcactcaccgctcttaatgatatgggtaaagtgagaaaggacattccgcagtgggagccttcaaaaggctggaacgattggcagcaagtacccttctgcagtcatcactttcaccagctgataatgaaggacgggcgggagatcgtggtcccatgtaggaatcaggatgagctggtgggacgagcccgtgtttctcagggcgcaggttggagcctgagagagacagcctgcctcgggaagtcctacgcgcaaatgtggcagttgatgtatttccatcgccgggacctgaggcttgctgccaacgcaatttgttcagccgtgcctgtcgattggatccccactagcagaaccacatggtctattcacgctcatcaccagtggatgactaccgaagacatgctgtccgtgtggaatcgcgtatggatcgaggaaaacccatggatggaggataaaacgcatataagtagctggggagacgttccctacctcggcaagcgggaggaccaatggtgcggctcgttaatcgggctgacagccagggcaacctgggctactaatattcaggtggccatcaaccaggtccgaagattgattggaaatgaaaactacctggattatatgacatccatgaaacggtttaagaatgagtctgaccctgaaggtgcgctctggtga

SEQ ID NO: 13679 - RNA, 9879 nt, synthetic construct
  misc_feature 1..9879: note = derived and/or modified CDS sequence (opt3) from DENV-1__FJ410240__SS-prME
  source 1..9879: mol_type = other RNA
agcgtgaccatgctgctaatgcttatgcccaccgcactggctttccacttgactacgagaggcggggaacctcatatgatcgtctccaagcaggaaagggggaagtctttactgtttaagacctcagccggtgttaacatgtgcacactaattgccatggacctcggcgagttctgtgaagatactatgacctacaaatgcccacggataacagaagcggaaccggacgatgtggactgttggtgcaatgctaccgatacttgggtaacatatgggacctgtagtcagacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaagacgcaaactttgtttgccgccgaacattcgtggatagaggctggggtaatgggtgtggactgtttggcaaaggctccttgataacttgcgctaagttcaagtgcgtaaccaaactcgaggggaagacagtgcagtacgaaaacctgaaatattcagtcattgtgaccgcccacactggagaccagcatcaagttggtaatgagagtacggaacacggcacaaccgcgactatcacaccccaggcccctagcacagagattcagttaaccgactacggggcactgactctcgattgttctccaaggacaggacttgactttaacgaaatggtgctgttgacgatgaaggagaaatcctggctagtccataagcagtggttcctggatctcccgctgccctggacctcaggcgctagcacaagtcaagagacatggaatcggaaagaccttctggtgacctttaagacagcccacgctaagaaacaggaagtagttgtgttgggttctcaggagggggccatgcacactgcactcaccggcgccacggaaatccaaacctccggaacaactaccatcttcgctggccatctgaagtgccgtttaaaaatggataagctgacactaaaagggatgagctatgtcatgtgtactggatcgttcaagctcgagaaggaagtggcggagacccagcacggtacggtcctggtgcagattaaatacgagggcacagacgcaccttgcaagataccattttctacccaggatgaaaaaggggttactcaaaacggacgccttatcacagccaatcccattgtgaccgacaaggagaaacctgtaaacatcgaagctgagccacccttcggcgagtcctatatagtcattggtgccggggaaaaggcattgaagctgtcatggtttaaaaagggcagtagcatcggaaaaatgttcgaggccactgctagaggcgccaggcggatggcaatcctcggggataccgcgtgggactttggatccattggtggcgtgttcacatctgttgggaagctggtgcatcagatctttggaacggcttacggcgtccttttcagcggtgtgtcatggaccatgaaaattgggataggcgtactgttgacttggctcggactgaatagtcgatccactagcttatctatgacctgtatcgccgtgggcctggttacactatacctcggggtcatggtgcaggcagattcaggatgcgtgattaactggaagggccgcgaactgaagtgtggtagtgggatctttgtcactaatgaggttcacacctggacggaacagtataaattccaagccgacagcccgaagagactttccgctgccatcggaaaagcatgggaggagggcgtgtgcggtattaggtctgctacacggttggaaaacataatgtggaagcagatctcgaacgagctgaatcatattctcctggaaaacgacatgaaatttaccgtggtagtcggcgatgtggccgggatcttagcgcagggaaagaaaatgattcgccctcagcccatggagtacaagtatagctggaagtcctggggcaaagccaagatcataggggctgacgttcaaaatactaccttcatcattgatggaccaaacacacctgaatgtcccgacgatcagagagcatggaatatctgggaggtggaggactacggctttggtattttcactaccaacatctggctgaaacttagggattcatatacacaggtctgcgaccaccgtttgatgagtgccgctataaaggattctaaagccgtgcacgcagacatggggtactggattgaaagcgagaagaatgaaacgtggaagctcgcgcgggcctccttcatcgaggttaaaacctgtatttggccaaagtcacatactctgtggagcaacggagtgctagaatctgagatgatcatacccaaaatctatggcggtcctatttcccagcacaattaccgaccaggctactttacacaaaccgctgggccgtggcatctgggaaagctcgagctggatttcgacctttgcgaaggcactacagtagtcgtggatgagcactgcgggaacagaggacccagtttgaggaccacgactgtgaccggcaaaatcattcacgaatggtgttgccgcagctgtacactgcctccattacggtttaagggtgaggacgggtgctggtatggaatggagatcagacccgtcaaggaaaaagaggaaaatctcgttaagtctatggtgtccgccggctcaggtgaggtagacagtttcagcctgggccttctgtgtatatcgattatgatcgaagaggtgatgaggtcccgctggtctcgaaaaatgttgatgaccgggactctcgcagtctttttcctgctaatcatgggacagctgacatggaacgatctcattcggctgtgcatcatggtgggcgctaatgccagcgaccgtatggggatgggaaccacataccttgcattgatggccacttttaagatgagacctatgttcgctgttggcctgttatttaggcgcctcacctcacgggaggtgctgcttctgacgattggtctaagtctcgtcgcgtccgtggaactgccaaactctttggaggaactgggggatggattagccatgggcataatgatcctcaaactgcttacagacttccagagccatcaactgtgggcaaccttgctctccctgacttttattaagaccacattctcactacactatgcttggaagactatggccatggttctgagcatcgtgagtctttttcccctctgtctgtctaccacgtcccagaaaacaacctggttgccggtcctgttaggcagcctcgggtgcaagcctctgactatgttccttattgccgagaataaaatctggggaagaaagtcgtggccactgaacgaaggtataatggctgtaggcatcgtgtcaattttgctctctagtctgctcaagaatgatgttcccctggcagggcctcttatcgccggaggcatgctcattgcgtgttacgtgatctccggtagctctgctgacctgagcttggagaaggccgcagaggtctcctgggaagaggaagccgagcattcaggggctagtcacaatatattagtggaagtacaggatgacggaacaatgaaaattaaggatgaggagagggacgataccctgactatcctcctgaaggcaacacttctggccgtgagcggcgtctatcccttgtctatcccagcgaccctattcgtttggtacttttggcagaaaaagaaacaacgatccggcgtgctgtgggacacgccttcacccccagaagtggagcgcgctgtcctcgatgacgggatttatcggataatgcagagaggactgcttggtaggagtcaggtgggcgttggggtattccaggaaaacgtgtttcatactatgtggcacgtcacccgtggagccgtgttaatgtaccaaggcaagcgcctggagccgagctgggcatccgttaaaaaggacctcatctcttacggtgggggatggcggttgcagggctcgtggaatacaggcgaggaagtgcaggtcattgccgtggagcctgggaagaaccccaaaaatgtacagaccgctccaggaacattcaagactagcgaaggtgaggtcggcgccatcgcactggattttaaacccgggacctcaggatcccctattgtgaacagagaaggcaagatcgttggtctctatgggaatggagtggtcacgacaagtggcacttacgtgtctgctatagcccaagcgaaagccagccaggagggcccactgcccgagatcgaagacgaggttttcaggaagcgaaaccttaccattatggatctgcaccctgggtccggaaagacacggcgctatttgccggcaatcgtgagagaagctattaaaaggaagctacggaccctgatcctcgccccaactcgagtcgtggcttcagagatggcagaagccttaaaaggtatgcccataagataccagaccacagccgtaaagtctgagcatacgggcaaagagattgtggacctgatgtgccacgctacttttaccatgcgccttctgagccctgttagggtcccaaattataacatgatcatcatggatgaagcgcatttcacagaccccagttccattgcagcccgtgggtacatcagcacccgggtgggaatgggcgaggctgccgcaatatttatgactgccacacctccgggttctgtggaggctttcccccaatcaaatgcggtcattcaggatgaggaaagagacatcccagagaggtcctggaacagtgggtatgagtggattaccgattttcctggaaagacggtatggttcgtgcccagcatcaagtcgggcaatgacatagccaactgtctccgcaaaaatggcaagcgagttattcagttgtctagaaaaactttcgatacagaataccagaagaccaaaaacaacgactgggactacgtggtcaccactgatatctccgagatgggggcaaattttcgggctgacagggtgatcgatccacgccgttgcctgaagcctgttattctcaaggacggacccgaaagagtgatcctggccggtccaatgccggtcacagtggcaagcgccgctcaacggaggggccgcattgggcgaaaccacaataaagagggagatcagtatatatacatgggccagcctcttaacaatgacgaggatcatgcccactggaccgaagcgaagatgctactggacaacatcaatacacccgagggtattatcccagcattgttcgaacccgagagagaaaaatcagccgctatcgatggggagtatcggttaaggggcgaggcccgcaagacttttgtagaactgatgagaaggggagacctccctgtgtggctgagttacaaagttgcttctgagggcttccagtattccgatcggcgttggtgctttgacggggaacgcaacaatcaagtccttgaggaaaacatggatgtggagatttggacgaaggagggagaacgaaagaaactgagaccaaggtggctcgacgcacggacctacagcgaccccttggccctgcgcgagttcaaagaatttgctgccggtagaaggtcagtgagtggcgatctaatactggagatcgggaaactccctcagcaccttacacagcgggcacagaatgcgctggacaacttagtcatgttgcataatagcgaacaaggaggccgagcctatagacacgctatggaggagctgccggatactattgaaaccctcatgctgcttgccctgatcgcagttctcacaggtggggtgaccttgttctttctgtccggccgcggattaggcaagacttctattgggctactgtgtgtaatggctagctccgtgctcctttggatggcctcagtcgagccacattggatcgcagcctctataatcctggagttctttttgatggtgctgctcattcccgagcctgacaggcagcggacgccccaggataaccagctggcttacgttgtgatcggacttctcttcatgattctgaccgtcgcggccaatgagatgggtttgctggaaacaactaaaaaggacttaggcatcgggcacgtagcagtggagaaccaccatcacgctgccatgctagatgttgacctgcatccagccagtgcatggaccctctacgctgtggccacaaccataattactcctatgatgcgtcacacaatcgaaaacacgaccgcgaatatttcgcttactgctatcgccaaccaagcagccatactgatgggattggataaaggctggcccatcagcaagatggacattggtgtcccactgctcgctctggggtgctattcccaggtgaatcctcttacattaaccgcagccgtcctgatgctcgtggcgcattacgctatcattggcccgggattgcaggccaaggcaaccagagaggcccagaagaggacagctgccggcatcatgaagaaccccactgttgatgggatagtggcaattgacctggatccagtagtgtatgacgctaaatttgaaaagcagctaggacagatcatgctgctcatcctttgtacgtctcagattctgttgatgcgcaccacatgggccctgtgcgagtcaatcactctcgcgaccggccctctgacaaccttatgggagggtagccccgggaaattctggaatactacgatagccgtctccatggcaaacattttccggggaagttaccttgctggcgccggtctggcattttctctcatgaaaagcctaggcgggggacgaagaggcacaggggctcaaggagaaaccctgggcgagaagtggaaaaggcagttgaatcagctgtcaaagtccgagttcaacacttataaacgcagtggtatcatggaggttgaccggagcgaagccaaggaggggctcaaaagaggagagaccacaaagcacgccgtgtctcgtggcactgcgaaacttaggtggtttgtcgaacggaatctggtgaaaccagagggtaaggtaattgatttgggctgtgggcgcggaggctggtcctactattgcgctgggctgaaaaaggtgaccgaagttaaaggatacacaaagggcggtcctgggcacgaggaacccatcccgatggcaacgtacggatggaacctcgtgaaattacattcaggcaaggacgtcttctttataccacctgagaagtgtgataccctgctttgcgacatcggcgagagctcgcccaatccaactattgaagaggggcgaacactgagagtgctaaaaatggtcgaaccctggctcaggggaaaccagttctgtatcaagattctgaatccttatatgccgtctgtggttgagaccttggagcaaatgcagcggaaacacggtggcatgctggtacgcaaccccctcagtagaaattccactcatgaaatgtactgggtgagctgcgggacaggaaacatcgtctcagccgtgaatatgacctccaggatgcttctgaaccgatttacgatggctcaccggaagccaacctatgagcgtgatgttgacttaggcgccggtacaagacacgtggcagtcgaacctgaggtggccaacctggatattatcgggcagcgcatagaaaatattaaacatgagcacaagtctacttggcattacgacgaggataacccctataagacctgggcttaccacggaagctatgaagtaaaacctagtggctccgcgagctctatggtgaatggcgttgtcaagttgctcacaaaaccatgggacgtgatccccatggtgactcagatcgccatgaccgatacaacccctttcgggcaacagagggtctttaaggagaaagttgacactcggacgccaaaggcaaagagaggaacagctcagattatggaagtgaccgccaaatggctgtggggtttcctatcacgcaacaagaaacccaggatatgtactcgagaggaatttacccggaaggtaagaagtaatgcagccatcggcgctgtgttcgtcgacgagaaccaatggaactccgccaaagaggcggtggaagatgagaggttttgggaccttgttcatcgcgaacgtgagctgcacaagcaggggaagtgcgcaacatgcgtgtacaacatgatgggaaaacgggaaaagaaactcggcgagttcggtaaggccaaagggagcagagctatttggtacatgtggctgggagccaggttcttggagtttgaagcactgggcttcatgaatgaggatcactggttttctcgcgaaaactcgctctcaggcgtcgagggggagggacttcataagctgggttatatcttacgagacattagcaaaatcccgggcgggaatatgtacgctgatgacacggccggatgggatacccggataactgaagacgatctgcagaacgaggctaagatcacagacattatggaacctgagcacgccttgctcgcaaagtccatcttcaaactgacctatcagaataaggtggtaagagttcaaaggccagcgaaaaacggcactgtgatggatgtcattagtcgcagagaccagcggggttctggacaggtgggaacatacggcctaaatacctttacaaacatggaagcccagcttatcaggcaaatggagagcgagggcatattctccccctcagaactggagactcctaacctcgctgggcgtgtgctggattggttggaaaagcatggagtcgagcgattaaaacgcatggccattagtggtgacgactgtgttgtgaagccaatcgatgacagatttgcaaccgctctgacggccctcaatgatatgggcaaggtacggaaagacatcccccagtgggaaccgtctaaggggtggaacgattggcaacaggtgcctttctgcagccaccactttcatcaacttattatgaaagacggaagggagatagtcgtgccctgtcgcaatcaggatgagctggttggcagagcacgggtgtcccagggtgccgggtggtcactaagggaaaccgcgtgcctgggaaagagctatgctcagatgtggcaactcatgtacttccaccgacgtgacttgagactggccgcaaacgccatctgttctgctgtcccagtggattgggtacctacatcccgcactacctggagtattcatgcccaccatcagtggatgacaactgaggacatgcttagcgtttggaatcgggtgtggatcgaagagaacccctggatggaagataaaacccacatttcgtcctggggcgacgtcccatatctgggcaagagggaggaccagtggtgcgggtctctcatcggattaacggcaagagctacatgggccaccaatatacaagtggcgatcaaccaggttcgccggctgattggtaatgagaactacttggattacatgacttcaatgaagaggtttaaaaatgaaagcgaccccgagggcgctctgtggtga

SEQ ID NO: 13680 - RNA, 9879 nt, synthetic construct
  misc_feature 1..9879: note = derived and/or modified CDS sequence (opt3) from DENV-1__FJ410242__SS-prME
  source 1..9879: mol_type = other RNA
agcgtgaccatgctgctaatgcttatgcccacagcactggctttccacttgactacgcgaggcggggaacctcatatgatcgtctccaagcaggaaagggggaaatctttactgtttaagacctcagccggtgttaacatgtgcacactaattgcaatggacctcggcgagttctgtgaagatactatgacctacaaatgcccacggataacagaagcggaaccggacgatgtggactgttggtgcaatgctaccgatacttgggtgacatatgggacctgtagtcagacgggagaacaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaagacgcaaactttgtttgccgccgaacattcgtggatagaggctggggtaatgggtgtggactgtttggcaaaggctccttgataacttgcgctaagttcaagtgcgtaaccaaactcgaggggaagattgtgcagtacgaaaacctgaaatattcagtcatcgtgacagttcacaccggagaccagcatcaagtgggtaatgagagtactgaacacggcacgacagccaccattactccccaggcgcctagcaccgagatccagttaacagactacggggccctgaccctcgattgttctccaaggactggacttgactttaacgaaatggtcctgttgacaatgaaggagaaatcctggctagtgcataagcagtggttcctggatctcccgctgccctggacgtcaggcgcaagcaccagtcaagagacttggaatcggaaagaccttctggtaacatttaagaccgctcacgccaagaaacaggaagttgtggtcttgggttctcaggagggggctatgcacacagccctcactggcgcaaccgaaatccaaacgtccggaaccacaactattttcgccggccatctgaagtgccgtttaaaaatggataagctgaccctaaaagggatgagctatgtgatgtgtacaggatcgttcaagctcgagaaggaagtcgctgagactcagcacggtaccgtgctggttcagataaaatacgagggcacggacgcgccttgcaagatcccattttctacacaggatgaaaaaggggtgacccaaaacggacgccttattactgcaaatcccatcgtaacagacaaggagaaacctgtcaacatagaagccgagccacccttcggcgagtcctatattgtgatcggtgctggggaaaaggccttgaagctgtcatggtttaaaaagggcagtagcatcggaaaaatgttcgaggcaaccgccagaggcgctaggcggatggccattctcggggatactgcatgggactttggatccatcggtggcgttttcacctctgtggggaagctggtccatcagatttttggaacagcgtacggcgtgcttttcagcggtgtatcatggacgatgaaaatagggatcggcgtgctgttgacctggctcggactgaatagtcgatccactagcttatctatgacatgtattgctgttggcctggtcaccctatacctcggggtgatggtgcaggccgattcaggatgcgtcatcaactggaagggccgcgaactgaagtgtggtagtgggatctttgttacaaatgaggtgcacacttggaccgaacagtataaattccaagcagacagcccgaagagactttccgccgctattggaaaagcctgggaggagggcgtgtgcggtataaggtctacgacacggttggaaaacatcatgtggaagcagatttcgaacgagctgaatcatatcctcctggaaaacgacatgaaatttaccgtagtcgtgggcgatgttgcagggattttagctcagggaaagaaaatgatccgccctcagcccatggagtacaagtatagctggaagtcctggggcaaagccaagataatcggggcggacgtgcaaaatactaccttcattatcgatggaccaaacacacctgaatgttcagacgatcagagagcctggaatatttgggaggtcgaggactacggctttggtatcttcactaccaacatatggctgaaacttagggatagttatacacaggtgtgcgaccaccgtttgatgtctgctgcaattaaggatagcaaagccgttcacgctgacatggggtactggatcgaatccgagaagaatgaaacgtggaagctcgcccgggcatcattcattgaggtgaaaacctgtatctggcccaagagccatactctgtggtctaacggagtactagaatccgagatgataatcccaaaaatttatggcggtcccatcagtcagcacaattaccgacctggctactttacacaaaccgcggggccatggcatctgggaaagctcgagctggatttcgacctttgcgaaggcactacagtcgtggtggatgagcactgcgggaacagaggaccgagcttgaggaccacgactgtcaccggcaaaattatccacgaatggtgttgccgctcttgtacactgccccctttacggtttaagggtgaggacgggtgctggtatggaatggagataagaccagttaaggaaaaagaggaaaatctcgtgaagtccatggtatcagccggcagtggtgaggtggacagcttctcgctgggccttctgtgtatttccatcatgatcgaagaggtcatgaggtctcgctggagccgaaaaatgttgatgaccgggactctcgctgtgtttttcctgctaattatgggacagctgacatggaacgatctcatccggctgtgcattatggttggcgccaatgcatcagaccgtatggggatgggaaccacataccttgctttgatggccacttttaagatgagacccatgttcgcagtgggcctgttatttaggcgcctcaccagtcgggaggtcctgcttctgacgataggtctatccctcgtggcctctgttgaactgcctaacagcttggaggaactgggggatggattagctatgggcatcatgattctcaaactgcttacagacttccagtcccatcaactgtgggcgaccttgctctcactgacttttatcaagaccacattcagcctacactatgcctggaagactatggcaatggtgctgagtattgtctctctttttccactctgtctgtccaccacgagccagaaaacaacctggttgcccgtactgttaggctcgctcgggtgcaagccgctgactatgttccttatcgctgagaataaaatatggggaagaaagtcatggcctctgaacgaaggtatcatggccgtgggcattgtttctatcttgctcagttccctgctcaagaacgatgtgccactggccgggccccttattgctggaggcatgctcatcgcatgttacgtcataagcggttctagcgccgacctgtccttggagaaggcggctgaggtgtcatgggaagaggaagccgagcatagtggggcaagccacaatattttagtagaagtgcaggatgacggaacaatgaaaatcaaggatgaggagagggacgataccctgactatcctcctgaaggccacacttctggctgtctctggcgtttatcctttgtccattcccgcaaccctattcgtgtggtacttttggcagaaaaagaaacaacgatcaggcgtgctgtgggacacgccaagtcctcccgaagtcgagcgcgccgtgctcgatgacgggatatatcggatcatgcagagaggactgcttggtaggagccaggttggcgtaggggtgttccaggaaaacgtctttcatactatgtggcacgtgacccgtggagcggttttaatgtaccaaggcaagcgcctggagccatcctgggcttctgtgaaaaaggacctcatttcgtacggtgggggatggcggttgcagggcagctggaatacaggcgaggaagtccaggtgatcgccgtagagccggggaagaaccctaaaaatgtccagaccgcacccggaacattcaagacttcagaaggtgaggtgggcgccattgctctggattttaaaccagggacctccggaagtcccatcgttaacagagaaggcaagatagtgggtctctatgggaatggagtcgtgacgacatctggcacttacgttagcgccatcgcacaagctaaagcctcccaggagggccctctgccagagattgaagacgaggtgttcaggaagcgaaaccttaccatcatggatctgcaccccgggtcaggaaagacacggcgctatttgcctgcgattgtcagagaagccatcaaaaggaagctacggaccctgatactcgcaccgactcgagtggtagcttctgagatggccgaggctttaaaaggtatgccaattagataccagaccacagcagtaaagagcgagcatacgggcaaagagatcgttgacctgatgtgccacgccacttttaccatgcgccttctgagtcccgtcagggtgcctaattataacatgatcattatggatgaagcccatttcacagacccatccagcatcgctgcgcgtgggtacatatctacccgggtgggaatgggcgaggcagccgctatttttatgactgccacaccccctggttcagtcgaagcattcccgcaatccaatgccgtaatccaggatgaggaaagagacattcccgagaggagttggaacagcgggtatgagtggatcaccgattttccaggaaagacggtgtggttcgttccttcgataaagtctggcaatgacattgctaactgtctccgcaaaaatggcaagcgagtgatccagttgtccagaaaaactttcgatacagaataccagaagaccaaaaacaacgactgggactacgtcgtgaccactgatatcagcgagatgggggcgaattttcgggccgacagggttattgatccccgccgttgcctgaagccagtgatcctcaaggacggacctgaaagagtcattctggcaggtcccatgccagtgacagtagcttcagccgcacaacggaggggccgcatagggcgaaaccacaataaagagggagatcagtatatctacatgggccagccgcttaacaatgacgaggatcatgcccactggaccgaagctaagatgctactggacaacattaatacacctgagggtatcatccccgccttgttcgaaccagagagagagaaaagtgcggcaattgatggggagtatcggttaaggggcgaggcccgcaagacttttgtggaactgatgagaaggggagacctccccgtttggctgtcttacaaagtcgcttccgagggcttccagtatagcgatcggcgttggtgctttgacggggaacgcaacaatcaagtgcttgaggaaaacatggatgtggagatatggacgaaggagggagaaaggaaaaagctgagacctagatggctcgacgcccggacctactcagacccattggctctgcgcgagttcaaggaatttgcagccggtagaaggagtgtcagcggcgatctaatcctggagattgggaaactcccccagcaccttacacagcgggctcagaatgccctggacaacttagttatgttgcataattccgaacaaggaggccgagcatatagacacgcgatggaggagctgcctgatactatcgaaaccctcatgctgcttgccctgattgctgtgctcacaggtggggtaaccttgttctttctgtctggccgcggattaggcaagactagcatcgggctactgtgtgtgatggcctcctcagtcctcctttggatggcatctgtggagccgcattggatagctgccagtatcattctggagttctttttgatggttctgctcatcccagagcccgacaggcagcggacgcctcaggataaccagctggcatacgtggtcattggacttctcttcatgatcctgaccgtagccgctaatgagatgggtttgctggaaacaactaaaaaggacttaggcatagggcacgtggcggccgagaaccaccatcacgcagctatgctagatgttgacctgcatcccgcctcggcctggaccctctacgcagtggctacaaccattatcactccaatgatgcgtcacacaattgaaaacacgaccgccaatatcagccttactgcgatagctaaccaagccgcaatcctgatgggattggataaaggctggcctatttccaagatggacatcggtgtccccctgctcgccctggggtgctattctcaggtgaatccacttacattaaccgctgcagtcctgatgctcgtggcccattacgcgattatcggccctggattgcaggctaaggccaccagagaggcacagaaaaggacagccgctggcataatgaagaacccgactgttgatgggattgtggccatcgacctggatcccgtagtgtatgacgcaaaatttgaaaagcagctaggacagatcatgctgctcattctttgtacgtcacagatcctgttgatgcgcaccacatgggctctgtgcgagagcataactctcgccaccggcccactgacaaccttatgggagggttcccctgggaaattctggaatactacgattgcggtcagtatggccaacatcttccggggatcttaccttgcaggcgctggtctggcctttagcctcatgaagtcactaggcgggggacgaagaggcacaggggcacaaggagaaaccctgggcgagaagtggaaaaggcagttgaatcagctgtccaagagtgagttcaacacttataaacgcagcggtattatggaggttgaccggtctgaagctaaggaggggctcaaaagaggagagaccacaaagcacgccgtgtcccgtggcactgccaaacttaggtggtttgtcgaacggaatctggtgaaacccgagggtaaggtaatcgatttgggctgtgggcgcggaggctggtcatactattgcgcggggctgaaaaaggtgaccgaagttaaaggatacacaaagggcggtccagggcacgaggaacctatacccatggctacgtacggatggaacctcgtgaaattacatagcggcaaggacgtcttctttatcccgccagagaagtgtgataccctgctttgcgacattggcgagtcgtctcctaatcccactatcgaagaggggcgaacactgagagtgctaaaaatggtcgaaccatggctcaggggaaaccagttctgtattaagatcctgaatccctatatgcctagtgtggttgagaccttggagcaaatgcagcggaaacacggtggcatgctggtacgcaacccgctctccagaaatagcactcatgaaatgtactgggtgtcatgcgggacaggaaacattgtctccgcagtgaatatgacctctaggatgcttctgaaccgatttacgatggcccaccggaagcccacctatgagcgtgatgttgacttaggcgctggtacaagacacgtggccgtcgaaccagaggtggcaaacctggatatcatagggcagcgcattgaaaatatcaaacatgagcacaagagcacttggcattacgacgaggataacccttataagacctgggcctaccacggaagttatgaagtaaaaccctccggcagcgcttcttcaatggtgaatggcgttgtcaagttgctcacaaaaccttgggacgtgatcccaatggtgactcagattgcgatgaccgatacaacccccttcgggcaacagagggtctttaaggagaaagttgacactcggacgcctaaggccaagagaggaacagcacagataatggaagtgaccgctaaatggctgtggggtttcctaagtcgcaacaagaaaccaaggatctgtactcgagaggaatttacccggaaggtaagatccaatgccgcaattggcgccgtgttcgtcgacgagaaccaatggaatagcgctaaagaggccgtggaagatgagaggttttgggaccttgttcatcgcgaacgtgagctgcacaagcaggggaagtgcgcgacatgcgtgtacaacatgatgggaaaacgggaaaagaaactcggcgagttcggtaaggcaaaagggtctagagccatctggtacatgtggctgggagctaggttcttggagtttgaagccctgggcttcatgaatgaggatcactggttttcgcgcgaaaactcactcagcggcgtcgagggggagggacttcataagctgggttatattttacgagacatctccaaaatacccggcgggaatatgtacgcagatgacacggctggatgggatacccggatcactgaagacgatctgcagaacgaggccaagattacagacatcatggaaccggagcacgctttgctcgccaagagtattttcaaactgacctatcagaataaggtggtaagagttcaaaggcctgccaaaaacggcactgtgatggatgtcatctctcgcagagaccagcggggtagcggacaggtgggaacatacggcctaaatacctttacaaacatggaagcgcagcttataaggcaaatggagtccgagggcattttctcaccaagtgaactggagactcccaacctcgccgggcgtgtgctggattggttggaaaagcatggagtcgagcgattaaaacgcatggctatctctggtgacgactgtgttgtgaagcctatcgatgacagatttgccaccgcactgacggctctcaatgatatgggcaaggtacggaaagacattccacagtgggaacccagcaaggggtggaacgattggcaacaggtgccgttctgctcccaccactttcatcaacttataatgaaagacggaagggagatcgtcgtgccttgtcgcaatcaggatgagctggttggcagagcccgggtgtcacagggtgcagggtggagcctaagggaaaccgcctgcctgggaaagtcttatgcgcagatgtggcaactcatgtacttccaccgacgtgacttgagactggctgccaacgcaatttgttccgccgtccccgtggattgggtaccaacaagtcgcactacctggagcatccatgctcaccatcagtggatgacaactgaggacatgctttcggtttggaatcgggtgtggattgaagagaacccttggatggaagataaaacccacatctcctcttggggcgacgtcccctatctgggcaagagggaggaccagtggtgcgggtcactcataggattaacggccagagcaacatgggctaccaatatccaagtggccattaaccaggttcgccggctgatcggtaatgagaactacttggattacatgactagcatgaagaggtttaaaaatgaaagtgacccagagggcgcgctgtggtga

SEQ ID NO: 13681 - RNA, 9879 nt, synthetic construct
  misc_feature 1..9879: note = derived and/or modified CDS sequence (opt3) from DENV-1__FJ410243__SS-prME
  source 1..9879: mol_type = other RNA
agcgtgaccatgctgctcatgcttatgcccaccgcactggctttccacttgactacgagaggaggggaacctcatatgatcgtctccaagcaggaaagggggaaatctttactgtttaagacctcagccggtgttaacatgtgcacactgattgccatggacctcggagagttctgtgaagatactatgacctacaaatgcccacggataacagaagcggaaccggacgatgtggactgttggtgcaatgctaccgatacttgggtaacatatgggacctgtagtcagacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaggacgcaaactttgtttgccgccgaacattcgtggatagaggctggggtaatgggtgtggactgtttggcaaaggctccttgataacttgcgctaagttcaagtgcgtaaccaaactcgaggggaagacagtgcagtacgaaaacctgaaatattcagtcattgtgaccgttcacactggagaccagcatcaagtgggtaatgagagtacggaacacggcacaaccgccactatcacaccccaggcgcctagcacagagattcagttaaccgactacggggccctgactctcgattgttctccaaggacaggacttgactttaacgaaatggtcctgttgacgatgaaggagaaagcatggctagtgcataagcagtggttcctggatctcccgctgccctggacctccggcgcttcaactagccaagagacatggaatcggaaagaccttctggtaacctttaagacagcccacgctaagaaacaggaagttgtggtcttgggtagtcaggagggggccatgcacactgcactcaccggcgccacggaaatccaaacctctggaacaactaccatcttcgctggccatctgaagtgccgtttaaaaatggataagctgacactacgcgggatgtcctatgtgatgtgtactggcagcttcaaactcgagaaggaagtcgcggagacccagcacggtacggtgctggttcagattaagtacgagggcacagacgcaccttgcaaaataccattttcgacccaggatgaaaagggggtgactcaaaacggaagacttatcacagccaatcccattgtaaccgacaaagagaagcctgtcaacatcgaagctgagccacccttcggcgagtcttatatagtgattggtgccggggaaaaagcattgaagctgtcctggtttaagaaaggctcaagtatcggaaagatgttcgaggccactgctaggggcgcccggcgaatggcaatcctcggggataccgcgtgggactttggaagcattggtggcgttttcacatccgtggggaaactggtccatcagatctttggaacggcttacggcgtgcttttctctggtgtaagctggaccatgaagattgggataggcgtgctgttgacttggctcggactaaattcacgcagtacatccttaagcatgacctgtatcgccgttggcctggtcacactatacctcggggtgatggtgcaggcagattctggatgcgtcattaactggaaaggcagagaactgaagtgtggttcagggatctttgttactaatgaggtgcacacctggacggaacagtataagttccaagccgacagtccgaaaaggcttagcgctgccatcggaaaggcatgggaggagggcgtgtgcggtattcggtccgctacacgcttggaaaacataatgtggaaacagatctctaacgagctgaatcatattctcctggaaaacgacatgaagtttaccgtagtcgtgggcgatgttgccgggatcttagcgcagggcaagaagatgattagacctcagcccatggagtacaaatattcgtggaaaagctggggcaaggccaagatcataggggctgacgtgcaaaatgcaactttcatcattgatggaccaaacacccctgaatgtcccgacgatcagagggcctggaatatctgggaggtcgaggactacggctttggtattttcacaactaacatctggctgaaacttcgtgattcctatacccaggtgtgcgaccaccggttgatgtcagctgccataaaagatagtaaggcagttcacgcggacatggggtactggattgaatctgagaaaaatgaaacatggaagctcgcccgagctagcttcatcgaggtgaagacgtgtatttggccaaaatcccataccctgtggtcaaacggagtactagaaagcgagatgatcatacccaagatctatggcggtcctatttctcagcacaattacagaccaggctactttactcaaacagccgggccgtggcatctgggaaaactcgagctggatttcgacctttgcgaaggcaccactgtcgtggtggatgagcactgcgggaacaggggaccctccttgcgcacaaccacggtcactggcaagatcattcacgaatggtgttgccggagttgtaccctgcctccattaagatttaaaggtgaggacgggtgctggtatggaatggagatcaggcccgttaaggaaaaggaggaaaatctcgtgaaaagcatggtatctgcaggctccggtgaggtggactcattcagtctgggccttctgtgtataagcattatgatcgaagaggtcatgcgctcgcgatggtcccggaagatgttgatgacagggaccctcgctgtgtttttcctgctaatcatgggacagctgacttggaacgatctcattcgtctgtgcatcatggttggcgccaatgcatctgacagaatggggatgggaacaacctaccttgccttgatggctacatttaaaatgaggcctatgttcgcggtgggcctgttatttcgccggctcactagcagagaggtcctgcttctgaccattggtctatcactcgtggccagtgttgaactgccaaactccttggaggaactgggggatggattagcaatgggcataatgatcctcaagctgcttacggacttccagtctcatcaactgtgggctacattgctcagcctgacctttattaaaactaccttctccctacactatgcctggaagacaatggccatggtgctgtcaatcgtcagcctttttcccctctgtctgagtactacctctcagaagacgacatggttgccggtactgttaggctccctcgggtgcaaacctctgaccatgttccttattgctgagaataagatctggggaaggaaaagctggccactgaacgaaggtataatggcagtgggcatcgtttcgattttgctctcatctctgctaaagaacgatgtgcccctggccgggcctcttatcgcgggaggcatgctcattgcttgttacgtcatcagtggttccagcgccgacctgtctttggagaaagcagccgaggtgagctgggaagaggaagctgagcattccggggcatcacacaatatattagtagaagtgcaggatgacggacccatgaagattaaagatgaggagcgagacgatatgctgactatcctcctgaaggccacacttctggcggtcagtggcgtttatccattgagcatccctgctaccctattcgtgtggtacttttggcagaagaaaaagcaacgctctggcgtgctgtgggacactccctccccaccggaagtcgagcgggccgtgctcgatgacgggatttatagaataatgcagaggggactgcttggtcgttcacaggttggcgtaggggtgttccaggaaaacgtctttcatacaatgtggcacgtgacccgcggagcagttttaatgtaccaaggcaaacggctggagcctagttgggccagcgtgaagaaagacctcatctcctacggtgggggatggagattgcagggctcttggaatacgggcgaggaagtccaggtgattgctgtagagcccgggaagaacccaaagaatgtccagactgcccccggaaccttcaaaacatcggaaggtgaggtgggcgcaatcgctctggattttaagcctgggaccagcggatcaccaattgttaacagggaaggcaaaatcgtgggtctctatgggaatggagtcgtgacaacttccggcacctacgttagtgccatagcgcaagccaaggcatctcaggagggccccctgcctgagatcgaagacgaggtgttccgaaaacggaaccttacgattatggatctgcacccggggagcggaaagacacgcagatatttgccagctatcgtcagggaagccattaagcggaaactacgaactctgatcctcgctcccaccagagtggtagcatccgagatggccgaagccttaaagggtatgcctatacgctaccagacaaccgctgtgaaatcagagcatactggcaaggagattgttgacctgatgtgccacgcgacctttacaatgaggcttctgtctccagtccgtgtgcccaattataacatgatcatcatggatgaagcacatttcacggaccctagcagtattgccgctcgggggtacatctccactagagtgggaatgggcgaggccgcagccatatttatgaccgctacaccgcccggtagcatggaagcgttcccacaatctaatgccgtcattcaggatgaggaaagggacatccctgagcgctcatggaactccgggtatgagtggattaccgattttcccggaaaaactgtatggttcgtgccaagtatcaagagcggcaatgacatagcaaactgtctccgaaagaatggcaaaagagttattcagttgtcgcggaagacattcgataccgaataccagaaaacgaagaacaacgactgggactacgtggtcactacagatatctctgagatgggggctaattttagggccgaccgcgtgatcgatcctcgtagatgcctgaaacccgttattctcaaggacggaccagaacgggtgatcctggcaggtccgatgcctgtcaccgtggcctccgctgcccaaaggcgcggccgaattgggagaaaccacaataaggagggagatcagtatatatacatgggccagccccttaacaatgacgaggatcatgcgcactggaccgaagcaaaaatgctactggacaacatcaatactccagagggtattatccccgccttgttcgaacctgagcgggaaaagagcgctgccatcgatggggagtataggttacgcggcgaggctagaaaaacatttgtagaactgatgaggcggggagacctcccagtgtggctgtcatacaaggttgcaagtgagggcttccagtattctgatcgtcgctggtgctttgacggggaacgaaacaatcaagtccttgaggaaaacatggatgtggagatttggaccaaagagggagaaagaaagaaactgaggccccggtggctcgacgcccgcacatactccgaccctttggctctgagagagttcaaggaatttgccgcaggtaggcggagcgtgtcaggcgatctaatactggagatcgggaagctcccgcagcaccttactcagcgagcgcagaatgccctggacaacttagtcattttgcataatagtgaacaaggaggcagagcttatcgccacgccatggaggagctgccagatacgatcgaaaccctcatgctgcttgcactgattgctgttctcacaggtggggtgactttgttctttctgagcggcaggggattaggcaaaacctccatcgggctactgtgtgtaatggcctctagcgtgctcctttggatggcatccgtcgagccccattggatagccgcttcaatcattctggagttctttttgatggtgctgctcatccctgagcccgaccggcagcgtacaccacaggataaccagctggcgtacgttgtgattggacttctcttcatgatcctgaccgtcgccgcaaatgagatgggtttgctggaaactacgaagaaagacttaggcatagggcacgtagctgtggagaaccaccatcacgccgccatgctagatgttgacctgcatcctgcatctgcttggaccctctacgccgtggcgacaactattatcacccccatgatgagacacacaattgaaaacaccactgctaatatcagtcttacagccatagcaaaccaagccgctatcctgatgggattggataagggctggccaatttcgaaaatggacatcggtgtccctctgctcgcactggggtgctatagccaggtgaatccgcttacgttaaccgccgcggtcctgatgctcgtggctcattacgccattatcggccccggattgcaggcaaaggccactagggaggctcaaaagcgcacagccgcaggcataatgaaaaacccaaccgttgatgggattgtggctatcgacctggatcctgtagtgtatgacaccaagtttgaaaaacagctaggacagatcatgctgctcattctttgtacatcccagatcctgttgatgcggactacgtgggccctgtgcgagtctataaccctcgcgacaggccccctgactaccttatgggagggttcaccagggaagttctggaatacaaccattgccgtcagcatggcaaacatcttccgaggatcctaccttgctggcgccggtctggcatttagtctcatgaaatctctaggcgggggaagaaggggcactggggctcaaggagaaacgctgggcgagaagtggaagcgccagttgaatcagctgagcaaatcagagttcaacacatataagcggtccggtattatggaggttgacagaagtgaagccaaagaggggctcaagcgtggagagaccactaaacacgccgtgagcaggggcaccgcgaaacttcggtggtttgtcgaacgcaatctggtgaagcctgagggtaaagtaatcgatttgggctgtgggcgaggaggctggtcttactattgcgctgggctgaagaaagtgacagaagttaagggatacactaaaggcggtcccgggcacgaggaaccgataccaatggcaacctacggatggaacctcgtgaagttacattccggcaaagacgtcttctttatccctcccgagaagtgtgatacactgctttgcgacattggcgagtcaagcccaaatcccacgatcgaagaggggagaaccctgagggtgctaaagatggtcgaaccttggctccggggaaaccagttctgtattaaaatcctgaatccgtatatgccctcggtggttgagactttggagcaaatgcagcgcaagcacggtggcatgctggtaagaaacccactctctaggaatagtacacatgaaatgtactgggtgtcctgcgggaccggaaacattgtcagcgccgtgaatatgacttcacgaatgcttctgaaccggtttacaatggctcaccgtaaacctacctatgagagagatgttgacttaggcgccggtacgcgccacgtggcagtcgaacccgaggtggccaacctggatatcatagggcagaggattgaaaatatcaagcatgagcacaaatccacctggcattacgacgaggataacccttataagacatgggcttaccacggatcttatgaagtaaagccaagcggcagtgcgtccagcatggtgaatggcgttgtcaaattgctcactaagccctgggacgtgatccctatggtgacccagattgccatgacagatactaccccattcgggcaacagcgggtctttaaagagaaggttgacacaagaacccccaaagcaaagcgcggaactgctcagataatggaagtgacggccaagtggctgtggggtttcctatctaggaacaaaaagccgcgaatctgtacacgggaggaatttaccagaaaagtaaggtcaaatgcagccattggcgctgtgttcgtcgacgagaaccaatggaatagtgccaaggaggcggtggaagatgagcgcttttgggaccttgttcatcgtgaacgggagctgcacaaacaggggaagtgcgcaacttgcgtgtacaacatgatgggaaagagagagaagaagctcggcgagttcggtaaagccaaggggtccagggctatctggtacatgtggctgggagcccgcttcttggagtttgaagcactgggcttcatgaatgaggatcactggtttagccgagaaaactctctctcgggcgtcgagggggagggacttcataaactgggttatattttacgggacatctcaaagatacctggcgggaatatgtacgctgatgacaccgccggatgggatacaagaatcacggaagacgatctgcagaacgaggctaaaattaccgacatcatggaaccagagcacgccttgctcgcaaagagcattttcaagctgacttatcagaataaagtggtaagggttcaacgccccgcgaagaacggcacagtgatggatgtcatctccagacgggaccagaggggtagtggacaggtgggaacctacggcctaaatacttttacaaacatggaagcccagcttatacgtcaaatggagtctgagggcattttcagcccttccgaactggagaccccaaacctcgctgggcgagtgctggattggttggaaaaacatggagtcgagcgcttaaagagaatggccatctcaggtgacgactgtgttgtgaaacccatcgatgaccggtttgcaacagctctgactgccctcaatgatatgggcaaggtaaggaaggacattccgcagtgggaacctagtaaagggtggaacgattggcaacaggtgcccttctgctctcaccactttcatcaacttataatgaaggacggacgcgagatcgtcgtgccatgtagaaatcaggatgagctggttggccgggcaagggtgagccagggtgccgggtggtccctacgagaaaccgcgtgcctgggaaaatcatatgctcagatgtggcaactcatgtacttccaccgtagagacttgcgcctggccgcaaacgccatttgtagcgctgtccctgtggattgggtacccacgtctcggaccacatggtccatccatgcccaccatcagtggatgactaccgaggacatgcttagtgtttggaatagggtgtggattgaagagaacccatggatggaagataagacacacatcagctcgtggggcgacgtcccctatctgggcaaaagagaggaccagtggtgcgggtccctcataggattaactgcacgcgctacctgggccacgaatatccaagtggcgattaaccaggttcggaggctgatcggtaatgagaactacttggattacatgacatctatgaagcgatttaagaatgaaattgaccctgagggcgctctgtggtga

SEQ ID NO: 13682 - RNA, 9879 nt, synthetic construct
  misc_feature 1..9879: note = derived and/or modified CDS sequence (opt3) from DENV-1__FJ410244__SS-prME
  source 1..9879: mol_type = other RNA
agcgtgaccatgctgctcatgcttatgcccaccgcactggctttccacttgactacgagaggcggggaacctcatatgatcgtctccaagcaggaaagggggaaatctttactgtttaagacctcagccggtgttaatatgtgcacactaattgccatggacctcggcgagttctgtgaagatactatgacctacaaatgcccacggataacagaagcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaggacgcaaactttgtttgccgccgaacattcgtggatagaggctggggtaatgggtgtggactgtttggcaaaggctccttgataacttgcgctaagttcaagtgcgtaaccaaactcgaggggaagacagtgcagtacgaaaacctgaaatattcagtcattgtgaccgttcacactggagaccagcatcaagtgggtaatgagagtacggaacacggcacaaccgccactatcacaccccaggcgcctagcacagagattcagttaaccgactacggggccctgactctcgattgttctccaaggacaggacttgactttaacgaaatggtcctgttgacgatgaaggagaaatcctggctagtgcataagcagtggttcctggatctcccgctgccctggacctcaggcgcaagcacaagtcaagagacatggaatcggaaagaccttctggtaacctttaagacagctcacgccaagaaacaggaagttgtggtcttgggttctcaggagggggctatgcacactgccctcaccggcgcaacggaaatccaaacctccggaacaactaccatcttcgccggccatctgaagtgccgtttaaaaatgaacaagctgacactaaaagggatgagctatgtgatgtgtactggatcgttcaagctcgagaaggaagtcgctgagacccagcacggtacggtgctggttcagattaaatacgagggcacagatgcgccttgcaagataccattttctacccaggacgaaaaaggggtgactcaaaatggacgccttatcacagcaaaccccattgtaaccgataaggagaaacctgtcaatatcgaagccgagccacccttcggcgagtcctatatagtgattggtgctggggaaaaggccttgaagctgtcatggtttaaaaagggcagtagcatcggaaaaatgttcgaggcaactgccagaggcgctaggcggatggccatcctcggggacaccgcatgggattttggatccattggtggcgttttcacatctgtggggaagctggtccatcagatctttggaacggcgtacggcgtgcttttcagcggtgtatcatggaccatgaaaattgggataggcgtgctgttgacttggctcggactgaacagtcgatccactagcttatctatgacctgtatcgctgttggcctggtcacactatacctcggggtgatggtgcaggccgactcaggatgcgtcattaattggaagggccgcgaactgaagtgtggtagtgggatctttgttactaacgaggtgcacacctggacggaacagtataaattccaagcagatagcccgaagagactttccgccgctatcggaaaagcctgggaggagggcgtgtgcggtattaggtctgcaacacggttggaaaacataatgtggaagcagatctcgaatgagctgaaccatattctcctggaaaatgacatgaaatttaccgtagtcgtgggcgacgttgctgggatcttagcccagggaaagaaaatgattcgccctcagcccatggagtacaagtatagctggaagtcctggggcaaagcgaagatcataggggccgatgtgcaaaacactaccttcatcattgacggaccaaatacacctgaatgtcccgatgaccagagagcttggaacatctgggaggtcgaggattacggctttggtattttcactaccaatatctggctgaaccttagggactcatatacacaggtgtgcgatcaccgtttgatgagtgcagccataaaagactctaaggctgttcacgccgatatggggtactggattgaaagcgagaaaaatgaaacgtggaagctcgcacgggcgtccttcatcgaggtgaagacctgtatttggccaaaatcacatactctgtggagcaacggagtactagaatctgagatgatcatacccaagatctatggcggtcctatttcccagcacaattaccgaccaggctactttacacaaaccgccgggccgtggcatctgggaaaactcgagctggacttcgatctttgcgaaggcactacagtcgtggtggacgagcactgcgggaacagaggacccagtttgaggaccacgactgtcaccggcaagatcattcacgaatggtgttgccgcagctgtacactgcctccattacggtttaaaggtgaggatgggtgctggtatggaatggagatcagacccgttaaggaaaaggaggaaaatctcgtgaaatctatggtatccgctggctcaggtgaggtggacagtttcagcctgggccttctgtgtatatcgattatgatcgaagaggtcatgaggtcccgctggtctcgaaagatgttgatgaccgggactctcgccgtgtttttcctgctaatcatgggacagctgacatggaacgacctcattcggctgtgcatcatggttggcgcaaatgctagcgatcgtatggggatgggaaccacataccttgccttgatggcaacttttaaaatgagacctatgttcgccgtgggcctgttatttaggcgcctcacctcacgggaggtcctgcttctgacgattggtctaagtctcgtggcttccgttgaactgccaaactctttggaggaactgggggacggattagcgatgggcataatgatcctcaagctgcttacagatttccagagccatcaactgtgggccaccttgctctccctgacttttattaaaaccacattctcactacactatgcatggaagactatggctatggtgctgagcatcgtcagtctttttcccctctgtctgtctaccacgtcccagaagacaacctggttgccggtactgttaggcagcctcgggtgcaaacctctgactatgttccttattgccgagaacaagatctggggaagaaaatcgtggccactgaatgaaggtataatggccgtgggcatcgtttcaattttgctctctagtctgctaaagaacgacgtgcccctggctgggcctcttatcgcaggaggcatgctcattgcctgttacgtcatctccggtagctctgcggatctgagcttggagaaagctgccgaggtgtcctgggaagaggaagcagagcattcaggggccagtcacaatatattagtagaagtgcaggacgatggaacaatgaagattaaagacgaggagagggatgacaccctgactatcctcctgaaggctacacttctggcagtcagcggcgtttatcccttgtctatcccagccaccctattcgtgtggtacttttggcagaagaaaaagcaacgatccggcgtgctgtgggatacgccttcacccccagaagtcgagcgcgcggtgctcgacgatgggatttatcggataatgcagagaggactgcttggtaggagtcaggttggcgtaggggtgttccaggaaaacgtctttcatactatgtggcacgtgacccgtggagctgttttaatgtaccaaggcaaacgcctggagccgagctgggcctccgtgaagaaagacctcatctcttacggtgggggatggcggttgcagggctcgtggaatacaggcgaggaagtccaggtgattgcagtagagcctgggaagaaccccaagaatgtccagaccgccccaggaacattcaaaactagcgaaggtgaggtgggcgctatcgccctggactttaagcccgggacctcaggatcccctattgttaacagagaaggcaaaatcgtgggtctctatgggaatggagtcgtgacgacaagtggcacttacgtttctgcaatagctcaagccaaggcgagccaggagggcccactgcccgagatcgaagatgaggtgttcaggaaacgaaaccttaccattatggacctgcaccctgggtccggaaagacacggcgctatttgccggccatcgtcagagaagcaattaagaggaaactacggaccctgatcctcgctccaactcgagtggtagcctcagagatggctgaagcattaaagggtatgcccataagataccagaccacagccgtgaaatctgagcatacgggcaaggagattgttgatctgatgtgccacgccacttttaccatgcgccttctgagccctgtcagggtgccaaattataacatgatcatcatggacgaagctcatttcacagatcccagttccattgcggcacgtgggtacatcagcacccgggtgggaatgggcgaggccgctgccatatttatgactgcaacacctccgggttctgtcgaagccttcccccaatcaaatgctattatccaggacgaggaaagagatattccagagaggtcctggaacagtgggtatgagtggatcaccgactttcctggaaaaacggtatggttcgtgcccagcataaagtcgggcaatgatattgcgaactgtctccgcaagaacggcaaacgagttatccagttgtctagaaagactttcgacacagaataccagaaaaccaagaataacgattgggactacgtggtcaccactgacatctccgagatgggggccaattttcgggcagatagggtgattgacccacgccgttgcctgaaacctgttatcctcaaggatggacccgaaagagtgattctggctggtccaatgccggtcacagtggccagcgcagcccaacggaggggccgcatagggcgaaaccacaataaggagggagaccagtatatctacatgggccagcctcttaacaatgatgaggaccatgctcactggaccgaagccaaaatgctactggataacattaatacacccgagggtatcatcccagcgttgttcgaacccgagagagaaaagtcagcagccattgacggggagtatcggttaaggggcgaggctcgcaaaacttttgtagaactgatgagaaggggagatctccctgtgtggctgagttacaaggttgcctctgagggcttccagtattccgaccggcgttggtgctttgatggggaacgcaacaatcaagtccttgaggaaaacatggacgtggagatatggacgaaagagggagaacgaaagaaactgagaccaaggtggctcgatgctcggacctacagcgaccccttggcactgcgcgagttcaaggaatttgccgctggtagaaggtcagtgagtggcgacctaatcctggagattgggaagctccctcagcaccttacacagcgggcccagaatgcactggataacttagtcatgttgcataatagcgaacaaggaggccgagcgtatagacacgccatggaggagctgccggacactatcgaaaccctcatgctgcttgctctgattgccgttctcacaggtggggtgaccttgttctttctgtccggccgcggattaggcaaaacttctatcgggctactgtgtgtaatggcaagctccgtgctcctttggatggcttcagtcgagccacattggatagccgcatctatcattctggagttctttttgatggtgctgctcatccccgagcctgataggcagcggacgccccaggacaaccagctggcctacgttgtgattggacttctcttcatgatcctgaccgtcgctgcgaacgagatgggtttgctggaaacaactaagaaagatttaggcatagggcacgtagccgtggagaatcaccatcacgcagctatgctagacgttgatctgcatccagccagtgcctggaccctctacgcagtggctacaaccattatcactcctatgatgcgtcacacaattgaaaacacgaccgccaatatctcgcttactgcgatagctaaccaagccgcaatcctgatgggattggacaagggctggcccattagcaaaatggatatcggtgtcccactgctcgccctggggtgctattcccaggtgaatcctcttacattaaccgctgcagtcctgatgctcgtggcccattacgcgattatcggcccgggattgcaggctaaggccaccagagaggcacaaaagaggacagccgctggcataatgaaaaaccccactgttgacgggattgtggccatcgatctggacccagtagtgtatgatgcaaagtttgaaaaacagctaggacagatcatgctgctcattctttgtacgtctcagatcctgttgatgcgcaccacatgggctctgtgcgagtcaataactctcgccaccggccctctgacaaccttatgggagggtagccccgggaagttctggaatactacgattgcggtctccatggccaacatcttccggggaagttaccttgcaggcgctggtctggccttttctctcatgaaaagcctaggcgggggacgaagaggcacaggggcacaaggagaaaccctgggcgagaagtggaagaggcagttgaatcagctgtcaaaatccgagttcaacacttataagcgcagtggtattatggaggttgaccggagcgaagctaaagaggggctcaagagaggagagaccacaaaacacgccgtgtctcgtggcactgccaaacttaggtggtttgtcgaacggaatctggtgaagccagagggtaaagtaatcgacttgggctgtgggcgcggaggctggtcctactattgcgcggggctgaagaaagtgaccgaagttaagggatacacaaaaggcggtcctgggcacgaggaacccataccgatggctacgtacggatggaacctcgtgaagttacattcaggcaaagatgtcttctttatcccacctgagaagtgtgacaccctgctttgcgatattggcgagagctcgcccaatccaactatcgaagaggggcgaacactgagagtgctaaagatggtcgaaccctggctcaggggaaaccagttctgtattaaaatcctgaatccttatatgccgtctgtggttgagaccttggagcaaatgcagcggaagcacggtggcatgctggtacgcaaccccctcagtagaaattccactcatgaaatgtactgggtgagctgcgggacaggaaacattgtctcagcagtgaacatgacctccaggatgcttctgaatcgatttacgatggcccaccggaaaccaacctatgagcgtgacgttgatttaggcgctggtacaagacacgtggccgtcgaacctgaggtgcccaacctggacatcatagggcagcgcattgaaaatatcaagcatgagcacaaatctacttggcattacgatgaggacaacccttataagacctgggcataccacggaagctatgaagtaaagccaagtggctccgccagctctatggtgaatggcgttgtcaaattgctcacaaagccctgggatgtgatccctatggtgactcagattgctatgaccgacacaaccccattcgggcaacagagggtctttaaagagaaggttgatactcggacgcccaaagcgaagagaggaacagcccagataatggaagtgaccgcaaagtggctgtggggtttcctatcacgcaacaaaaagccgaggatctgtactcgagaggaatttacccggaaagtaagaagtaatgctgccattggcgcagtgttcgtcgacgagaaccaatggaactccgccaaggaggctgtggaagacgagaggttttgggatcttgttcatcgcgaacgtgagctgcacaaacaggggaagtgcgccacatgcgtgtacaacatgatgggaaagcgggagaagaagctcggcgagttcggtaaagcgaaggggagcagagcaatctggtacatgtggctgggagccaggttcttggagtttgaagctctgggcttcatgaatgaggaccactggttttctcgcgaaaactcgctctcaggcgtcgagggggagggacttcataaactgggttatattttacgagatatcagcaagatacctggcgggaatatgtacgccgacgatacggcaggatgggacacccggatcactgaagatgacctgcagaacgaggctaaaattacagatatcatggaaccagagcacgccttgctcgctaagtccattttcaagctgacctatcagaataaagtggtaagagttcaaaggcccgccaagaacggcactgtgatggacgtcatcagtcgcagagatcagcggggttctggacaggtgggaacatacggcctaaacacctttacaaatatggaagcacagcttataaggcaaatggagagcgagggcattttctccccttcagaactggagactccaaacctcgcggggcgtgtgctggactggttggaaaaacatggagtcgagcgattaaagcgcatggccatcagtggtgatgactgtgttgtgaaacccatcgacgatagatttgctaccgccctgacggcactcaatgacatgggcaaggtacggaaggatgtgccgcagtgggaaccttctaaagggtggaacgactggcagcaggtccccttctgcagccaccactttcatcaacttattatgaaggatggaagggagatagtggttccatgtcgcaatcaggacgagctggtgggcagagctcgggtctcccagggtgccgggtggtcactaagggaaaccgcatgcctgggaaaaagctatgcccagatgtggcaactcatgtacttccaccgacgtgatttgagactggcggctaacgccatctgttctgcagtgcctgtagactgggttcccacatcccgcactacctggagtattcatgcccaccatcagtggatgacaactgaggatatgcttagcgtgtggaatcgggtctggatcgaagagaacccatggatggaagacaagacccacatttcgtcctggggcgatgtgccctatctgggcaaaagggaggaccagtggtgcgggtctctcatcggattaacggctagagccacatgggcaaccaatatacaagttgctatcaaccaggtgcgccggctgattggtaatgagaactacttggactacatgacttcaatgaagaggtttaagaatgaaagcgatcctgagggcgccctgtggtga

SEQ ID NO: 13683 - RNA, 9879 nt, synthetic construct
  misc_feature 1..9879: note = derived and/or modified CDS sequence (opt3) from DENV-1__FJ410245__SS-prME
  source 1..9879: mol_type = other RNA
agcgtgacaatgctgctcatgcttatgcccacggccctggctttccacttgactacgagaggaggggaacctcatatgatagtctccaagcaggaaaggggaaaatctttactgtttaagacctcagccggtgttaacatgtgcacactaattgccatggacctcggcgaactgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaggacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctacaaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccgggagcttcaaactggagaaggaagtcgccgagacgcagcacggtacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattgtgatcggtgccggggaaaaagctctgaagctctcctggttcaagaaaggctcaagtatcggaaagatgtttgaggccaccgcaagaggcgccaggcggatggctattctgggggatacagcctgggacttcggaagcatcggtggcgtttttacgtccgtggggaaacttgtccatcagattttcggaaccgcatacggcgtgctgttttctggtgtaagctggactatgaagatagggatcggcgtgttgctcacatggctgggattaaattcacgaagtacctccctgagcatgacatgtattgcggttggcctagtcactctctacctgggggtgatggtgcaggctgattctggatgcgtcatcaactggaaaggccgcgaacttaagtgtggttcagggatcttcgttaccaatgaggtgcacacgtggacagaacaatataagtttcaggccgacagtccgaaaagattgagcgcagccattggaaaggcttgggaggagggcgtgtgcggtataaggtccgccacccggctggaaaacatcatgtggaaacagatttctaacgagctcaatcatatcctgttagaaaacgacatgaagttcactgtagtcgtgggcgatgttgcagggattctggctcagggcaagaagatgatccgccctcaacccatggagtacaaatattcgtggaaaagctggggcaaggccaagataatcggggcggacgtgcagaataccacatttattatcgatggaccaaacactcctgaatgtcccgacgatcagagagcctggaatatttgggaggtcgaggactacggcttcggtatctttaccacaaacatatggcttaagttgagggattcctatacacaggtgtgcgaccaccgtctcatgtcagctgcaattaaagatagtaaggccgttcacgctgacatggggtactggatcgaatctgagaaaaatgaaacctggaagctggcccgggcatccttcattgaggtgaagacttgtatctggccaaaatcccatacactatggtcaaacggagtactggaaagcgagatgataatccccaagatttatggcggtcctatctctcaacacaattaccgaccaggctacttcacccaggcggccgggccgtggcatctcggaaaactggagcttgattttgacttgtgcgaaggcactacagtcgtggtggatgagcactgcgggaacagaggaccctccctgaggaccacgactgtcaccggcaagattatccacgaatggtgttgccgcagttgtacattacctccactccggttcaaaggtgaggacgggtgctggtatggaatggagataagacccgttaaggaaaaggaggaaaatctggtgaaaagcatggtatctgctggctccggtgaggtggactcatttagtcttggcctgttgtgtattagcatcatgatcgaagaggtcatgaggtcgcgctggtcccgacggatgctcatgaccgggactctggccgtgttctttctactgattatgggacagctcacatggaacgatctgatccgtctttgcattatggttggcgcaaatgcttctgacagaatggggatgggaaccacatacttggccctgatggcaactttcaagatgaggcctatgtttgccgtgggcttactcttccgccggctgaccagcagagaggtccttctgctaacgataggtctctcactggtggctagtgttgaattgccaaactccctggaggaattaggggatggactcgcgatgggcatcatgattctgaaacttctgacagactttcaatctcatcagttgtgggccaccctcctgagcctaactttcatcaagaccacattttccctgcactatgcatggaaaactatggctatggtgctttcaattgtcagcctcttccccctgtgtttgagtaccacgtctcagaagacaacctggctgccggtattactcggctccctggggtgcaagcctcttactatgtttctgatcgccgagaataaaatatggggaaggcgaagctggccattgaacgaaggtatcatggccgtgggcattgtttcgatcctcctgtcatctctactgaagaacgatgtgccccttgctgggcctctcattgcaggaggcatgctgatcgcctgttacgtcataagtggttccagcgcggacttgtctttagagaaagctgccgaggtgagctgggaagaggaagcagagcattccggggcctcacacaatattctggtagaagtgcaggatgacggaacaatgaagatcaaagatgaggagcgcgacgataccctcactatcctgcttaaggctacactgttggcagtcagtggcgtttatcccctaagcattccagccaccctgttcgtgtggtacttctggcagaaaaagaagcagcggtctggcgtgctctgggacacgccttcacccccagaagtcgagagagcggtgctggatgacgggatatataggatcatgcagcgtggacttttaggtcgcagccaggttggcgtaggggtgtttcaagaaaacgtcttccatactatgtggcacgtgacccggggagctgttctgatgtaccagggcaaaagactcgagccgagttgggccagcgtgaagaaagacttgatttcctacggtgggggatggaggctgcagggctcttggaatatcggcgaggaagtccaggtgattgcagtagagcctgggaagaaccccaaaaatgtccaaacagccccaggaacctttaagacacccgaaggtgaggtgggcgctatcgccctcgatttcaagcctgggacttcgggaagcccaatagttaaccgagaaggcaaaatcgtgggtctgtatgggaatggagtcgtgaccacgtcaggcacatacgtttccgcaattgctcaggccaaggcgagtcaggagggcccccttcctgagatcgaagacgaggtgtttcggaaacgcaacctgactattatggatttgcacccggggtctggaaagaccagaaggtatctaccagccatcgtccgggaagcaatcaaaaagaagctgcgaacactcattttagctcccaccagagtggtagccagcgagatggctgaagcactgaaaggtatgcctatccgctaccaaactaccgccgtgaagtccgagcatacaggcaaagagatcgttgaccttatgtgccacgccacgttcactatgaggctgctctcaccagtccgtgtgcccaattataacatgattatcatggatgaagctcattttaccgacccttctagcatagcggcacgggggtacattagtacaagagtgggaatgggcgaggccgctgccatcttcatgaccgcaactccgcccggttccgtcgaagcctttccacagagcaatgctgtaattcaggatgaggaaagggacatccctgagcgctcttggaactcagggtatgagtggataacagatttccccggaaagaccgtgtggtttgttccatccattaaaagtggcaatgacatcgcgaactgtttgcgaaagaatggcaagagagtgatccagctgagccggaaaacgttcgatactgaataccaaaagaccaaaaataacgactgggactacgtcgtgaccaccgatatttcggagatgggggccaatttcagggcagaccgcgttatcgatcctcgtagatgcctcaagcccgtgattctgaaagacggaccagaacgggtcatacttgctggtccgatgcctgtgactgtagcctctgcagcccagaggcgcggccgaatcgggagaaaccacaataaggagggagatcagtatatttacatgggccagcccctaaacaatgacgaggatcatgctcactggacagaagccaagatgctgttggacaacatcaataccccagagggtatcattcccgcgttatttgaacctgagcgggaaaaatccgcagccatagatggggagtataggctgcgcggcgaggctagaaagacattcgtggaactcatgaggcggggagacctgccagtttggcttagctacaaagtcgcctcagagggctttcaatatagtgatcgtcgctggtgcttcgacggggaacgaaacaatcaggtgctggaggaaaacatggatgtggagatctggactaaggagggagaaaggaaaaagctcaggccccggtggttggacgctcgcacgtactctgaccctctggcactaagagagtttaaagagttcgccgctggtaggcggtccgtcagcggcgatctgattctcgagatcgggaaacttccgcagcacctgacccagcgagcccaaaatgcattagacaacttggttatgctgcataattcagaacagggaggcagagcgtatcgccacgccatggaggagctcccagatacaattgaaactctgatgcttctggctctcatcgccgtgttgaccggtggggtaacactgtttttcttaagtggcaggggactaggcaagaccagcatagggctgctctgtgtgatggcatcctctgtccttctgtggatggctagcgtggagccccattggatcgccgcatccattatcttggaatttttcctgatggttctcctgattcctgagcccgaccggcagcgtactccacaggataaccaacttgcctacgtggtcatcggactcctgtttatgatattgacggtagctgcgaatgagatgggtctgttagaaaccaccaaaaaggacctaggcattgggcacgtggccgttgagaaccaccatcacgcagctatgctggatgtggacctccatcctgcctcagcctggactctttacgcagtcgctaccacaatcattacccccatgatgagacacactatcgaaaacacaacggccaatatatctctgaccgcgatcgctaaccaggccgcaattttgatgggactggataaaggctggccaatcagtaagatggacattggtgtgcctctcctggcccttgggtgctattcgcaggtcaatccgttaactctgacagctgcagtgctcatgttggttgcccattacgcgatcataggccccggactgcaagctaaagccaccagggaggcacagaagcgcaccgccgctggcattatgaagaacccaacagtggatgggatcgtagccatcgacctagatcctgtggtctatgacgcaaaattcgaaaagcagctgggacagattatgctccttatcctgtgtactagccaaatattgctgatgcggacgacctgggctctctgcgagtccattacactggccactggccccttaaccacactttgggagggttctccagggaaattttggaataccactatcgcggtttcaatggccaacattttccgaggaagctacctggcaggcgctggtctcgccttctccctaatgaagagtctgggcgggggaagaaggggcacgggggcacagggagaaacattgggcgagaaatggaagcgccagctgaatcagctctctaagagcgaatttaacacctataaacggtcaggtatcatggaggtggacagatccgaagctaaggaggggcttaaacgtggagagactaccaagcacgccgtcagtaggggcacagccaaactgcggtggttcgtggaacgcaatttggtaaagcctgagggtaaggtgatagatctgggctgtgggcgaggaggctggagctactattgcgcggggctcaaaaaggttactgaagtgaaaggatacaccaagggcggtcccgggcacgaggaaccgatcccaatggctacatacggatggaacttagtcaaactgcattctggcaaggacgtgtttttcattcctcccgagaaatgtgatacgcttctgtgcgacatcggcgagtcctcaccaaatcccaccattgaagaggggagaactctaagggtcctcaagatggtggaaccttggctgcggggaaaccaattttgtatcaagattttgaatccgtatatgcccagcgttgtagagacactggagcagatgcagcgcaaacacggtggcatgctcgtgagaaacccactttcgagaaattctacccatgaaatgtactgggtcagttgcgggactggaaacatcgtgtccgcagttaatatgacaagccgaatgctgttaaaccggttcaccatggcccaccgtaagcctacgtatgagagagatgtggacctgggcgctggtacccgccacgtcgccgtggaacccgaggtagcaaacttggatataattgggcagaggatcgaaaatatcaaacatgagcacaagtcaacatggcattacgacgaggataacccttataaaacttgggcctaccacggatcctatgaagtgaagccatctggcagcgctagttccatggttaatggcgtcgtgaagctcctgaccaaaccctgggacgtgattcctatggtcacacaaatagcgatgactgataccacaccatttgggcagcagcgggttttcaaggagaaagtggacaccagaactcccaaggccaaacgcggaacggcacaaatcatggaagtaacagctaagtggctatggggttttcttagcaggaacaagaaaccgcgaatttgtacccgggaggagttcactagaaaggtgaggtctaatgccgcaatcggcgccgtctttgtggacgagaaccagtggaactcagctaaagaggccgttgaagatgagcgcttctgggacctggtgcatcgtgaacgggagctccacaagcaggggaaatgcgcgacctgcgtctacaacatgatgggaaagagagaaaagaaactgggcgagtttggtaaggcaaaagggagtagggccatttggtacatgtggttgggagctcgcttcctggagttcgaagccctcggctttatgaatgaggatcactggttctcccgagaaaacagcctttctggcgtggagggggagggactgcataagttaggttatatcctgcgggacatatcgaaaatccctggcgggaatatgtacgcagatgacacagctggatgggatacgagaattaccgaagacgatttgcagaacgaggccaggatcactgacattatggaaccagagcacgctctcctggccaagtcaatctttaaactaacatatcaaaataaggtagttcgcgtgcagagacccgcaaagaacggcaccgtcatggatgtgataagccggagggaccagcgtggttccggacaggtgggaacttacggccttaatacattcaccaacatggaagcgcaactgattcgacagatggagagtgagggcatcttttctcctagcgaactcgagacaccaaacctggccgaacgcgtcttggattggttagagaaatatggggttgaaagactgaagcggatggctatctccggagacgactgtgtggtaaaacccattgatgacaggttcgccactgcactcaccgctcttaatgatatgggtaaggtgcgcaaagacataccgcagtgggagccttcaaagggctggaacgattggcagcaagtccccttttgcagtcatcacttccaccagctgatcatgaaggacgggagagagattgtggttccatgtcggaatcaggatgagctagtgggaagggcccgagtctctcagggcgcaggttggagcctgcgtgagacggcctgcctcgggaaatcctacgcgcaaatgtggcagttgatgtattttcatagacgcgacctgcggcttgctgccaacgcaatctgttcagccgtgcctgtagattggattcccaccagcaggacaacttggtctatccacgctcatcaccagtggatgaccacagaagacatgctgtccgtttggaatagagtgtggatagaggaaaacccatggatggaggataagactcatatcagtagctggggagacgtcccctacctcggcaaacgcgaggaccaatggtgcggctcgttaattgggctgaccgcccgggcaacgtgggctacaaatatccaggtggccattaaccaggttaggcgattgatcggaaatgaaaactacctggattatatgacctccatgaagagattcaaaaatgagtctgaccctgaaggtgcgctctggtga

SEQ ID NO: 13684 - RNA, 9879 nt, synthetic construct
  misc_feature 1..9879: note = derived and/or modified CDS sequence (opt3) from DENV-1__FJ410246__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagttctgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagagcaggacgcaaactttgtttgccgccgaacattcgtggatagaggctggggtaatgggtgtggactgtttggcaaaggctccttgataacttgcgctaagttcaagtgcgtaaccaaactcgaggggaagattgtgcagtacgaaaacctgaaatattcagtcatcgtgacagttcacaccggagaccagcatcaagtgggtaatgagagtactgaacacggcacgacagccaccattactccccaggcgcctagcaccgagatccagttaacagactacggggccctgaccctcgattgttctccaaggactggacttgactttaacgaaatggtcctgttgacaatgaaggagaaatcctggctagtgcataagcagtggttcctggatctcccgctgccctggacgtcaggcgcaagcaccagtcaagagacttggaatcggcaggaccttctggtaacatttaaaaccgctcacgccaagaagcaggaagttgtggtcttgggttctcaagagggggctatgcacacagccctcactggcgcaaccgaaatccagacgtccggaaccacaactattttcgccggccatctgaaatgccgtttaaagatggataaactgaccctaaaggggatgagctatgtgatgtgtacaggatcgttcaaactcgagaaggaagtcgctgagactcagcacggtaccgtgctggttcagataaagtacgagggcacggacgcgccttgcaaaatcccattttctacacaagatgaaaagggggtgacccagaacggacgccttattactgcaaatcccatcgtaacagacaaagataagcctgtcaacatagaggccgaaccacccttcggcgagtcctatattgtgatcggtgctggggagaaagccttgaagctgtcatggtttaagaaaggcagtagcatcggaaagatgttcgaagcaaccgccagaggcgctaggcggatggccattctcggggacactgcatgggattttggatccatcggtggcgttttcacctctgtggggaaactggtccatcagatttttggaacagcgtacggcgtgcttttcagcggtgtatcatggacgatgaagatagggatcggcgtgctgttgacctggctcggactgaatagtcgatccactagcttatctatgacatgtattgctgttggcctggtcaccctatacctcggggtgatggtgcaggccgactcaggatgcgtcatcaactggaaaggccgcgagctgaagtgtggtagtgggatctttgttacaaatgaagtgcacacttggaccgagcaatataagttccaggcagacagcccgaaaagactttccgccgctattggaaaggcctgggaagagggcgtgtgcggtataaggtctgcaacgcggttggagaacatcatgtggaaacagatttcgaacgaactgaatcatatcctcctggagaacgatatgaagtttacagtagtcgtgggcgacgttgctgggattttagcccagggaaaaaagatgatccgccctcaacccatggaatacaaatatagctggaagtcctggggcaaggcgaaaataatcggggccgatgtgcagaataccactttcattatcgacggaccaaacacccctgagtgtcccgatgaccagagagcttggaatatttgggaagtcgaggattacggctttggtatcttcacaactaacatatggctgaagcttagggactcatatacccaggtgtgcgatcaccgtttgatgagtgcagccattaaagactctaaggctgttcacgccgatatggggtactggatcgagagcgaaaaaaatgagacatggaagctcgcacgggcgtccttcattgaagtgaagacgtgtatctggccaaaatcacataccctgtggagcaacggagtactagagtctgaaatgataatccccaagatttatggcggtcctatctcccaacacaattaccgaccaggctactttactcagacagccgggccgtggcatctgggaaaactcgagctggacttcgatctttgcgagggcaccactgtcgtggtggacgaacactgcgggaacagaggacccagtttgaggacaaccacggtcactggcaagattatccacgagtggtgttgccgcagctgtaccctgcctccattacggtttaaaggtgaagacgggtgctggtatggaatggagataagacccgttaaggagaaggaagagaatctcgtgaaatctatggtatccgctggctcaggtgaagtggatagtttcagcctgggccttctgtgtatttcgatcatgacagaggaagtcatgaggtcccgctggtctcgaaagatgttgatgaccgggactctcgccgtgtttttcctgctaatcatgggacagctgacatggaacgacctcattcggctgtgcatcatggttggcgcaaatgctagcgatcgtatggggatgggaaccacataccttgccttgatggcaacttttaaaatgagacctatgttcgccgtgggcctgttatttaggcgcctcacctcacgggaggtcctgcttctgacgattggtctaagtctcgtggcttccgttgagctgccaaactctttggaagagctgggggacggattagcgatgggcataatgatcctcaagctgcttacagatttccaaagccatcagctgtgggccaccttgctctccctgacttttattaaaaccacattctcactacactatgcatggaagactatggctatggtgctgagcatcgtcagtctttttcccctctgtctgtctaccacgtcccagaagacaacctggttgccggtactgttaggcagcctcgggtgcaaacctctgactatgttccttattgccgaaaataagatctggggaagaaaatcgtggccactgaacgagggtataatggccgtgggcatcgtttcaattttgctctctagtctgctaaagaacgacgtgcccctggctgggcctcttatcgcaggaggcatgctcattgcctgttacgtcatctccggtagctctgcggatctgagcttggaaaaagctgccgaggtgtcctgggaggaagaggcagaacattcaggggccagtcacaatatattagtagaggtgcaggacgatggaacaatgaagattaaagacgaagagagggatgacaccctgactatcctcctgaaggctacacttctggcagtcagcggcgtttatcccttgtctatcccagccaccctattcgtgtggtacttttggcaaaagaaaaagcagcgatccggcgtgctgtgggatacgccttcacccccagaggtcgaacgcgcggtgctcgacgacgggatttatcggataatgcagagaggactgcttggtaggagtcaggttggcgtaggggtgttccaagagaacgtctttcatactatgtggcacgtgacccgtggagctgttttaatgtaccagggcaaacgcctggaaccgagctgggcctccgtgaagaaagatctcatctcttacggtgggggatggcggttgcagggctcgtggaatacaggcgaggaggtccaggtgattgcagtagaacctgggaagaaccccaagaatgtccaaaccgccccaggaacattcaaaactagcgagggtgaagtgggcgctatcgccctggactttaagcccgggacctcaggatcccctattgttaacagagagggcaaaatcgtgggtctctatgggaatggagtcgtgacgacaagtggcacttacgtttctgcaatagctcaggccaaggcgagccaggaaggcccactgcccgagatcgaggatgaagtgttcaggaaacgaaaccttaccattatggacctgcaccctgggtccggaaagacacggcgctatttgccggccatcgtccatgaggcaattaagagaaaactaaggaccctgatcctcgctccaactcgggtggtagcctcagaaatggctgaggcattaaagggtatgcccatacgataccaaaccacagccgtgaaatctgaacacacgggcaaggagattgttgatctgatgtgccatgccacttttaccatgagacttctgagccctgtccgcgtgccaaattataacatgatcatcatggacgaggctcacttcacagatcccagttccattgcggcaagggggtacatcagcacccgtgtgggaatgggcgaagccgctgccatatttatgactgcaacacctccgggttctgtcgaggccttcccccagtcaaatgctgtaattcaggacgaagagcgggatatcccagaaagatcctggaacagtgggtatgagtggattaccgactttcctggaaaaacggtgtggttcgttcccagcatcaagtcgggcaatgatatagcgaactgtctcaggaagaatggcaaacgcgtgattcagttgtctcgaaagactttcgacacagagtaccaaaaaaccaagaacaacgactgggattacgtcgtgaccactgacatctccgaaatgggggccaattttagagcagatcgggttatcgacccaaggcgctgcctgaaacctgtgattctcaaggatggacccgagcgtgtcatcctggctggtccaatgccggtgacagtagccagcgcagcccagagacggggcaggattgggcgcaaccataataaggaaggagaccagtatgtgtacatgggccagcctcttaacaatgatgaggaccacgctcactggaccgaggccaaaatgctactggataacataaatacacccgaaggtatcattccagcgttgttcgagcccgaacgagagaagtcagcagccatcgacggggaatatagattacggggcgaggctaggaaaacttttgttgagctgatgcgcagaggagatctccctgtctggctgagttacaaggtggcctctgaaggcttccaatattccgacaggcggtggtgctttgatggggagcgtaacaatcaggtgcttgaagagaacatggacgtcgaaatctggacgaaagagggagagcgcaagaaactgcgaccaagatggctcgacgctaggacctacagcgatcccttggcactgcgggaattcaaggagtttgccgctggtcgcagatcagttagtggcgacctaattctggaaatagggaagctccctcagcatcttacacagagggcccaaaatgcactggataacttagtgatgttgcacaatagcgagcagggaggccgggcgtatcgacatgccatggaagagctgccggacactatcgagaccctcatgctgcttgctctgattgccgtactcacaggtggggtgaccttgttctttctgtccggcagaggattaggcaaaacttctatcgggctactgtgtgtcatggcaagctccgtgctcctttggatggcttcagttgaaccacactggattgccgcatctatcatactggagttctttttgatggtgctgctcatccccgaacctgatcgccagaggacgccccaggacaaccaactggcctacgtcgtaattggacttctcttcatgatcctgaccgtggctgcgaatgagatgggtttgctggagacaactaagaaagatttaggcattgggcacgttgccgtggaaaaccatcaccatgcagctatgctagacgtcgatctgcacccagccagtgcctggaccctctacgcagtggctacaaccatcataactcctatgatgcggcatacaattgagaacacgaccgccaatatctcgcttactgcgattgctaaccaggccgcaatcctgatgggattggacaagggctggcccataagcaaaatggatatcggtgtcccactgctcgccctggggtgctattcccaggtgaatcctcttacattaaccgctgcagttctgatgctcgtggcccactacgcgattatcggcccgggattgcaagctaaggccacccgtgaagcacagaagagaacagccgctggcattatgaaaaaccccactgtagacgggatcgtggccatagatctggacccagtcgtttatgacgcaaagtttgagaaacagctaggacagattatgctgctcatcctttgtacgtctcaaatcctgttgatgaggaccacatgggctctgtgcgaatcaattactctcgccaccggccctctgacaaccttatgggagggtagccccgggaagttctggaatactacgatcgcggtgtccatggccaacatattccgcggaagttaccttgcaggcgctggtctggccttttctctcatgaaaagcctaggcgggggacggcgaggcacaggggcacagggagagaccctgggcgaaaagtggaagagacagttgaatcagctgtcaaaatccgagttcaacacttataagaggagtggtattatggaagtcgatcgcagcgaggctaaagaagggctcaagcggggagagaccacaaaacacgccgtgtctagaggcactgccaagcttcgttggtttgtagagaggaatctggtgaagccagaaggtaaagttatcgacttgggctgtgggcggggaggctggtcctactattgcgcggggctgaagaaagtgaccgaggtcaagggatacacaaaaggcggtcctgggcatgaagagcccattccgatggctacgtacggatggaacctcgtgaagttacactcaggcaaagatgtcttctttatcccacctgaaaagtgtgacaccctgctttgcgatataggcgagagctcgcccaatccaactatcgaggaagggcgcacactgcgagtgctaaagatggttgagccctggctcagaggaaaccaattctgtattaaaatcctgaatccttatatgccgtctgtagtggaaaccttggagcagatgcagaggaagcatggtggcatgctggtccggaaccccctcagtcgcaattccactcacgagatgtactgggtgagctgcgggacaggaaacattgtttcagcagtgaatatgacctccagaatgcttctgaacaggtttacgatggcccaccgaaaaccaacctatgaacgggacgtcgatttaggcgctggtacacgtcatgtggccgtagagcctgaagtggcaaacctggacatcattgggcagagaatcgagaatataaagcacgaacataaatctacttggcactacgatgaggacaacccctataagacctgggcctaccatggaagctatgaggttaagcctagtggctccgctagctctatggtcaatggcgtggtgaaattgctcacaaagccatgggatgtcattcccatggttactcaaatcgcgatgaccgacacaacccctttcgggcagcagcgcgtgtttaaagaaaaggtagacactaggacgccaaaagccaagcggggaacagcacaaatcatggaggtgaccgctaagtggctgtggggtttcctatcaagaaacaaaaagccccgcatttgtactagggaagagtttacccgaaaagtccggagtaatgccgcaataggcgccgtgttcgttgatgaaaaccagtggaattccgctaaggaggccgtggaggacgaaagattttgggatcttgtccacagggagcgcgaactgcacaaacaggggaagtgcgcgacatgcgtgtacaacatgatgggaaagcgtgagaaaaagctcggcgaattcggtaaagcaaaggggagccgggccatctggtacatgtggctgggagctagattcttggagtttgaggccctgggcttcatgaatgaagaccattggttttctagggagaactcgctctcaggcgtagaaggggagggacttcacaaactgggttatattttacgcgatatcagcaagattccgggcgggaatatgtacgcagacgatacggctggatgggacacccgaatcactgaggatgacctgcagaacgaagccaaaataacagatatcatggagcctgaacatgctttgctcgccaagtccattttcaagctgacctatcaaaataaagttgtgcgggtccagagaccagcaaagaacggcactgtgatggacgtgatcagtaggcgcgatcagagaggttctgggcaggtcggaacatacggcctaaatacctttacaaacatggaggcgcaacttattcggcagatggaaagcgagggcatcttctccccctcagagctggaaactcctaacctcgccgggagggttctggactggttggagcgtcacggagtggaacgattaaaacgcatggctataagtggtgacgattgtgtagtgaagccaattgacgatagatttgccaccgcactgacggctctcaatgacatgggcaaagtccggaaggatatcccccagtgggagccgtctaaggggtggaacgactggcagcaagtgcctttctgcagccaccattttcaccagcttatcatgaaagatggaagggaaattgttgtgccctgtcgcaatcaggacgagctggtcggcagagcccgggtgtcccagggtgcagggtggtcactaagggagaccgcctgcctgggaaagagctatgcgcaaatgtggcagctcatgtacttccatcgacgtgatttgagactggctgccaacgcaatatgttctgccgtaccagttgactgggtgcctacatcccgcactacctggagtatccacgctcatcaccagtggatgacaactgaagatatgcttagcgtctggaatcgggtgtggattgaggaaaacccctggatggaggacaaaacccacatctcgtcctggggcgacgttccatatctgggcaagagggaagatcaatggtgcgggtctctcattggattaacggccagagcaacatgggctaccaatatccaggtggccataaaccaggtccgccggctgatcggtaatgagaactacttggactacatgacttcaatgaaaaggtttaagaatgagagcgatcccgaaggcgcgctgtggtga

SEQ ID NO: 13685 - RNA, 9879 nt, synthetic construct
  misc_feature 1..9879: note = derived and/or modified CDS sequence (opt3) from DENV-1__FJ410247__SS-prME
  source 1..9879: mol_type = other RNA
agcgtgaccatgctgctcatgcttatgcccaccgccctggctttccacttgactacgcggggaggggagcctcatatgatcgtctccaagcaggaaaggggaaaatctttactgtttaagacctcagccggtgttaatatgtgcacattgattgccatggacctcggcgagctgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcaattctgaggaaactttgcatcgaagccaagatatctaataccacaactgatagccggtgtccaacccaaggagaggctacactggtggaagaacaggacgccaacttcgtctgccgccgaacttttgttgatagaggctggggtaatgggtgtggattgttcggcaaaggctccctcattacctgcgcaaagtttaagtgcgtgacaaaactggaggggaagatcgtacagtacgaaaacttaaaatattcagtgattgtcaccgtgcacactggagaccagcatcaagttggtaatgagagtacggaacacggcacaaccgctactatcacaccccaggcccctacaaccgagatccagctgactgactacggggcgctcacacttgattgtagcccaaggacgggactggacttcaacgaaatggtgttgctaaccatgaaggagaaatcttggctggtccataagcagtggtttctcgatctgccgcttccctggacttccggcgcctcaacaagccaagagacctggaatcggcaggacctgttggtgacattcaaaactgcacacgctaagaagcaggaagtagttgtgctcggtagtcaagagggggccatgcacaccgctctgacgggcgccaccgaaattcagacatctggaactaccacaatatttgcaggccatttaaaatgccgtctgaagatggataaactaactctcaaggggatgtcctatgtcatgtgtaccggatcgttcaaactggagaaggaagtggccgagacgcagcacggtacagtccttgtgcagatcaagtacgagggcaccgacgctccttgcaaaattccattctcgactcaagatgaaaagggggttacacagaacggacgcttgatcaccgcgaatcccatagtgactgacaaagagaagcctgtaaacattgaagcagagccaccctttggcgagtcttatatcgtcatcggtgccggggaaaaagctctgaagctctcctggttcaagaaaggctcaagtattggaaagatgtttgaggccaccgcaagaggcgccaggcggatggctatcctgggggatacagcctgggacttcggaagcattggtggcgtgtttacgtccgttgggaaacttgtgcatcagatattcggaaccgcatacggcgtcctgttttctggtgtgagctggactatgaagatcgggattggcgtattgctcacatggctgggattaaattcacgaagtacctccctgagcatgacatgtatcgcggtgggcctagttactctctacctgggggtcatggtgcaggctgattctggatgcgtgatcaactggaaaggccgcgaacttaagtgtggttcagggattttcgtcaccaatgaggttcacacgtggacagaacaatataagtttcaggccgacagtccgaaaagattgagcgcagccataggaaaggcttgggaggagggcgtgtgcggtatcaggtccgccacccggctggaaaacattatgtggaaacagatctctaacgagctcaatcatattctgttagaaaacgacatgaagttcactgtggtagtcggcgatgtggcagggatcctggctcagggcaaaaagatgatacgccctcaacccatggagtacaaatattcgtggaaaagctggggcaaggccaagatcattggggcggacgttcagaataccacatttatcattgatggaccaaacactcctgaatgtcccgacgatcagagagcctggaatatctgggaggtggaggactacggcttcggtatatttaccacaaacatttggcttaagttgagggattcctatacgcaggtctgcgaccaccgtctcatgtcagctgcaatcaaagatagtaaggccgtgcacgctgacatggggtactggattgaatctgagaaaaatgaaacctggaagctggcccgggcatccttcatcgaggttaagacttgtatatggccaaaatcccatacactatggtcaaacggagtgctggaaagcgagatgatcattcccaagatctatggcggtcctatttctcaacacaattaccgaccaggctacttcacccagactgcggggccgtggcatctcggaaaactggagcttgattttgacttgtgcgaaggcacaaccgtagtcgtggatgagcactgcgggaacagaggaccctccctgaggacgactaccgtgacaggcaagatcatacacgaatggtgttgccgcagttgtaccttacctccactccggttcagaggtgaggacgggtgctggtatggaatggagattaggcccgtcaaagaaaaggaggaaaatctggttaagagcatggtgtctgccggctccggtgaggtagactcatttagtcttggcctgttgtgtatcagcatcatgattgaagaggtgatgcgctcgcgatggtcccggaaaatgctcatgactgggacactggctgtcttcctactgctcatcatgggacagctgacctggaacgatcttattcgtttgtgcataatggtgggcgccaatgcatctgacagaatggggatgggaacaacttacctggctttaatggccacctttaagatgaggcctatgttcgcagttggcctcctgtttcgccggcttacgagcagagaggtgctgctactcacaatcggtctgtcattggtcgccagtgtggaactgccaaactccttagaggaactcggggatggactggctatgggcattatgatccttaaactgttgaccgacttccaatctcatcagctctgggcgactctgctaagcctgacctttattaagacaactttctcccttcactatgcctggaaaaccatggcaatggttctctcaatcgtgagcctgtttcccttgtgtctgagtacgacatctcagaagaccacttggttaccggtcctcctgggctcccttgggtgcaagcctctgacaatgttcttgatagctgagaataggatctggggacgacgcagctggccactcaacgaaggtattatggccgtaggcatcgtgtcgattctgctatcatctctgcttaaaaacgatgttcccctcgccgggcctctgatcgctggaggcatgttgatagcatgttacgtgattagtggttccagcgccgacttatctctggagaaggcggctgaggtcagctgggaagaggaagccgagcattccggggcatcacacaatatcctcgtggaagtacaggatgacggaaccatgaaaatcaaggatgaggagcgggacgatactctgacaattcttctgaaagccaccttgctagctgtgagtggcgtctatcccctgagcataccagcaacgctctttgtttggtacttctggcaaaagaaaaagcagagatctggcgtgctgtgggacactccttcacccccagaagtggagagggccgtccttgatgacgggatctatcgtattatgcagcgcggattactgggtcggagccaggtgggcgttggggtattccaagaaaacgtgtttcataccatgtggcacgtcacaagaggagcggtgctcatgtaccagggcaagaggttggagccgagttgggctagcgttaaaaaggacctgatctcctacggtgggggatggcgactccagggctcttggaataccggcgaggaagtgcaggtcattgccgtggagcctgggaaaaaccccaagaatgtacaaacaactccaggaaccttcaaaacgcccgaaggtgaggtcggcgcaatcgccctggattttaagcctgggacatcgggaagcccaatagtgaaccgggaaggcaagatcgttggtctttatgggaatggagtggtcactacctcaggcacatacgtgtccgctattgcccaggcaaaagctagtcaggagggccccctgcctgagatcgaagacgaggttttccgcaagagaaacttgaccattatggatctacacccggggtctggaaaaactaggcggtatctgccagccatcgtgcgagaagcgataaagagaaaactccgcaccttaattctggcccccacaagggtcgtggcaagcgagatggctgaagcccttaagggtatgcctatccgttaccaaacgactgctgtaaagtccgagcataccggcaaagagatcgtggacctgatgtgccacgcaacatttaccatgcggctcttgtcaccagttagagtccccaattataacatgattatcatggatgaagcccatttcactgacccttctagcatagccgctagggggtacattagtacacgcgtgggaatgggcgaggcggcagccatctttatgaccgctacgccgcccggttccgtggaagccttcccacagagcaatgcagtcattcaggatgaggaacgagacatccctgagagatcttggaactcagggtatgagtggataactgattttcccggaaagacagtatggttcgtgccatccattaaaagtggcaatgacatcgccaactgtctgcggaagaatggcaaaagggttatccagctcagccgcaagacctttgataccgaataccaaaagactaaaaacaacgactgggactacgtggtcacaaccgatatttcggagatgggggctaatttccgtgcggacagagtgatcgatcctcggaggtgcctgaagcccgttattcttaaagacggaccagaacgcgtgatactagccggtccgatgcctgtcacagtggcatctgctgcccagcgaagaggccggatcgggaggaaccacaataaggagggagatcagtatatttacatgggccagcccctgaacaatgacgaggatcatgcacactggactgaagccaaaatgttgttagacaacatcaatacgccagagggtatcattcccgctctgttcgaacctgagcgcgaaaagtccgccgcgatagatggggagtatagactcaggggcgaggcacggaagacctttgtagaactgatgcgtcgcggagaccttccagtgtggctgagctacaaagttgcctcagagggcttccaatatagtgatcgaagatggtgctttgacggggaaaggaacaatcaggtcctcgaggaaaacatggatgtggagatctggacaaaggagggagaacggaaaaagttgcgccccagatggctggacgctaggacttactctgaccctctagccctgcgggagttcaaagaatttgctgcaggtcgaagatccgtgagcggcgatctcattcttgagatcgggaagctgccgcagcacttaacccagcgcgcccaaaatgctttggacaacctggtcatgctccataattcagaacagggaggcagggcctatcggcacgcaatggaggagctgccagatacaattgaaacccttatgctgctcgcgttgatcgccgttctgactggtggggtgacgttattctttctaagtggccgtggactgggcaaaaccagcatagggctcctttgtgtaatggcttcctctgtgctgttgtggatggccagcgtcgagccccattggatcgcagcttccattatcctggagttctttctcatggtgctgcttattcctgagcccgacagacagaggacaccacaggataaccaactcgcctacgttgtgatcggactgttgttcatgatactgactgtcgcagccaatgagatgggtttactagaaaccacaaagaaggacctgggcattgggcacgtagctgtgggaaaccaccatcacgcggccatgctcgatgttgaccttcatcctgcatcagcttggaccctgtacgccgtggccactacaatcattacgcccatgatgcgccacaccatcgagaacactacagcaaatatatctttgaccgctatcgccaaccaggcggctattctgatgggcctcgataaaggttggccaatcagtaagatggacattggggtccctctgcttgccttaggctgctatagccaggtgaatccgctgaccctcacagcagccgtcttgatgctggtggctcattacgcaatcataggacccggcctacaagccaaagcgactcgggaagctcagaagcgaacggccgcagggattatgaaaaacccaaccgttgatggaatcgtggccatcgacctggatcctgtagtgtatgacgctaagtttgagaagcagctcggccagattatgcttctgatcttgtgtacaagccaaatactgctcatgagaactacctgggccctgtgcgaatccattacattagcaaccggtccccttactacgctgtgggaggggtctccaggaaaattctggaatacaaccatcgctgtctcaatggccaacatttttaggggcagctacctcgcgggtgccggcctagcattctccctgatgaagagtctagggggaggccgccgggggactggagctcagggcgagaccctgggtgaaaaatggaagagacagctcaatcagctttctaaaagcgagttcaacacatataagcgttcagggatcatggaagttgacaggtccgaggccaaggaaggactgaaacggggcgagactaccaagcacgcagtgagtcgcggtacagctaaattgcgatggtttgtcgagagaaatctggtgaagcctgaaggcaaagtaatagatctcgggtgtggaaggggcgggtggagctactattgcgccggattaaagaaggtgacggaggttaaaggctacaccaagggtgggcccggacacgaagaaccgatcccaatggccacttacggctggaacctggtgaaacttcattctggcaaggacgtcttctttattcctcccgaaaaatgtgatacactgctatgcgacatcggggagtcctcaccaaatcccaccattgaggaaggacggactctccgcgtgctgaagatggtcgagccttggttgagaggtaaccaattctgtatcaaaattctgaatccgtatatgcccagcgtggttgaaacactcgagcagatgcagaggaagcacggcgggatgcttgtacgaaacccactgtcgagaaattctacccatgagatgtactgggtgagttgcggaacgggcaacatcgtctccgcggtgaatatgaccagccgtatgttactgaacagatttacaatggctcaccgcaagcctacttatgaaagggatgttgacttgggtgcagggacccggcacgtggccgtcgagcccgaagtggctaacctcgatataattggacagagaatcgagaatatcaaacatgaacacaagtcaacatggcattacgacgaggataacccttataaaacttgggcctaccacggctcctatgaggtaaagccatctggcagcgcaagttccatggtgaatggggttgtcaaactgctaaccaagccctgggacgtgattcctatggtgacacaaatagccatgaccgatactacgccattcggacagcagcgcgtctttaaggaaaaagttgacacaaggacccccaaggctaaacaaggtactgcgcagatcatggaggtgaccgccaagtggctttggggcttcctgagccgaaacaaaaagccgcggatttgtacaagagaagagtttacgaggaaggtacgctctaatgcagctatcggggccgtgttcgtcgacgaaaaccagtggaactcagcaaaagaggccgtggaggatgaacgtttttgggacctcgttcatcgggagagagaactgcacaagcagggaaaatgcgctacctgcgtgtacaacatgatgggcaagagggagaaaaagttgggtgagttcgggaaggccaaaggaagtcgcgcgatttggtacatgtggctgggcgcacgatttctcgagttcgaggcccttggcttcatgaatgaagatcactggttttcccgggagaacagcctgtctggggtcgaaggagagggtttacataagctgggctatatcttgagagacatatcgaaaatccctgggggaaatatgtacgctgatgacactgccggctgggatacaaggattaccgaggacgatctccaaaacgaagcacgcatcactgacattatggagccagaacacgctctgctagccaagtcaatcttcaaacttacatatcagaataaggtggtaagagttcagcggcccgctaaaaacggtaccgtgatggatgtcataagcaggcgtgaccagcgagggtccggacaagtgggcacatacggcctgaatacttttaccaacatggaggcccagctcattcgccagatggaaagtgaggggatcttctctcctagcgagctggaaacgccaaacttggcagagagagtgttagattggctggaaaagtatggagtcgagcggctcaagaggatggcgatctccggtgacgactgtgttgtgaaacccattgatgaccgctttgccaccgctcttacagccctgaatgatatgggcaaggtaagaaaagacataccgcagtgggaaccttcaaaggggtggaacgattggcaacaggtgcccttctgcagtcatcactttcaccagctaatcatgaaagacggacgggagattgtcgtgccatgtaggaatcaggatgagctggttggccgagcacgtgtgtctcaaggtgctgggtggagcctcagagaaactgcctgcttgggaaagtcctacgcacagatgtggcagctgatgtatttccatcgccgggaccttaggctggccgcgaacgctatctgttcagccgtccctgtggattggattcccaccagcagaacaacttggtctatccacgcacatcaccaatggatgaccacggaggacatgctctccgtatggaatcgcgtttggatagaagagaacccatggatggaagataagacacatatcagtagctggggcgacgtgccctacttaggcaaacgggaggaccagtggtgcgggtcgctgattggattgaccgccagggctacttgggccacaaatatccaggtcgcaattaaccaggtgcgaagactgatcggtaatgagaactacctcgattatatgacctccatgaagcggtttaaaaatgaatctgaccctgagggcgctctttggtga

SEQ ID NO: 13686 - RNA, 9879 nt, synthetic construct
  misc_feature 1..9879: note = derived and/or modified CDS sequence (opt3) from DENV-1__FJ410248__SS-prME
  source 1..9879: mol_type = other RNA
agcgtgaccatgctgctcatgcttatgcccacagcactggctttccacttgactacgagaggaggggagcctcatatgatcgtctccaagcaggaaaggggaaaatctttactgtttaagacctcagccggtgttaacatgtgcacactaattgcaatggacctcggcgagctgtgtgaagatactatgacctacaaatgcccacggattacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccgtgctgaggaaactttgcattgaagctaagatctctaatacgaccacagatagccggtgtccaactcaaggagaggccaccctggtcgaagaacaagacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctagcaccgagatccagctgacagactacggggccctcacccttgattgttctccaaggactggactggacttcaacgaaatggtcttgctaacaatgaaggagaaatcctggctggtgcataagcagtggtttctcgatctgccgcttccctggacgtcaggcgcaagcaccagtcaagagacttggaatcggcaggacctgttggtaacattcaaaaccgctcacgccaagaagcaggaagttgtggtcctcggttctcaagagggggctatgcacacagccctgactggcgcaaccgaaatccagacgtccggaaccacaactatttttgccggccatttaaaatgccgtctgaagatggataaactaaccctcaaggggatgagctatgtgatgtgtacaggatcgttcaaactggagaaggaagtcgctgagactcagcacggtaccgtgcttgttcagataaagtacgagggcacggacgcgccttgcaaaatcccattctctacacaagatgaaaagggggtgacccagaacggacgcttgattactgcaaatcccatcgtaacagacaaagagaagcctgtcaacatagaagccgagccaccctttggcgagtcctatattgtgatcggtgctggggaaaaagccctgaagctctcatggttcaagaaaggcagtagcatcggaaagatgtttgttgcaaccgccagaggcgctaggcggatggccattctgggggatactgcatgggacttcggatccatcggtggcgtgtttacctctgtcgggaaacttgtgcatcagattttcggaacagcgtacggcgtactgtttagcggtgtgtcatggacgatgaagatagggatcggcgttttgctcacctggctgggattaaatagtcgatccactagcctgtctatgacatgtattgctgtcggcctagtgaccctctacctgggggtgatggtccaggccgattcaggatgcgttatcaactggaaaggccgcgagcttaagtgtggtagtgggatcttcgtgacaaatgaagtgcacacttggaccgagcaatataagtttcaggcagacagcccgaaaagattgtccgccgctattggaaaggcctgggaagagggcgtatgcggtataaggtctgcaacgcggctggagaacatcatgtggaaacagatttcgaacgaactcaatcatatcctgttagagaacgacatgaagttcacagtcgtggttggcgatgtggctgggattctggcccagggcaagaaaatgatccgccctcaacccatggaatacaaatatagctggaagtcctggggcaaggcgaaaataatcggggccgacgtccagaataccacttttattatcgatggaccaaacacccctgagtgtcccgacgatcagagagcttggaatatttgggaagtggaggactacggcttcggtatctttacaactaacatatggcttaagttgagggattcatatacccaggtttgcgaccaccgtctcatgagtgcagccattaaagattctaaggctgtgcacgccgacatggggtactggatcgagagcgagaaaaatgagacatggaagctggcacgggcgtccttcattgaagtaaagacgtgtatctggccaaaatcacataccctatggagcaacggagtcctggagtctgaaatgataatccccaagatttatggcggtcctatctcccaacacaattaccgaccaggctacttcactcagacagccgggccgtggcatctcggaaaactggagcttgattttaacttgtgcgagggcaccactgtggtggtcgacgaacactgcgggaatagaggacccagtctgaggacaaccacggttactggcaagattatccacgagtggtgttgccgcagctgtaccttacctccactccggttcaaaggtgaagatgggtgctggtatggaatggagataagacccgtgaaggagaaggaagagaacctggtaaaatctatggtgtccgctggctcaggtgaagtcgacagttttagccttggcctgttgtgtatttcgatcatgatcgaggaagtgatgaggtcccgctggtctcgaaagatgctcatgacagggaccctggccgttttctttctactgattatgggacagctcacttggaatgacctgatccggctttgcattatggtgggcgcaaacgctagcgatcgtatggggatgggaacaacctacttggccctgatggcaacattcaaaatgagacctatgttagccgtcggcctcctgtttaggcgccttacttcacgggaggtgctgctactcaccataggtctgagtttggttgcttccgtggagctgccaaattctttagaagaactcggggacggactggcgatgggcatcatgattcttaagctgttgacggatttccaaagccatcagctctgggccacactgctatccctgacctttatcaaaactacctattcacttcactacgcatggaagacaatggctatggtcctcagcattgtaagtctgttccccttgtgtctgtctactacctcccagaagacgacatggttaccggtgctcctgggcagccttgggtgcaaacctctgaccatgtttttgatcgccgaaaacaagatatggggaagaaaatcgtggccactcaacgagggtatcatggccgttggcattgtgtcaatcctgctatctagtctgcttaagaatgacgtccccctcgctgggcctctgattgcaggaggcatgttgatcgcctgttatgtgatatccggtagctctgcggatttaagcctggaaaaagctgccgaggtatcctgggaggaagaggcagaacattcaggggccagtcacaacattctcgtggaggtccaggacgatggaactatgaagatcaaagacgaagagagggatgacacactgaccatccttctgaaggctactttgctagcagttagcggcgtgtaccccctgtctattccagccacactcttcgtgtggtatttttggcaaaagaaaaagcagcgatccggcgtcctgtgggataccccttcacccccagaggtggaacgcgcggttcttgacgatgggatataccggatcatgcagagaggattactgggtaggagtcaggtaggcgtgggggtcttccaagagaatgtgttccatacgatgtggcacgttactcgtggagctgtgctcatgtaccagggcaaacgcttggaaccgagctgggcctccgtcaagaaagacctgatttcttatggtgggggatggcggctccagggctcgtggaacaccggcgaggaggtgcaggtaatcgcagtcgaacctgggaagaatcccaagaacgtgcaaacagccccaggaacctttaaaacaagcgagggtgaagttggcgctattgccctggacttcaagcccgggacttcaggatcccctatcgtgaatagagagggcaaaatagtcggtctttacgggaacggagtggttaccacgagtggcacatatgtgtctgcaatcgctcaggccaaggcgagccaggaaggcccactgcccgagattgagaatgaagtctttaggaaacgaaacttgactatcatggatctacaccctgggtccggaaagacccggcgctacctgccggccattgtgagagaggcaatcaagaggaaactccggacattaatactggctccaacccgagtagtggcctcagaaatggctgaggcacttaagggtatgcccattagatatcaaactaccgccgttaaatctgaacatacaggcaaggagatcgtcgacctgatgtgccacgccacgttcactatgcgcctcttgagccctgtgagggtgccaaattacaacatgatcattatggatgaggctcattttaccgaccccagttccatcgcggcacgtgggtatataagcacacgggtcggaatgggcgaagccgctgccattttcatgaccgcaactcctccgggttctgtagaggcctttccccagtcaaatgctgtgatccaggatgaagagagagacattccagaaaggtcctggaacagtgggtacgagtggatcacagatttccctggaaaaaccgtttggtttgtgcccagcataaagtcgggcaatgacattgcgaactgtctgcgcaagaacggcaaacgagtcatccagctctctagaaagacgttcgatactgagtaccagaaaacaaagaataacgactgggattatgtggttaccaccgacatctccgaaatgggggccaattttcgggcagacagggtgattgatccacgccgttgcctgaaacctgtcatccttaaggacggacccgagagagtgattctagctggtccaatgccggtaactgtggccagcgcagcccagcggaggggccgcatagggcgaaaccacaataaggaaggagatcagtacatctatatgggccagcctctgaacaatgacgaggatcatgctcactggacagaggccaaaatgttgttagacaacattaatacccccgaaggtatcatcccagcgctgttcgagcccgaaagagagaagtcagcagccattgatggggaataccggctcaggggcgaggctcgcaaaacattcgttgagctgatgagaaggggagaccttcctgtctggctgagttataaggtggcctctgaaggctttcaatactccgatcggcgttggtgcttcgacggggagcgcaacaatcaggtgctcgaagagaacatggatgtcgaaatatggactaaagagggagagcgaaagaaattgagaccaaggtggctggacgctcggacgtatagcgatcccctagcactgcgcgaatttaaggagttcgccgctggtagaaggtcagttagtggcgacctcatccttgaaattgggaagctgcctcagcacttaacccagcgggcccaaaatgcattggacaacctggtgatgctccataatagcgagcagggaggccgagcgtacagacacgccatggaggaactgccggatacaatcgagactcttatgctgctcgctttgattgccgtactgaccggtggggtgacattatttttcctatccggccgcggactgggcaaaacctctatcgggctcctttgtgtcatggcaagctccgtgctgttgtggatggcttcagttgaaccacattggatagccgcatctatcattctggagtttttcctcatggtgctgcttatccccgaacctgacaggcagcggactccccaggataaccaactcgcctacgtcgtaattggactgttgtttatgatcctgacggtggctgcgaacgagatgggtttactagagaccacaaagaaagacctgggcatagggcacgttgccgtggaaaatcaccatcacgcagctatgctcgatgtcgaccttcatccagccagtgcctggactctgtatgcagtggctaccacaattatcacccctatgatgcgtcacactattgagaacacaacggccaatatctcgttgaccgcgatagctaaccaggccgcaatcctgatgggactcgataagggctggcccattagcaaaatggacatcggtgtcccactgcttgccttagggtgctactcccaggtgaatcctctgactctcacagctgcagttttgatgctggtggcccattatgcgattatcggcccgggactacaagctaaggccaccagagaagcacagaagaggaccgccgctggcataatgaaaaaccccacagtagatgggattgtggccatcgacctggatccagtcgtttacgacgcaaagttcgagaaacagctcggacagatcatgcttctgattttgtgtacttctcaaatcctgctcatgcgcacgacctgggctctgtgcgaatcaataacattagccactggccctcttaccacactgtgggagggtagccccgggaagttttggaataccactattgcggtgtccatggccaacatcttccggggaagttatctcgcaggcgctggtctagccttttctctgatgaagtcattgggcgggggacgaagaggcacgggggcacagggagagacactgggcgaaaagtggaagaggcagctcaatcagcttagcaaatccgagttcaacacctacaagcgcagtggtattatggaagtcgatcggagcgaggctaaagaagggctgaagagaggagagactaccaaacacgccgtgtctcgtggcacagccaagttgaggtggttcgtagagcggaatctggtgaagccagaaggtaaagttatcgacctcggctgtgggcgcggaggctggtcctattactgcgcggggttaaagaaagtgactgaggtcaagggatacaccaaaggcggtcctgggcacgaggagcccataccgatggctacatatggatggaacctggtgaaacttcattcaggcaaagacgtctttttcatcccacctgaaaagtgtgatacgctgctatgcgacattggcgagagctcgcccaatccaaccatcgaggaagggcgaactctcagagtgctgaagatggttgagccctggttgaggggaaaccaattttgtattaaaatcctgaatccttacatgccgtctgtagtggaaacactcgagcagatgcagcggaagcacggtggcatgcttgtccgcaaccccctgagtagaaattccacccatgagatgtattgggtgagctgcgggactggaaacattgtttcagcagtgaacatgacatccaggatgttactgaatcgattcaccatggcccaccggaaaccaacgtacgaaaaggatgtcgacttgggcgctggtacccgtcacgtggccgtagagcctgaagtggcaaacctcgatatcatagggcagagaattgagaatatcaaacatgaacacaagtctacatggcattatgacgaggataacccctacaagacttgggcctatcacggaagctacgaggttaaacctagtggctccgctagctctatggtcaatggcgtggtgaagctgctaaccaaaccatgggacgtcatccccatggttacacaaattgcgatgactgataccacaccttttgggcagcagcgcgtgttcaaggaaaaagtagacaccaggactccaaaggccaagcggggaacggcacaaataatggaggtgacagctaaatggctttggggttttctgtcaagaaacaagaaaccccgcatctgtaccagggaagagttcactcgaaaggtccggagtaatgccgcaattggcgccgtgtttgttgatgaaaaccagtggaactccgctaaagaggccgtggaggacgaaagattctgggacctcgtccatagggagcgcgaactgcacaagcaggggaagtgcgcgacctgcgtgtacaacatgatgggaaaacgtgagaagaaattgggcgaatttggtaaggcaaaagggagccgggccatctggtatatgtggctgggagctagattcctcgagtttgaggcccttggcttcatgaatgaagatcactggttctctagggagaactcgctgtcaggcgtagaaggggagggattacataagctgggttacattttgcgcgacatcagcaaaataccgggcgggaatatgtatgcagatgacacagctggatgggatacgcgaatcaccgaggacgatctccagaacgaagccaagattactgacatcatggagcctgaacacgctctgctagccaagtccatttttaaacttacataccaaaataaggttgtgcgggtccagagaccagccaaaaatggcaccgtgatggatgtgatcagtaggcgcgaccagagaggttctgggcaggtcggaacttatggcctgaacacattcaccaatatggaggcgcaactcatacggcagatggaaagcgagggcatattttccccctcagagctggaaacacctaacttggccgggagggttttagattggctggagaagcatggagtggaacgtctcaaacgaatggctatcagtggtgacgattgtgtagtgaagccaatcgacgaccgcttcgccactgcacttaccgctctgaatgatatgggcaaggtcagaaaagacattccccagtgggagccgtctaaggggtggaacgattggcagcaagtgcctttttgcagccaccacttccatcagctaataatgaaagacggacgggaaatcgttgtgccctgtaggaatcaggatgagctggtcggccgcgccagagtgtcccagggtgcagggtggtcactccgggagacggcctgcttgggaaagagctacgcgcaaatgtggcagctgatgtattttcacaggcgagaccttcgtctggctgccaacgcaatttgttctgccgtaccagttgattgggtgcctacctccagaacaacttggagtatccatgctcaccatcagtggatgaccacagaagacatgctcagcgtctggaatcgcgtgtggattgaggaaaacccctggatggaggataaaactcacatctcgtcctggggcgacgttccatacttaggcaagcgggaagatcaatggtgcgggtctctgataggattgaccgccagggcaacgtgggctacaaatatccaggtggccattaaccaggtcagacgcctgatcggtaatgagaactacctcgactatatgacctcaatgaagcggttcaaaaatgagagcgaccccgaaggcgcgctttggtga

SEQ ID NO: 13687 - RNA, 9879 nt, synthetic construct
  misc_feature 1..9879: note = derived and/or modified CDS sequence (opt3) from DENV-1__FJ410249__SS-prME
  source 1..9879: mol_type = other RNA
agcgtgaccatgctgctcatgcttatgcccactgcactggctttccacttgactacgaggggcggggaacctcatatgatcgtctccaagcaggaaaggggaaagtctttactgtttaagacctcagccggtgttaatatgtgcaccctaattgccatggacctcggcgagttctgtgaagatactatgacctacaaatgcccacggattacagaagcggaaccggacgatgtggactgttggtgcaatgctaccgatacttgggtaacatatgggacctgtagtcaaacgggagagcgccgacgtgacaagagaagcgtggccctggcaccccacgtcggccttggtctggagactaggaccgaaacatggatgtcctctgagggggcctggaaacagatccagcgggtggaaacttgggctttgcgccatcctggatttaccgttattgcactcttcctggcccacgctatcggcacatcgattacccagaagggcatcatatttatcctgctcatgttagtgacgccatcaatggccatgagatgcgtcggggtgggaagcagggatttcgttgagggtctgagtggcgcgacttgggttgacgtggtccttgagcatgggtcctgtgtgacaaccatggcaaaggataaacccactttggacattgaactgctaaagacagaggtgaccaaccctgccgtcctccggaaactgtgcatcgaagctaagatttctaatacgaccacagatagccgctgtccaactcaaggagaggccacccttgttgaagaacaggacgcaaactttgtgtgccgaagaacattcgtagataggggctggggtaatgggtgtggactgtttggcaaaggctccttgatcacttgcgctaagttcaagtgcgtgaccaaactcgaggggaagacagtccagtacgaaaacctgaaatattcagtgatagttaccgtgcacactggagaccagcaccaagtcggtaatgagagtacggaacatggcacaaccgccactattacaccccaggcgcctagcacagagatccagttaaccgactacggggccctgactctcgattgttctccacggacaggacttgactttaacgaaatggtgctgttgacgatgaaggagaaatcctggctagtacacaagcagtggttcctggatctcccgctgccctggacctcaggcgcaagcacaagtcaagagacatggaatcgtaaagaccttctggttacctttaagacagctcatgccaagaaacaggaagtggtcgtgttgggttctcaggagggggctatgcacactgccctcaccggcgcaacggaaattcaaacctccggaacaactaccatcttcgccggccacctgaagtgccgcttaaaaatggataagctgacactaaaagggatgagctatgtcatgtgtactggatcgttcaagctcgagaaggaagtggctgagacccagcatggtacggttctggtgcagatcaaatacgagggcacagacgcgccttgcaagattccattttctacccaggatgaaaaaggggtaactcaaaacggaagacttataacagcaaatcccatcgtcaccgacaaggagaaacctgtgaacattgaagccgagccacccttcggcgagtcctatatcgttataggtgctggggaaaaggccttgaagctgtcatggtttaaaaagggcagtagcattggaaaaatgttcgaggcaactgccaggggcgctcggcgaatggccatcctcggggataccgcatgggactttggatccatcggtggcgtgttcacatctgtcgggaagctggtgcaccagatttttggagcggcttacggcgtacttttcagcggtgtgtcatggacgatgaaaatcgggattggcgttctgttgacctggctcggactgaatagtcgctccactagcttatctatgacatgtatagccgtcggcctggtgaccctatacctcggggtgatggtccaggcagattcaggatgcgttatcaactggaagggcagagaactgaagtgtggtagtgggatttttgtgacaaatgaggtgcatacttggaccgaacagtataaattccaagccgacagcccgaagaggctttccgctgccatcggaaaagcatgggaggagggcgtatgcggtatccggtctgctacgcgcttggaaaacattatgtggaagcagatatcgaacgagctgaatcacatcctcctggaaaacgacatgaaatttacagtcgtggttggcgatgtggccgggattttagcgcagggaaagaaaatgatcagacctcagcccatggagtacaagtatagctggaagtcctggggcaaagccaagattatcggggctgacgtccaaaataccactttcataatcgatggaccaaacacccctgaatgtcccgacgatcagagggcatggaatatttgggaggtggaggactacggctttggtatcttcacaactaacatttggctgaaacttcgtgattcatatacccaggtttgcgaccatcggttgatgagtgccgctatcaaggattctaaagccgtgcacgcagacatggggtactggatagaaagcgagaagaatgaaacatggaagctcgcgcgagcctccttcattgaggtaaaaacgtgtatctggccaaagtcacacaccctgtggagcaacggagtcctagaatctgagatgattatccccaaaatatatggcggtcctatctcccagcataattacagaccaggctactttactcaaacagctgggccgtggcacctgggaaagctcgagctggatttcgacctttgcgaaggcaccactgtggtggtcgatgagcattgcgggaacaggggacccagtttgcgcacaaccacggttactggcaaaattatccacgaatggtgttgccggagctgtaccctgcctccattaagatttaagggtgaggacgggtgctggtatggaatggagattaggcccgtgaaggaaaaagaggaaaatctcgtaaagtctatggtgtccgccggctcaggtgaggtcgacagtttcagcctgggccttctgtgtatctcgataatgattgaagaggtgatgcgctcccgatggtctcggaaaatgttgatgacagggaccctcgcagtatttttctttctgatcatgggacagctaacttggaacgatctgatccgtctctgcattatggtgggcgctaatgccagcgacagaatggggatgggaacaacctacctggcacttatggccacattcaagatgaggcctatgtttgctgtcggcttgctgttccgccggttaacttcaagagaggtgctcctgcttaccacgggtctgagtctagttgcgtccgtggaactcccaaactctctggaggaattgggggatggactggccatgggcatcatgattttaaaactcctgacagactttcagagccaccaactttgggcaaccctgttgtccctcactttcataaagaccacattttcactgcattatgcttggaagactatggccatggtcctaagcatcgtaagtctgttccccctttgtctctctaccacgtcccagaaaacaacctggctgccggtgttgctgggcagcttagggtgcaagcctctcactatgttcctgattgccgagaataaaatctggggaaggaagtcgtggccacttaacgaaggtattatggctgttggcatcgtgtcaatactgttgtctagtctcctgaaaaacgatgtccccctagcagggcctctgatcgccggaggcatgcttattgcgtgttacgtgatctccggtagctctgctgacctcagcctggagaaggccgcagaggtatcctgggaagaggaagccgagcactcaggggctagtcataatattttggtggaagtccaggatgacggaacaatgaaaatcaaggatgaggagcgagacgataccttaactatactgctcaaggcaacactgcttgccgttagcggcgtgtatcccctgtctattccagcgaccttgtttgtgtggtacttctggcagaaaaagaaacaacgctccggcgtcctatgggacacgccttcacccccagaagtggagcgggctgttctggatgacgggatctatagaatcatgcagaggggactcctgggtcgtagtcaggtaggcgtgggggtctttcaggaaaacgtgttccacactatgtggcatgttacccgcggagccgtgcttatgtaccaaggcaagcggttagagccgagctgggcatccgtcaaaaaggacctgatttcttacggtgggggatggagactccagggctcgtggaatacaggcgaggaagtgcaggtaatagccgtcgagcctgggaagaaccccaaaaatgtgcagaccgctccaggaacatttaagactagcgaaggtgaggttggcgccatcgcattggatttcaaacccgggacctcaggatcccctattgtgaacagggaaggcaagatcgtcggtctgtatgggaatggagtggttacgacaagtggcacttacgtgtctgctattgcccaagcgaaagccagccaggagggcccactccccgagatcgaagacgaggtctttcgaaagcggaacctgaccataatggatcttcaccctgggtccggaaagacacgcagatatctgccggcaatcgtgagggaagctattaaacggaagttgcgaaccctaatcctggccccaactagagtagtggcttcagagatggcagaagccctcaaaggtatgcccattcgctaccagaccacagccgttaagtctgagcacacgggcaaagagatcgtcgacttaatgtgccatgctactttcaccatgaggctgcttagccctgtgcgtgtgccaaattataacatgataattatggatgaagcgcactttacagaccccagttccatcgcagcccgggggtacatcagcaccagagtcggaatgggcgaggctgccgcaattttcatgactgccacacctccgggttctgtagaggcttttccccaatcaaatgcggtgatccaggatgaggaaagggacataccagagcgctcctggaacagtgggtatgagtggattaccgatttccctggaaagacggtttggttcgtgcccagcatcaagtcgggcaatgacattgccaactgtctgagaaagaatggcaagagagtcatccagctctctcggaaaacttttgatacagaataccagaagaccaaaaacaacgactgggactacgtggttaccactgatatatccgagatgggggcaaatttcagggctgaccgcgtgattgatccacgtagatgcttgaagcctgtcatcctgaaggacggacccgaacgggtgatcctcgccggtccaatgccggtaacagtggcaagcgccgctcaaaggcgcggccgaattgggagaaaccataataaagagggagatcagtatatctacatgggccagcctctgaacaatgacgaggatcacgcccattggaccgaagcgaagatgcttctagacaacattaatacacccgagggtataatcccagcactgtttgaacccgagcgggaaaaatcagccgctattgatggggagtataggttgcgcggcgaggccagaaagactttcgttgaattaatgaggcggggagacctgcctgtctggctcagttacaaagtggcttctgagggctttcagtattccgatcgtcgctggtgcttcgacggggaacgaaacaatcaagtgctggaggaaaacatggatgtcgagatctggacgaaggagggagaacgaaagaaacttaggccacggtggctggacgcacgcacctacagcgaccccctcgccttgagagagtttaaggagttcgctgccggtaggcggtcagttagtggcgatctgatcctagagattgggaaactgcctcagcacctcacacagcgagcacagaatgcgcttgacaacctggtgatgttacacaatagcgaacaaggaggcagagcctatcgccatgctatggaggagttgccggatactatagaaaccctgatgctcctggcccttatcgcagtactgacaggtggggtgaccctctttttcttgtccggcaggggactgggcaagacttctattgggttactatgtgtcatggctagctccgtgctgctctggatggcctcagttgagccacactggatcgcagcctctattatccttgaatttttcctgatggtgttgctgatacccgagcctgaccggcagcgtacgccccaggataaccagctcgcttacgtcgtaatcggactgctttttatgattctcaccgtggcggccaatgagatgggtctgttggaaacaactaaaaaggacctgggcatcgggcatgttgcagtggagaaccaccaccatgctgccatgttagatgtcgacctacacccagccagtgcatggaccctgtacgctgtggccacaaccattatcactcctatgatgagacatacaatagaaaacacgaccgcgaatatttcgctcactgctatcgccaaccaagcagccattcttatgggactggataaaggctggcccatcagcaagatggacataggtgtcccattgctggctctcgggtgctattcccaggtgaatcctctgacacttaccgcagccgttttaatgctggtggcgcactacgctatcattggcccgggactccaggccaaggcaaccagggaggcccaaaaacgcacagctgccggcatcatgaagaaccccactgtagatgggattgtggcaatcgacttggatccagtcgtttatgacgctaaattcgaaaagcagctgggacagataatgctactgattctctgtacgtctcagatccttctgatgcggaccacatgggccttgtgcgagtcaatcactctggcgaccggccctctcacaaccctgtgggagggtagccccgggaaattctggaatactacgattgccgtgtccatggcaaacatctttcgaggaagttacttagctggcgccggtcttgcattctctctgatgaaaagcctcggcgggggaagaaggggcacaggggctcaaggagaaaccctaggcgagaagtggaaacgccagctgaatcagttgtcaaagtccgaatttaacacttataaacggagtggtataatggaggtcgacagaagcgaagccaaggaggggctgaaacgtggagagaccacaaagcatgccgtgtctaggggcactgcgaagctccggtggttcgtagaacgcaatcttgtgaaaccagagggtaaggttattgatctgggctgtgggcgaggaggctggtcctactattgcgctgggttgaaaaaggtgaccgaagtcaaaggatacacaaagggcggtcctgggcacgaggaacccatcccgatggcaacgtacggatggaacctggtgaaactccactcaggcaaggacgtctttttcattccacctgagaagtgtgataccttactgtgcgacatcggcgagagctcgcccaatccaactatagaagaggggagaacacttagggtgctgaaaatggttgaaccctggctacggggaaaccagttttgtatcaagattctcaatccttatatgccgtctgtagtggagaccctggagcaaatgcagcgcaaacatggtggcatgttggtcagaaaccccctgagtagaaattccactcacgaaatgtactgggtgagctgcgggacaggaaacatcgtttcagccgtgaatatgacctcccgaatgctccttaaccggttcacgatggctcatcgtaagccaacctatgagagagatgtcgacctgggcgccggtacacgccacgtggcagtagaacctgaggtggccaacttagatattatcgggcagaggattgaaaatatcaaacacgagcataagtctacttggcactacgacgaggataacccctataagacctgggcttaccatggaagctatgaagttaaacctagtggctccgcgagctctatggtcaatggcgtggtgaagctgttgacaaaaccatgggacgtcatacccatggttactcagattgccatgaccgatacaaccccttttgggcaacagcgggtgttcaaggagaaagtagacactagaacgccaaaggcaaagcgcggaacagctcagatcatggaagtgaccgccaaatggctctggggttttctgtcaaggaacaagaaaccccgaatctgtactcgggaggagttcaccagaaaggtcaggagtaatgcagccattggcgctgtgtttgttgacgagaaccaatggaactccgccaaagaggcggtggaagatgagcgcttctgggacctagtccaccgtgaacgggagcttcataagcaggggaagtgcgcaacatgcgtgtacaacatgatgggaaaaagagaaaagaaactgggcgagttcggtaaggccaaagggagcagggctatatggtacatgtggctcggagcccgctttctggagttcgaagcattgggctttatgaatgaggatcactggttctctcgagaaaactcgctgtcaggcgtagagggggagggactccacaaacttggttatatcctgcgggacattagcaaaatcccgggcgggaatatgtacgctgatgacacggccggatgggataccagaattactgaagacgatttacagaacgaggctaagatcacagacataatggaacctgagcatgccctgttggcaaagtccatctttaaactcacctatcagaataaggttgtgagggtccaacgcccagcgaaaaacggcactgtgatggatgtgattagtagacgggaccagaggggttctgggcaggtcggaacatacggcctgaataccttcacaaacatggaagcccagctaatccgtcaaatggagagcgagggcatattttccccctcagaacttgagactcctaacctggctgggcgagttctcgattggctggaaaagcacggagtggagcgcttgaaaagaatggccatcagtggtgacgactgtgtagtgaagccaatagatgaccggttcgcaaccgctttaacggccctgaatgatatgggcaaggtcaggaaagacgtgccccagtgggaaccgtctaaggggtggaacgattggcagcaggttcctttttgcagccatcacttccaccaactcattatgaaagacggacgcgagatcgtggtcccctgtagaaatcaggatgagcttgtgggccgggcaagggtatcccagggtgccgggtggtcactgcgagaaaccgcgtgcctaggaaagagctatgctcagatgtggcaactgatgtactttcatcgtagagacctccgcttggccgcaaacgccatctgttctgctgttccagtggattgggtccctacatcccggactacctggagtattcacgcccatcaccagtggatgacaactgaggacatgctgagcgtgtggaatagggtttggatagaagagaacccctggatggaagataaaacccatatctcgtcctggggcgacgtgccatatcttggcaagagagaggaccagtggtgcgggtctctgattggactcacggcacgcgctacatgggccaccaatatccaagtcgcgattaaccaggtgcggaggttaatcggtaatgagaactacctggattacatgacttcaatgaagcgattcaaaaatgaaagcgaccccgagggcgctttgtggtga

SEQ ID NO: 13688 - RNA, 9879 nt, synthetic construct
  misc_feature 1..9879: note = derived and/or modified CDS sequence (opt3) from DENV-1__FJ410251__SS-prME
  source 1..9879: mol_type = other RNA
agcgtgaccatgctgctcatgcttatgcccaccgccctggctttccacttgactacgaggggcggggagcctcatatgatcgtaaccaagcaggaaaggggaaaatccttactgtttaagacatctgccggtgttaatatgtgcactctgattgccatggacctcggcgagctgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggtagcttcaaactggagaaggaagtggctgagacccagcacggaacggtccttgtgcagataaagtacgagggcacagacgcgccttgcaaaatcccattctcgacccaagatgaaaagggggttactcagaacggacgcttgattacagcaaatcccatcgtgaccgacaaagagaagcctgtaaacatagaagccgagccaccctttggcgagtcttatattgtcatcggtgctgggggcaaagccctgaagctctcctggttcaagaaaggatcaagtatcggcaagatgtttgaagcaactgccagaggggctaggcggatggccattctgggagataccgcatgggacttcggtagcgtgggcggggtttttacatccgtgggaaaacttgtccatcagatcttcggcacggcgtacggtgtgctgttttctggggtaagctggaccatgaagattggcataggagtgttgctcacttggctgggcttaaattcacgaagtacatccctgagcatgacctgtatcgctgttgggctagtcacactctacctgggagtgatggtgcaggccgattctggctgcgtcattaactggaaaggtcgcgagcttaagtgtgggtcaggaatcttcgttactaatgaagtgcacacctggacggagcaatataagtttcaggcagacagtccgaaaagattgagcgccgctatcggcaaggcctgggaagagggtgtgtgcggcattaggtccgcaacacggctggagaacataatgtggaaacagatctctaacgaactcaatcatattctgttagagaacgacatgaagttcaccgtagtcgtgggggatgttgtgggaatcctggctcagggcaaaaagatgattcgccctcaacccatggaacacaaatactcgtggaaaagctgggggaaggccaagatcataggagcggacgtccagaatactacctttatcattgatggcccaaacacacctgagtgtcccgacgatcagagagcctggaatatctgggaagtggaggactatggtttcgggatttttactaccaacatctggcttaagttgagggattcctacacacaggtttgcgaccaccgtctcatgtcagctgcaataaaagatagtaaggccgtgcatgctgacatgggatattggattgagtctgagaaaaatgagacgtggaagctggcccgggcatccttcatcgaagtaaagacctgtatttggccaaaatcccacactctatggtcaaacggcgtcctggagagcgaaatgatcatacccaagatctacggtggccctatttctcaacataattatcgaccagggtacttcacacagaccgcgggaccgtggcacctcggcaaactggagcttgattttgacttgtgcgaggggactacagtggtggtcgatgaacactgcggaaacagaggcccctccctgaggaccacgactgttaccggtaagatcattcatgagtggtgttgccgcagttgtacattacctccactccggttcaaaggggaagacggatgctggtacggcatggagatcagacccgtgaaggagaaggaagagaatctggtaaaaagcatggtgtctgccggttccggcgaagtcgactcatttagtcttgggctgttgtgtataagcattatgatcgaggaagtgatgaggtcgcgctggtcccgaaagatgctcatgaccggaactctggctgttttcctactgctcatcatgggccagctgacatggaacgatcttattcggttgtgcatcatggtgggggccaatgcatctgaccgtatgggaatgggcaccacatatctggctttaatggccacttttaaaatgagacctatgttcgcagtcggtctcctgtttaggcgccttaccagccgggaggtgctgctactcacgattgggctgtcattggttgccagtgtggagctgccaaactccttagaagaactcggagatggcctggctatgggcataatgatccttaagctgttgacagacttccaatctcaccagctctgggcgaccctgctaagcctgacttttattaaaaccacactttccctccattacgcctggaagactatggcaatggtcctgtcaatcgtcagcttgttccccctgtgtttaagtaccacgtctcagaagacaacctggctcccggtgctgcttgggtccctgggatgcaaacctttgactatgtttctcattacagaaaataagatctggggtagaaaaagctggccactgaacgagggcataatggctgttggggtggtctcgatcctactgtcatctcttctcaagaacgatgtgcccctggccggacctttgattgccggcggtatgttaatcgcttgttatgtaattagtgggtccagcgcagacctgtctctcgaaaaagccgcggaggtgagctgggaggaagaggctgaacactccggagcctcacataatatcctggtcgaggttcaggatgacggcaccatgaagataaaagatgaagagagggacgatactcttacaattctgttgaaggcaaccctactggccgtgagtggcgtgtaccccctcagcatcccagctacgctgttcgtctggtatttttggcaaaagaaaaagcagcgatctggggtgctttgggacactccttcacccccagaggttgaacgcgcagtattagatgacggaatctaccggattatgcagagaggtctgctcggcaggagccaggtgggggtcggagtgttccaagagaacgttttccacaccatgtggcacgtgacacgtggcgccgtcttgatgtatcagggtaaacgcctggaaccgagttgggcgagcgtgaagaaagacctcatatcctacgggggaggctggcggctgcagggctcttggaataccggggaggaggtacaggtcatcgctgtggaacctggaaagaaccccaagaatgttcaaacagccccaggtacttttaaaacccccgagggcgaagtgggggcaattgcccttgatttcaagcctggaacgtcgggcagcccaatcgtcaacagagagggtaaaattgtggggctgtacggaaatggcgttgtgacaacttcaggcacctatgtctccgctatcgcccaggcaaaggctagtcaggaagggcccttgcctgagatagaggacgaagtgtttaggaaacgaaacctaacaatcatggatctgcatccgggatctggtaagacccggcgctacctcccagccattgtaagagaggcgatcaagaggaaattacggactctgattcttgcccccacccgagtggttgcaagcgaaatggctgaggccctgaagggcatgcctatcagatatcaaacaacggctgtcaaatccgaacacactgggaaggagatagtggacctcatgtgccatgcaaccttcacaatgcgcttgctgtcaccagtgagggtccccaattacaacatgattatcatggatgaggcccactttaccgacccttctagcatcgccgctcgtggatatattagtactcgggtaggcatgggtgaagcggcagccatcttcatgacagctaccccgcccgggtccgtggaggcctttccacagagcaatgcagttatacaggatgaagagagagacattcctgaaaggtcttggaactcaggatacgagtggatcacggatttccccggcaaaactgtgtggtttgtcccatccattaagagtggcaatgacatcgccaactgtctccgcaagaatgggaaacgagtgatacagctgagcagaaagacattcgataccgagtatcagaaaaccaagaacaacgactgggactacgttgtgactacagatatttcggaaatgggagctaattttcgggcggacagggtcatcgatcctcgccgttgccttaaacccgtgatcctaaaggacggtccagagagagtaattctggccggcccgatgcctgtgaccgttgcatctgctgcccagcggagggggcgcatcggacgaaaccataataaggaaggcgatcagtacatttatatgggtcagcccttgaacaatgacgaggatcacgcacactggacagaggccaaaatgttactggacaacataaatactccagaagggatcattcccgctctcttcgagcctgaaagagagaagtccgccgcgatcgatggcgaataccggctgaggggagaggcacgcaaaacgttcgtcgagcttatgagaaggggcgacctgccagtgtggctcagctataaggtggcctcagaagggtttcaatacagtgatcggcgttggtgcttcgacggagagcgcaacaatcaggtcttggaagagaacatggatgttgaaatctggaccaaagagggtgagcgaaagaaactgagacccaggtggctagacgctcggacatattctgaccctctggccctccgcgaatttaaggagttcgctgcaggcagaaggtccgtgagcggggatcttattctggaaataggaaagttaccgcagcatttgactcagcgggcccaaaatgctctggacaacctcgtaatgctgcacaattcagagcagggcggtcgagcctacagacatgcaatggaggaacttccagataccatcgagacactgatgctcttggcgctgattgccgtgttaaccgggggcgtcactctatttttcctgagtggacgcggcctcgggaaaacgagcatcggacttctgtgtgtgatggcttcctctgttttgctgtggatggccagcgtggaaccccactggattgcagcttccatcatactcgagtttttcctgatggtccttctcatccctgaacccgacaggcagcggaccccacaggataaccaactggcctatgtagtgattggtttgctgtttatgatcttaacagttgcagccaatgagatgggcctactggagactaccaagaaagacctcgggattggacacgtggctgtcgaaaaccatcaccatgcgacaatgcttgatgtggacctgcaccctgcctcagcatggaccttgtacgctgtcgccactacaatcataacgcccatgatgcgtcataccattgagaacactacagccaatatctctctgaccgcaattgctaaccaggccgcgatcctcatgggcctggataagggttggccaataagtaaaatggacatcggggtgcctcttttagctctgggctgctactcgcaggttaatccgctcaccttgacagccgcagtgctgatgctagtagcccactatgctattatcggacccggcctgcaagcaaaggccactagagaagcgcagaagaggacggctgccgggattatgaaaaacccaaccgtggatggaatcgtcgcaatagacctcgatcctgttgtgtacgacgccaagttcgagaaacagcttggccagattatgctgttgatcctgtgtacaagccaaatcctcctgatgcgcactacctgggctttatgcgaatccattacacttgccaccggtcccctgactacgctctgggaggggtctccaggaaagttttggaatacaaccatcgcagtctcaatggctaacatattccggggcagctatctagccggtgcgggcctggccttttccttgatgaaaagtctagggggaggccgaagagggactggagcacagggcgagaccctcggtgaaaagtggaagaggcagcttaatcagctgtctaaaagcgagttcaacatttacaagcgctcagggatcatggaagtggaccggtccgaggctaaagaaggattgaagagaggcgagacaactcgtcacgccgtaagtaggggtaccgcaaaactgcggtggttcgtggagcgcaatctcgttaagcctgaaggcaaggtgattgatttagggtgtggacgaggcgggtggagctattactgcgctggactgaaaaaggtcacagaggtgaaaggctatacgaagggtgggcccggacatgaggagccgatcccaatggccacctacggctggaaccttgtcaaactgcactctggcaaggacgtgtttttcactcctcccgaaaaatgtgatacactactctgcgacataggggagtcctcaccaaatcccaccatcgaggaaggaagaactctgagggttttgaagatggtagagccttggctgcggggtaaccaattttgtattaagatcctcaatccgtacatgcccagcgtggtcgaaacacttgagcagatgcagcgcaaacatggcgggatgctggtgagaaacccattatcgagaaattctacccacgagatgtattgggttagttgcggaacgggcaacattgtgtccgccgtcaatatgaccagccgaatgctgttgaaccggttcacaatggcgcaccgtaagcctacttacgaaagagatgtggacctcggtgctgggacccgccatgtagcagtggagcccgaagttgccaacctggatatcattggacagaggatcgagaatataaaacacgaacataagtcaacatggcactatgacgaggataacccttacaaaacttgggcttatcatggctcctacgaggtcaagccatctggcagcgccagttccatggtgaatggggtggtcaagctacttaccaaaccctgggacgttattcctatggtgacacaaatcgcaatgaccgatactacgccatttggacagcagcgggtattcaaggaaaaagtggacacaagaacccccaaggccaaacgcggtactgctcaaatcatggaggtcaccgcgaggtggctgtggggctttctcagccgaaacaagaagccgcggatttgtacaagagaagagttcacgaggaaagtgcgctctaatgccgcaataggggctgtttttgtggacgaaaaccagtggaactcagccaaggaggcagtcgaggatgaacgtttctgggacctggtgcagaaagagcgggaattgcacaagcagggaaaatgcgcaacctgcgtatataacatgatgggcaagagagagaagaaactgggtgaatttgggaaggctaaaggaagtagggccatctggtacatgtggctcggcgcgcgcttccttgagtttgaggcactgggcttcatgaatgaagatcactggttctcccgagagaacagcttatctggggttgaaggagagggtctgcataagttgggctacattctccgggacatctcgaaaattcctgggggaaatatgtatgccgatgacactgctggctgggatacaagaatcaccgaggacgatctgcaaaacgaagccaagataactgacatcatggagccagaacacgcactacttgctacatcaatttttaaactgacctaccagaataaggtggtcagggtgcagcgccccgccaagaacggtacagtgatggatgtcatcagcagacgggaccagagggggtccggacaagttggcacttatggcctcaataccttcacgaacatggaggctcagctgattcgtcagatggaaagtgaggggatctttttgccttctgagttagaaaccccaaacctggccgagcgagtgctcgattggcttgaaaaatacggagtagagcgcctgaagagaatggcaataagcggtgacgactgtgtggtcaaacccattgatgaccggttcgcgacagccctaactgctctgaatgatatgggcaaggtgaggaaagacatcccgcagtgggaaccttccaaggggtggaacgattggcaacaggttcccttttgctcacatcacttccaccagctcatcatgaaggacggacgcgagattgtggtcccatgtagaaatcaggatgagttggtgggccgggccagggtaagtcaaggtgcagggtggtctctgcgagaaaccgcttgccttggaaaaagctatgcccagatgtggcagctgatgtactttcatcgtagagacctccgcttagcagccaacgcgatatgttccgctgttcctgtggattgggtccccacatcacggactacctggagcatccacgcccatcaccaatggatgacgacagaggacatgctgtctgtgtggaatagggtttggattgaagagaacccatggatggaagataagacccatgtgtccagttggggcgacgtcccctatttgggcaaaagagaggaccagtggtgcgggagcctgatcggactcactgcacgcgccacatgggcttcgaatattcaggtggccatcaaccaggtacggaggcttataggtaatgagaactacctggattacatgacctccatgaagcgattcaaaaatgaaggcgaccctgagggggcactatggtga

SEQ ID NO: 13689 - RNA, 9879 nt, synthetic construct
  misc_feature 1..9879: note = derived and/or modified CDS sequence (opt3) from DENV-1__FJ410252__SS-prME
  source 1..9879: mol_type = other RNA
agcgtgaccatgctgctcatgcttatgcccacagcactggctttccacttgactacgagaggaggggaacctcatatgatcgtctccaagcaggaaagggggaaatctttactgtttaagacctcagccggtgttaacatgtgcacactgattgccatggacctcggcgagttctgtgaagatactatgacctacaaatgcccacggataacagaagcggaaccggacgatgtggactgttggtgcaatgctaccgatacttgggtaacatatgggacctgtagtcaaacgggagagcaccgccgagacaagcgttccgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaagacgcaaactttgtttgccgccgaacactggtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctagcaccgagatccagctgacagactacggggccctcacccttgattgttctccaaggactggactggacttcaacgaaatggtcttgctaacaatgaaggagaaatcctggctggtgcataagcagtggtttctcgatctgccgcttccctggacgtcaggcgcaagcaccagtcaagagacttggaatcggcaggacctgttggtaacattcaaaaccgctcacgccaagaagcaggaagttgtggtcctcggttctcaagagggggctatgcacacagccctgactggcgcaaccgaaatccagacgtccggaaccacaactatttttgccggccatttaaaatgccgtctgaagatggataaactaaccctcaaggggatgagctatgtgatgtgtacaggatcgttcaaactggagaaggaagtcgctgagactcagcacggtaccgtgcttgttcagataaagtacgagggcacggacgcgccttgcaaaatcccattcttgacacaagatgaaaagggggtgacccagaacggacgcctgattactgcaaatcccatcgtaacagacaaagagaagcctgtcaacatagaagccgagccaccctttggcgagtcttatattgtgatcggtgctggggaaaaagccctcaagctgtcctggttcaagaaaggctcaagtatcggaaagatgtttgaggcaaccgccagaggcgctaggcggatggccattcttggggatactgcatgggacttcggaagcatcggtggcgtttttacctccgtggggaaactggtccatcagattttcggaacagcgtacggcgtgttgttttctggtgtaagctggacgatgaagatagggatcggcgtgctcctgacctggttaggactaaattcacgaagtacttccctaagcatgacatgtattgctgttggcctcgtcaccctgtaccttggggtgatggtgcaggccgattctggatgcgtcatcaactggaaaggccgcgaattgaagtgtggttcagggatcttcgttacaaatgaggtgcacacttggaccgaacaatataagtttcaggcagacagtccgaaaagactgagcgccgctattggaaaggcctgggaggagggcgtgtgcggtataaggtccgcaacgcggctcgaaaacatcatgtggaaacagatttctaacgagctgaatcatatcttactggaaaacgacatgaagttcacagtagtcgtgggcgatgttgctgggattcttgcccagggcaagaagatgatccgccctcaacccatggagtacaaatattcgtggaaaagctggggcaaggcgaagataatcggggccgacgtgcagaataccacttttattatcgatggaccaaacacccctgaatgtcccgacgatcagagagcttggaatatttgggaggtcgaggactacggcttcggtatctttacaactaacatatggttgaagctcagggattcctatacccaggtgtgcgactaccgtctgatgtcagcagccattaaagatagtaaggctgttcacgccgacatggggtattggatcgaatctgagaaaaatgaaacatggaagctagcacgggcgagcttcattgaggtgaagacgtgtatctggccaaaatcccacaccctgtggtcaaacggagtactcgaaagcgagatgataatccccaagatttacggcggtcctatctctcaacataattaccgaccaggctatttcactcagacagccgggccgtggcacctgggaaaacttgagttggattttgacctgtgcgaaggcaccactgtcgtggtggatgagcattgcgggaacagaggaccctccttaaggacaaccacggtcactggcaagattatccacgaatggtgttgccgcagttgtaccctccctccactgcggttcaaaggtgaggacgggtgctggtacggaatggagataagacccgttaaggaaaaggaggaaaatcttgtgaaaagcatggtatctgctggctccggtgaggtggactcatttagtctgggcttgctctgtattagcatcatgatcgaagaggtcatgaggtcgcgctggtcccgaaagatgctgatgacagggaccctagccgtgttctttctgctcattatgggacagctgacttggaacgatcttatccggttgtgcattatggttggcgcaaatgcttctgaccgtatggggatgggaacaacctatctggccttaatggcaacattcaaaatgagacctatgtttgccgtgggcctcctgttcaggcgccttactagccgggaggtcctgctactcaccataggtctgtcattggtggctagtgttgaactgccaaactccttagaggaactcggggatggactggcgatgggcatcatgattcttaagctgttgacggactttcaatctcaccagctctgggccacactgctaagcctgaccttcatcaaaactaccttttcccttcattacgcatggaagacaatggctatggtgctctcaattgtcagcctgttccccttgtgtctgagtactacctctcagaagacgacatggttaccggtactcctgggctcccttgggtgcaaacctctgaccatgtttttgatcgccgagaataagatatggggaagaaaaagctggccactcaacgaaggtatcatggccgtgggcattgtttcgatcctgctatcatctctgcttaagaacgatgtgcccctcgctgggcctctgattgcaggaggcatgttgatcgcctgttatgtcataagtggttccagcgcggacttatctctggagaaagctgccgaggtgagctgggaagaggaagcagagcactccggggcctcacataatattctcgtagaagtgcaggatgacggaactatgaagatcaaagatgaggagagggacgatacactgaccatccttctgaaggctactttgctagcagtcagtggcgtttaccccctgagcattccagccacactcttcgtgtggtatttctggcaaaagaaaaagcagcgatctggcgtgctgtgggacaccccttcacccccagaagtcgagcgcgcggtgcttgatgacgggatataccggatcatgcagagaggattactgggtaggagccaggttggcgtaggggtgtttcaagaaaacgtcttccacacgatgtggcatgtgactcgtggagctgttctcatgtaccagggcaaacgcttggagccgagttgggccagcgtgaagaaagacctgatttcctatggtgggggatggcggctccagggctcttggaataccggcgaggaagtccaggtgatcgcagtagagcctgggaagaaccccaagaatgtccaaacagccccaggaacctttaaaacatcggaaggtgaggtgggcgctattgccctggatttcaagcccgggactagcggatcacctatcgttaacagagaaggcaaaatagtgggtctttacgggaatggagtcgtgaccacgtccggcacatatgttagtgcaatcgctcaggccaaggcgtctcaggagggcccactgcccgagattgaagacgaggtgtttaggaaacgaaacttgactatcatggatctacaccctgggagcggaaagacccggcgctacctgccggccattgtcagagaagcaatcaagaggaaactccggacattaatactggctccaacccgagtggtagcctccgagatggctgaagcacttaagggtatgcccattagatatcaaactaccgccgtgaaatcagagcacacaggcaaggagatcgttgacctgatgtgccatgccacgttcactatgcgcctcttgtctcctgtcagggtgccaaattacaacatgatcattatggatgaagctcactttaccgaccccagcagtatcgcggcacgtgggtatatatccacacgggtgggaatgggcgaggccgctgccattttcatgaccgcaactcctccgggtagcgtcgaagcctttccccagtctaatgctgtaatccaggatgaggaaagagacattccagagaggtcatggaactccgggtacgagtggatcacagatttccctggaaaaaccgtgtggtttgttcccagtataaagagcggcaatgacattgcgaactgtctgcgcaagaatggcaaacgagtgatccagctctcgagaaagacgttcgatactgaataccagaagacaaagaacaacgactgggactatgtcgtgaccaccgatatctctgagatgggggccaatttccgggcagacagggttattgatccacgccgttgcctgaaacctgtgatccttaaggacggacccgaaagagtcattctagctggtccaatgccggtgactgtagcctccgcagcccagcggaggggccgcatagggcgaaaccataataaggagggagatcagtacatctatatgggccagcctctgaacaatgacgaggatcacgctcattggacagaagccaaaatgttgttagacaacattaatacccccgagggtatcatcccagcgctgtttgaacccgagagagaaaagagcgcagccattgatggggagtaccggctcaggggcgaggctcgcaaaacattcgtggaactgatgagaaggggagaccttcctgtttggctgtcatataaggtcgccagtgagggctttcaatactctgatcggcgttggtgcttcgacggggaacgcaacaatcaggtgctcgaggaaaacatggatgtggagatatggactaaagagggagaacgaaagaaattgagaccaaggtggctggacgctcggacgtattccgaccccctagcactgcgcgagtttaaggagttcgccgctggtagaaggagcgtctcaggcgatctcatccttgagattgggaagctgcctcagcacttaacccagcgggcccaaaatgcattggacaacctggttatgctccacaatagtgaacagggaggccgagcgtacagacatgccatggaggagctgccggatacaatcgaaactcttatgctgctcgctttgattgccgtgctgaccggtggggtaacattatttttcctaagcggccgcggactgggcaaaacctccatcgggctcctttgtgtgatggcatctagcgtcctgttgtggatggcttccgtggagccacactggatagccgcatcaatcattctggaatttttcctcatggttctgcttatccccgagcctgacaggcagcggactccccaggataaccaactcgcctacgtggtcattggactgttgtttatgatcctgacggtagctgcgaatgagatgggtttactagaaaccacaaagaaagacctgggcatagggcatgtggccgttgagaaccaccaccatgcagctatgctcgatgtggaccttcacccagcctctgcctggactctgtatgcagtcgctaccacaattatcacccctatgatgcgtcatactattgaaaacacaacggccaatatcagtttgaccgcgatagctaaccaggccgcaatcctgatgggactcgataagggctggcccatttcgaaaatggacatcggtgtgccactgcttgccttagggtgctacagccaggtcaatcctctgactctcacagctgcagtgttgatgctggttgcccactatgcgattatcggcccgggactacaagctaaggccaccagagaggcacagaagaggaccgccgctggcataatgaaaaaccccacagtggatgggattgtagccatcgacctggatccagtggtctacgacgcaaagttcgaaaaacagctcggacagatcatgcttctgattttgtgtacttcccaaatcctgctcatgcgcacgacctgggctctgtgcgagtctataacattagccactggccctcttaccacactgtgggagggttcacccgggaagttttggaataccactattgcggttagcatggccaacatcttccggggatcctatctcgcaggcgctggtctagccttcagtctgatgaaatctttgggcgggggacgaagaggcacgggggcacagggagaaacactgggcgagaagtggaagaggcagctcaatcagcttagcaaatcagaatttaacacctacaagcgctccggtattatggaggtggaccggagtgaagctaaagaggggctgaagagaggagagactaccaaacatgccgtcagccgtggcacagccaagttgaggtggttcgtggaacggaatctggtaaagccagagggtaaagtgatcgatctcggctgtgggcgcggaggctggtcttattactgcgcggggttaaagaaagttactgaagtgaagggatacaccaaaggcggtcctgggcacgaggaacccataccgatggctacatatggatggaacctggtcaaacttcactccggcaaagacgtgtttttcatcccacctgagaagtgtgatacgctgctatgcgacattggcgagtcaagccccaatccaaccatcgaagaggggcgaactctcagagtcctgaagatggtggaaccctggttgaggggaaaccaattttgtattaaaatcctgaatccttacatgccgtcggttgtagagacactcgagcagatgcagcggaagcatggtggcatgcttgtgcgcaaccccctgtctagaaatagtacccacgaaatgtattgggtctcctgcgggactggaaacattgtgagcgcagttaatatgacatcaaggatgttactgaaccgattcaccatggcccatcggaaaccaacgtacgagcgtgatgtggacttgggcgctggtaccagacacgtcgccgtggaacctgaggtagcaaacctcgatatcatagggcagcgcattgaaaatatcaagcacgagcataaatccacatggcactatgacgaggataacccctacaagacttgggcctatcatggatcttacgaagtgaagcctagcggcagtgcttccagcatggttaatggcgtcgtgaaactgctaaccaagccatgggacgtgatccccatggtcacacaaattgcgatgactgataccacaccttttgggcagcagagggttttcaaagagaaggtggacacccggactccaaaagccaagagaggaacggcacaaataatggaagtaacagctaagtggctttggggttttctgtctcgcaacaaaaagcccaggatctgtacccgagaggagttcactcggaaagtgagatcaaatgccgcaattggcgccgtctttgtggacgagaaccagtggaatagtgctaaggaggccgttgaagatgagaggttctgggacctcgtgcaccgcgaacgtgagctgcataaacaggggaagtgcgcgacctgcgtctacaacatgatgggaaagcgggagaaaaagttgggcgagtttggtaaagcaaaggggtccagagccatctggtatatgtggctgggagctaggttcctcgagttcgaagcccttggctttatgaatgaggatcactggttcagccgcgaaaactctctgtcgggcgtggagggggagggattacacaaactgggttacattttgcgagacatctcaaagataccgggcgggaatatgtatgcagatgacacagctggatgggatacgcggatcaccgaagacgatctccagaacgaggccaaaattactgacatcatggaacctgagcatgctctgctagccaagagcatttttaaacttacataccaaaataaagtagttagagtgcagaggccagcaaagaacggcaccgtcatggatgtgatctcccgcagagaccagcggggtagtggacaggtgggaacttatggcctgaatacattcaccaacatggaagcgcaactcataaggcagatggagtctgagggcatttttagcccctccgaactggagacacctaacttggccgggcgtgtcttagattggctggaaaaacacggagttgagcgactcaagcgcatggctatctcaggtgacgactgtgtggtaaaaccaatcgatgacagattcgccactgcacttaccgctctgaatgatatgggcaaggtgcggaaggacattccccagtgggaaccgagtaaagggtggaacgattggcagcaagtccctttttgctctcatcacttccaccagctaataatgaaggacggaagggagatcgtggttccctgtcgcaatcaggatgagctggtgggcagagcccgggtcagccagggtgcagggtggtccctcagggaaacggcctgcttgggaaaatcatacgcgcaaatgtggcagctgatgtattttcatcgacgtgaccttagactggctgccaacgcaatttgtagcgccgtgccagtagattgggttcctacctctcgcacaacttggtccatccacgctcatcaccagtggatgaccacagaggacatgctcagtgtgtggaatcgggtctggattgaagagaacccctggatggaagataagactcatatcagctcgtggggcgacgtgccatacttaggcaaaagggaggaccaatggtgcgggtccctgataggattgaccgccagagcaacgtgggctacaaatatccaggttgccattaaccaggtgcgccggctgatcggtaatgagaactacctcgattatatgacctctatgaagaggttcaagaatgaatcagaccccgagggcgcgctttggtga

SEQ ID NO: 13690 - RNA, 9879 nt, synthetic construct
  misc_feature 1..9879: note = derived and/or modified CDS sequence (opt3) from DENV-1__FJ461331__SS-prME
  source 1..9879: mol_type = other RNA
agcgtgaccatgctgctcatgcttatgcccactgcactggctttccacttgactacgagaggaggggagcctcatatgatcgtctccaagcaggaaaggggaaaatctttactgtttaagacctcagccggtgttaacatgtgcacattaattgccatggacctcggagagctgtgtgaagatactatgacctacaaatgcccacggattacagaggcggaaccggacgatgtggactgttggtgcaatgctaccgatacttgggtaacatatgggacctgtagtcagacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaattgctcaagacagaggtgaccaaccctgccgtgctgaggaaactttgcattgaagctaagatctctaatacgaccacagatagccggtgtccaactcaaggagaggccaccctggtcgaggaacaggacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatgtgtactggcagcttcaaactggagaaggaagtcgctgagacccagcacggtacggtgcttgttcagataaagtacgagggcacagacgcgccttgcaaaatcccattctcgacccaagatgaaaagggggtgactcagaacggacgcttgattacagcaaatcccatcgtaaccgacaaagagaagcctgtcaacatagaagccgagccaccctttggcgagtcttatattgtgatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtttttacatccgtggggaaacttattcatcagatattcggaacggcgtacggcgtcctgttttctggtgtgagctggaccatgaagatcgggattggcgtattgctcacttggctgggattaaattcacgaagtacatccctgagcatgacctgtatcgctgtgggcctagttacactctacctgggggtcatggtgcaggccgattctggatgcgtgatcaactggaaaggccgcgaacttaagtgtggttcagggattttcgtcactaatgaggttcacacctggacggaacaatataagtttcaggcagacagtccgaaaagattgagcgccgctataggaaaggcctgggaggagggcgtgtgcggtatcaggtccgcaacacggctggaaaacattatgtggaaacagatctctaacgagctcaatcatattctgttagaaaacgacatgaagctgaccgtggtagtcggcgatgtggctgggatccttggacagggcaaaaagatgatacgccctcaacccatggagtacaaatattcgtggaaaagctgggggaaggccaaaatcattggagcggacgcccagaatactaccttcatcattgatggcccaaacacacctgaatgtcccgacgatcagagagcttggaatatctgggaggttgaggactacggttttgggatattcactaccaacatttggttgaagctcagggattcctatacacaggtgtgcgaccaccgtctgatgtcagcagccatcaaagatagtaaggctgtccacgccgacatgggatactggattgaatctgagaaaaatgaaacgtggaagctagcacgggcgagctttatcgaggtgaagacctgtatatggccaaaatcccatactctgtggtcaaacggcgttctcgaaagcgagatgatcattcccaagatctatggtggccctatttctcaacacaattaccgaccagggtacttcacacagaccgccggaccgtggcatctgggcaaacttgagttggatttcgacctgtgcgaagggactacagtggtagtcgatgagcactgcggaaacagaggcccctccttaaggaccacgactgtgaccggtaagatcatacacgaatggtgttgccgcagttgtacactccctccactgcggtttagaggggaggacggatgctggtatggcatggagattaggcccgtgaaagaaaaggaggaaaatcttgtcaagagcatggtttctgctggttccggcgaggtggactcattcagtctggggttgctctgtatcagcatcatgattgaagaggtaatgcgctcgcgatggtcccggaaaatgctgatgaccggaactctagccgtgtttttcctgctcatcatgggccagctgacatggaacgatcttattcgtttgtgcataatggtcggggcaaatgcttttgacagaatgggaatgggcaccacatacctggccttaatggcaactttcaagatgaggcctatgtttgccgtgggtctcctgttccgccggcttacctctagagaggttctgctactcacgatcgggctgagcttggtggcttcagtcgaactgccaaacagtttagaggaactcggagatggcctggcgatgggcattatgatccttaaactgttgacagactttcaatcccatcagctctgggccaccctgctatctctgactttcattaagaccacatttagccttcactatgcatggaaaactatggctatggtgctctccatcgtttcactgttccccttgtgtctgagcaccacgagtcagaagacaacctggttaccggtgctcctggggtctcttggatgcaagcctctgactatgtttttgatagccgagaataaaatctggggtaggaagtcctggccactcaacgaaggcattatggccgtcgggatcgtaagcattctgctatcgtcactgcttaaaaacgatgtgcccctcgctggacctctgatcgcaggcggtatgttgatagcctgttacgttatttctgggagttccgcggacttaagcctggagaaggctgccgaggtgtcttgggaagaggaagcagagcatagcggagcctcccacaatatcctcgtcgaagtgcaggatgacggcacaatgaaaatcaaggatgaggagcgagacgataccctgactattcttctgaaagctacattgctagcagtatcaggcgtgtatcccctgagtataccagccaccctcttcgtctggtacttctggcaaaagaagaaacagcgcagcggggttctgtgggacacgccttctcccccagtggtggaacgggcggtccttgatgacggaatctatagaattatgcagaggggtttactgggccgttcccaggtgggggttggagtatttcaagagaacgtgttccatactatgtggcacgtcacccgcggcgctgtgctcatgtaccagggtaagcggttggaaccgtcatgggccagtgttaaaaaggacctgatcagctacgggggaggctggagactcaggggctcctggaatacaggggaggaggtgcaggtcattgcagtggaacctggcaaaaatcccaagaatgtacagaccgccccaggtacatttaagactcccgagggcgaagtcggggctatcgccctggatttcaaacctggaacctctggctcgccaatagtgaaccgagagggtaagatcgttgggctttatggaaatggcgtggtcacgacaagcggcacttacgtgtcagcaattgctcaagccaaagcgtcccaggaagggcccctgcctgagatcgaggacgaagtttttcggaagcgcaacttgaccattatggatctacacccgggaagtggtaaaacaagaaggtatctgccagccatcgtgcgggaggcaataaagcgaaagctcagaaccttaattctggctcccactcgcgtcgtggcctctgaaatggctgaggcacttaaaggcatgcctatcaggtaccagaccacagccgtaaagagcgaacatacggggaaagagatcgtggacctgatgtgccacgccactttcaccatgcgtctcttgtccccagttcgggtccccaattataacatgattatcatggatgaggctcattttacagacccttcatctatagcggcaagaggatacattagcaccagggtgggcatgggtgaagccgctgccatcttcatgactgcaacaccgcccgggagtgtggaggcctttccacaatccaatgctgtcattcaggatgaggaacgcgacatccctgaacgaagctggaactctggacacgagtggataaccgatttccccggcaagacggtatggtttgtgccatcaattaaatccggcaatgacatcgcgaactgtctgagaaagaatgggaagcgggttatccagctcagtaggaaaactttcgatacagagtatcagaagaccaaaaacaacgactgggactacgtggtcaccactgatattagcgaaatgggagccaatttccgcgcagaccgtgtgatcgatcctagacggtgcctgaagcccgttattcttaaagacggtccagagagggtgatactagctggcccgatgcctgtcacagtggcctcggcagcccaacgccgagggagaatcggacggaaccataataaggaaggcgatcagtacatttatatgggtcagcccctgaacaatgacgaggatcacgctcactggaccgaggccaagatgttgttagacaacatcaatacaccagaagggatcattcccgcgctgtttgagcctgaaagggagaaatctgcagccgtagatggcgaataccgcctcagaggagaggctaggaagactttcgtggagctgatgcggcgtggcgaccttccagtttggctgtcctataaagtcgccagcgaagggtttcagtactcagatcgccgatggtgcttcgacggagagagaaacaatcaagtgctcgaagagaacatggatgtggaaatatggacgaaggagggtgagaggaaaaagttgcggccccgctggctggacgctagaacctatagtgaccctctagcactgagggaatttaaagagttcgccgctggccggcgatctgtctccggggatctcatccttgaaattggaaagctgccgcagcatttaacacagagagcccagaatgcattggacaacctggttatgctccacaatagcgagcaaggcggtcgcgcgtacaggcatgccatggaggaactgccagatactatcgagacccttatgctgctcgctttgattgccgtgctgacagggggcgtaaccttatttttcctatcaggacggggcctggggaagacaagtatcggactcctttgtgtgatggcaagctccgtcctgttgtggatggcttctgtggaaccccactggatagccgcaagcatcattctggagtttttcctcatggttctgcttatccctgaacccgaccgtcagagaacgccacaggataaccagctcgcctatgtggtcattggtctgttgtttatgatcctgaccgtagctgcgaatgagatgggcttactagagacaactaaaaaggacctggggataggacacgtggccgttgaaaaccatcaccatgcagctatgctcgatgtggaccttcaccctgcctccgcctggaccctgtacgcagtcgctacaaccattatcactcccatgatgaggcatacaattgagaacacgaccgccaatatctcattgactgcgatagctaaccaagccgcaatcctgatgggcctcgataaaggttggccaatttctaagatggacatcggggtgcctctgcttgccttaggctgctacagtcaggtcaatccgctgacactcaccgctgcagtgttgatgctggttgcccactatgcgattatcggacccggcctacaggctaaagccacccgcgaagcacaaaagcggacagccgctgggataatgaagaacccaactgtggatggaattgtagccatcgacctggatcctgtggtctacgacgcaaaattcgagaagcagctcggccagatcatgcttctgattttgtgtacgtcgcagatcctgctcatgcgaaccacatgggctctgtgcgaaagcataactttagccaccggtccccttacaaccctgtgggaggggtccccaggaaaattttggaatactacgattgcggtttctatggccaacatcttcagaggctcatatctcgcaggagctggcctagccttcagcctgatgaagtccctagggggtggcaggcgcgggacaggagcacaaggcgagaccctgggtgaaaaatggaagcggcagctcaatcagcttagtaagtctgagtttaacacttacaaaagaagcgggattatggaagtggaccgttcagaggctaaggaaggactgaaaaggggcgagaccacaaagcacgccgtctcccggggtactgccaaattgcgctggttcgtggagcgaaatctggtaaagcctgaaggcaaggtgatcgatctcgggtgtggaagaggcgggtggagttattactgcgcgggactaaagaaggttaccgaggtgaaaggctatacaaagggtgggcccggacatgaggaaccgataccaatggctacgtacggctggaacctggtcaaacttcacagcggcaaggacgtgtttttcatccctcccgaaaaatgtgataccctgctatgcgacattggggagtcttccccaaatcccactatcgaggaaggaaggacactccgggtcctgaagatggtggagccttggttgcgcggtaaccagttttgtattaagatcctgaatccgtacatgccctcagttgtagaaaccctcgagcaaatgcagagaaaacatggcgggatgcttgtgaggaacccactgagccgaaattcgactcacgagatgtattgggtctcttgcggaacaggcaacattgtgagtgcagttaatatgacctcccggatgttactgaaccgtttcacgatggcccacagaaagcctacctacgaacgcgatgtggacttgggtacagggactaggcatgtcgctgtggagcccgaagtagccaacctcgatatcataggacagcggattgagaatatcaaacacgaacataagagcacctggcactatgacgaggataacccttacaaaacatgggcatatcatggctcatacgaggtgaagccatccggctctgccagcagtatggttaatggggtcgtgaagctgctaactaaaccctgggacgtgatccctatggtcacccagattgctatgacagataccactccatttggacaacagagagttttcaaggaaaaagtggacacgcgcacacccaaggcgaaaaggggtaccgcccagataatggaggtaactgcacgatggctttggggctttctgtcccggaacaagaagccgagaatctgtaccagggaagagttcacacgcaaagtgcgtagcaatgctgccattggggcagtctttgtggacgaaaaccaatggaactctgccaaggaggctgttgaggatgaacggttctgggacctcgtgcacagagagagggaactgcacaaacagggaaagtgcgccacgtgcgtctataacatgatgggcaaacgcgagaagaagttgggtgaatttgggaaagcgaagggatcacgagcaatctggtacatgtggctgggcgcccggttcctcgagttcgaggctcttggctttatgaatgaagatcattggttcagtagagagaactccctgagcggggtggaaggagagggtttacacaaactgggctacattttgagggacatctctaagatacctgggggaaatatgtatgccgatgacaccgcaggctgggatactcgcatcacagaggacgatctccagaacgaagctaaaattaccgacatcatggagccagaacatgccctgctagctaaggccatttttaaacttacttaccagaataaggtagttagagtgcaacggcccgcaaagaacggtacagtcatggatgtgatctcgaggcgtgaccagcgagggtcaggacaggtgggcacctatggcctgaatacattcactaacatggaggcgcagctcatacgccaaatggaaagcgaggggatattttcccctagtgagctggaaaccccaaacttggccgagagagctttagattggctggaaaaatacggagtcgagcggctcaagaggatggccatctctggtgacgactgtgttgtgaaacccatcgatgaccgcttcgcaacggctcttaccgccctgaatgatatgggcaaggtaagaaaagacattccgcagtgggaacctagcaaggggtggaacgattggcaacaggtgcccttttgctcccaccacttccatcaactaataatgaaggacggacgggagatcgtcgtgccatgtaggaatcaggatgagctggttggccgagcacgtgtgtcacagggtgccgggtggagtctcagagaaacagcgtgcttgggaaaatcttatgctcagatgtggcaactgatgtactttcaccgccgggaccttaggctggccgcaaacgccatttgtagcgctgtccctgtggattgggtacccacttccagaaccacatggtcaatccatgcccaccatcagtggatgactaccgaggacatgctcagcgtttggaatcgcgtgtggattgaagagaacccatggatggaagataagacgcacatctcttcctgggaggacgtcccctatttaggcaaacgggaggaccagtggtgcggcagtctgatagggttgacagcaagggctacctgggccactaatatccaagtggcgattaaccaggttcgaagactgatcggaaatgaaaactacctcgattacatgacaagcatgaagcggttcaaaaatgagtcggaccctgaaggtgctctttggtga

SEQ ID NO: 13691 - RNA, 9879 nt, synthetic construct
  misc_feature 1..9879: note = derived and/or modified CDS sequence (opt3) from DENV-1__FJ410256__SS-prME
  source 1..9879: mol_type = other RNA
agcgtgaccatgctgctcatgcttatgcccactgcactggctttccacttgactacgagaggaggggaacctcatatgatcgtctccaagcaggaaagggggaaatctttactgtttaagacctcagccggtgttaatatgtgcaccctaattgccatggacctcggcgagttctgtgaagatactatgacctacaaatgcccacggataaccgaagcggaaccggacgatgtggactgttggtgcaatgctaccgatacttgggtaacgtatgggacctgtagtcagacgggagagcaccgccgagacaagcgtagcgtggccctggcaccccatgtcggccttggtctggagactagaaccgaaacatggatgtcctctgagggggcctggaaacagatccagaaggtggaaacttgggctttgaggcaccctggatttaccgttattgcactcttcctggcccatgctatcggcacatcgattacccagaagggcatcatatttatcctgctcatgttagtgacgccatcaatggccatgcggtgcgtcgggattggaagccgcgatttcgtggagggtctgagtggcgcgacttgggtagacgttgtgcttgagcacgggtcctgtgtcacaaccatggcaaaagataagcccactttggacatcgaactgctaaaaacagaggtgaccaaccctgccgtgctcagaaagctgtgcattgaagctaaaatctctaatacgaccacagatagtaggtgtccaactcaaggagaggccacccttgtcgaagaacaggacacaaactttgtttgccggcgcactttcgtggatcgaggctggggtaatgggtgtggactgtttggcaagggctccttgataacctgcgcaaagttcaaatgcgtaacaaagctcgaggggaaaattgtgcagtacgaaaacctgaagtattcagtcatcgtgaccgttcacactggagaccagcatcaagtgggtaatgagagtacggaacacggcacaaccgctactattacaccccaggcccctagcacagagatccagttaaccgactacggggcgctgactctcgattgttctccaagaacaggacttgactttaacgaaatggtcctgttgacgatgaaagagaagtcctggctagtgcataaacagtggttcctggatctcccgctgccctggacctcaggcgccagcacaagccaagagacatggaataggaaggaccttctggtaacctttaagacagcacacgctaaaaagcaggaagttgtggtcttgggttctcaggagggggccatgcacactgctctcaccggcgccacggaaatccaaacctccggaacaactaccattttcgcaggccatctgaaatgccggttaaagatggataaactgacactaaaggggatgagctatgtgatgtgtactggatcgttcaagctcgagaaagaagtcgccgagacccagcacggtacggtgctggttcagataaagtacgagggcacagacgctccttgcaaaatcccattttctacccaggatgaaaagggggtgactcaaaacggacgtcttattacagcgaatcccatcgtaaccgacaaagagaagcctgtcaacatagaagcagagccacccttcggcgagtcctatattgtgatcggtgccggggaaaaggctttgaaactgtcatggtttaagaaaggcagtagcatcggaaagatgttcgaggccactgcacgcggcgccagaaggatggctattctcggggataccgcctgggactttggatccatcggtggcgttttcacatctgtggggaaactggtccatcagatttttggaacggcatacggcgtgcttttcagcggtgtatcatggaccatgaagatagggatcggcgtgctgttgacttggctcggactgaatagtcggtccactagcttatctatgacctgtattgcggttggcctggtcacactatacctcggggtgatggtgcaggctgattcaggatgcgtcatcaactggaagggccgagaactgaaatgtggtagtgggatctttgttactaatgaggtgcacacctggacggaacagtataagttccaagccgacagcccgaaacgcctttccgcagccattggaaaggcttgggaggagggcgtgtgcggtataagatctacaaccaggttggaaaacatcatgtggaaacagatttcgaacgagctgaatcatatcctcctggaaaacgacatgaagtttactgtagtcgtgggcgatgttgccgggattttagcacagggcaagaagatgatccggcctcagcccatggagtacaagtatagctggaaatcctggggcaaggctaaaataatcggggccgacgtgcaaaataccacattcattatcgatggaccaaacactcctgaatgtcccgacgatcagcgcgcgtggaatatttgggaggtcgaggactacggctttggtatcttcaccacaaacatatggctgaaacttagagattcatatacacaggtgtgcgaccacaggttgatgagtgccgctattaaagattctaaggcagttcacgccgacatggggtactggatcgaaagcgagaagaatgaaacctggaaactcgctcgtgcctccttcattgaggtgaagacttgtatctggccaaaatcacatacactgtggagcaacggagtactagaatctgagatgataatccccaagatttatggcggtcctatctcccagcacaattaccggccaggctactttacccaaactgcagggccgtggcatctgggaaaactcgagctggatttcgacctttgcgaaggcacaaccgtcgtggtggatgagcactgcgggaaccgaggacccagtttgagaacgactaccgtcacaggcaagattatccacgaatggtgttgcaggagctgtaccctgcctccattacgctttaagggtgaggacgggtgctggtatggaatggagatacggcccgttaaagaaaaggaggaaaatctcgtgaaatctatggtatccgcgggctcaggtgaggtggacagtttcagcctgggccttctgtgtatttcgatcatgatcgaagaggtcatgagatccaggtggtctcgcaagatgttgatgactgggacactcgccgtgtttttcctgctaattatgggacagctgacctggaacgatctcatccgactgtgcattatggttggcgctaatgccagcgaccggatggggatgggaacaacttaccttgcattgatggctacctttaaaatgcgtcctatgttcgccgtgggcctgttatttagaaggctcacgtcacgcgaggtcctgcttctgacaataggtctaagtctcgtggcatccgttgaactgccaaactctttggaggaactgggggatggattagccatgggcatcatgattctcaagctgcttaccgacttccagagccatcaactgtgggctactttgctctccctgacctttatcaagacaactttctcactacactatgcgtggaaaaccatggccatggtgctgagcattgtcagtctttttcccctctgtctgtctacgacatcccagaagaccacttggttgccggtactgttaggcagcctcgggtgcaaacctctgacaatgttccttatcgcagagaataagatatggggacggaaatcgtggccactgaacgaaggtatcatggctgtgggcattgtttcaatcttgctctctagtctgctaaagaacgatgtgcccctggccgggcctcttattgccggaggcatgctcatcgcttgttacgtcatatccggtagctctgcagacctgagcttggagaaagccgcggaggtgtcctgggaagaggaagctgagcattcaggggccagtcacaatattttagtagaagtgcaggatgacggaaccatgaagatcaaggatgaggagagagacgatactctgacaatcctcctgaaagcaacccttctggccgtcagcggcgtttatcccttgtctattccagctacgctattcgtgtggtacttttggcagaagaaaaagcaaaggtccggcgtgctgtgggacactccttcacccccagaagtcgagcgagcagtgctcgatgacgggatatatcgcatcatgcagcggggactgcttggtagaagtcaggttggcgtaggggtgttccaggaaaacgtctttcataccatgtggcacgtgacaaggggagccgttttaatgtaccaaggcaaacgtctggagccgagctgggcgtccgtgaagaaggacctcatttcttacggtgggggatggcgcttgcagggctcgtggaataccggcgaggaagtccaggtgatcgctgtagagcctgggaaaaaccccaagaatgtccagacagccccaggaactttcaaaaccagcgaaggtgaggtgggcgcaattgccctggattttaagcccgggacgtcaggatcccctatcgttaaccgggaaggcaaaatagtgggtctctatgggaatggagtcgtgacaacaagtggcacctacgtttctgctatcgcccaagcaaaggctagccaggagggcccactgcccgagattgaagacgaggtgttcagaaagaggaaccttacaatcatggatctgcaccctgggtccggaaaaacccgacggtatttgccggccattgtccgcgaagcgatcaagagaaaactaaggactctgatactcgccccaacccgggtggtagcatcagagatggctgaagccttaaagggtatgcccattcgataccagacaacggctgtgaaatctgagcatactggcaaggagatcgttgacctgatgtgccacgcaacctttacaatgagacttctgagccctgtccgcgtgccaaattataacatgatcattatggatgaagcccatttcaccgaccccagttccatcgccgctagggggtacataagcactcgtgtgggaatgggcgaggcggcagccatttttatgacagctacccctccgggttctgtcgaagccttcccccaatcaaatgcagtaatccaggatgaggaacgggacattccagagagatcctggaacagtgggtatgagtggatcacggattttcctggaaagactgtgtggttcgttcccagcataaaatcgggcaatgacattgccaactgtctcaggaagaatggcaaacgcgtgatccagttgtctcgaaagacattcgataccgaataccagaaaaccaagaacaacgactgggactacgtcgtgactacagatatctccgagatgggggctaattttagagcggaccgggttattgatccaaggcgctgcctgaagcctgtgatcctcaaagacggacccgaacgtgtcattctggccggtccaatgccggtgaccgtagcaagcgctgcccaaagacggggcaggatagggcgcaaccacaataaggagggagatcagtatatctacatgggccagcctcttaacaatgacgaggatcatgcacactggacagaagccaaaatgctactggacaacattaatactcccgagggtatcatcccagctttgttcgaacccgagcgagaaaagtcagccgcgattgatggggagtatagattacggggcgaggcaaggaaaacgtttgtggaactgatgcgcagaggagacctccctgtttggctgagttacaaggtcgcctctgagggcttccagtattccgataggcggtggtgctttgacggggaacgtaacaatcaagtgcttgaggaaaacatggatgtggagatatggaccaaagagggagaacgcaagaagctgcgaccaagatggctcgacgctaggacatacagcgaccccttggccctgcgggagttcaaagaatttgctgcaggtcgcagatcagtcagtggcgatctaatcctggagattgggaagctccctcagcaccttactcagagggcccagaatgctctggacaacttagttatgttgcataatagcgaacaaggaggccgggcctatcgacacgcaatggaggagctgccggataccatcgaaacactcatgctgcttgcgctgattgccgtgctcaccggtggggtaactttgttctttctgtccggcagaggattaggcaaaacgtctatcgggctactgtgtgtggtcgctagctccgtgctcctttggatggcctcagttgagccacattggatagcagcttctatcattctggagttctttttgatggtgctgctcatccccgagcctgaccgccagaggacaccccaggataaccagctggcctacgtcgtaattggacttctcttcatgatcctgacagtggcagccaatgagatgggtttgctggaaactaccaagaaagacttaggcatagggcacgttgctgcggagaaccaccatcacgccgcaatgctagatgtggacctgcatccagctagtgcctggacactctacgccgtcgcaaccactattatcacacctatgatgcggcacacgattgaaaacaccactgctaatatctcgcttacagccatagcgaaccaagctgccatcctgatgggattggataagggctggcccattagcaagatggacatcggtgtgccactgctcgcactggggtgctattcccaggtcaatcctcttaccttaaccgccgctgtgctgatgctcgttgcacattacgccattatcggcccgggattgcaggcgaaagctacacgtgaggcccaaaagagaactgcagccggcataatgaaaaaccccacggtggatgggattgtagctatcgacctggatccagtggtctatgacgccaagtttgaaaaacagctaggacagatcatgctgctcattctttgtacctctcagatcctgttgatgaggacaacttgggcactgtgcgagtcaataaccctcgctacaggccctctgaccactttatgggagggtagccccgggaagttctggaatacgacaattgccgtttccatggcgaacatcttccgcggaagttaccttgccggcgcaggtctggctttttctctcatgaaaagcctaggcgggggacggcgaggcaccggggcccaaggagaaactctgggcgagaaatggaagagacagttgaatcagctgtcaaaatccgagttcaacacctataagaggagtggtattatggaggtggaccgcagcgaagcaaaagaggggctcaagcggggagagacaactaagcacgctgtctctagaggcaccgccaaacttcgttggtttgtggaaaggaatctggtaaagccagagggtaaagtgatcgatttgggctgtgggcggggaggctggtcctactattgcgccgggctgaagaaagttacagaagtgaagggatacacgaaaggcggtcctgggcacgaggaacccataccgatggcgacctacggatggaacctcgtcaagttacattcaggcaaggacgtgttctttatcccacctgagaaatgtgatactctgctttgcgacattggcgagagctcgcccaatccaacaatcgaagaggggcgcaccctgcgagtcctaaagatggtggaaccctggctcagaggaaaccagttctgtattaaaatcctgaatccttatatgccgtctgttgtagagactttggagcaaatgcagaggaagcacggtggcatgctggtgcggaaccccctcagtcgcaattccacacatgaaatgtactgggtcagctgcgggaccggaaacattgtgtcagctgttaatatgacgtccagaatgcttctgaacaggtttaccatggcacaccgaaaaccaacatatgagcgggatgtggacttaggcgccggtactcgtcacgtcgctgtggaacctgaggtagccaacctggatatcatagggcagagaattgaaaatatcaagcatgagcacaagtctacctggcattacgacgaggataacccctataaaacatgggcataccacggaagctatgaagtgaagcctagtggctccgccagctctatggttaatggcgtcgtgaaattgctcactaagccatgggacgtgatccccatggtcacccagattgctatgacagataccactcctttcgggcaacagcgcgtttttaaagagaaggtggacacgaggacaccaaaggcgaaacggggaaccgcccagataatggaagtaactgcaaagtggctgtggggtttcctatcaagaaacaaaaagccccgcatctgtaccagggaggaatttacacgaaaagtgcggagtaatgctgccattggcgcagtcttcgtggacgagaaccaatggaactccgccaaggaggctgttgaagatgagagattttgggaccttgtgcatagggaacgcgagctgcacaagcaggggaaatgcgccacgtgcgtctacaacatgatgggaaagcgtgagaagaagctcggcgagttcggtaaagcgaaggggagccgggcaatctggtacatgtggctgggagccagattcttggagtttgaagctctgggcttcatgaatgaggatcactggttttctagggaaaactcgctctcaggcgtggagggggagggacttcataaactgggttatattttacgcgacatcagcaagataccgggcgggaatatgtacgccgatgacaccgcaggatgggatactcgaatcacagaagacgatctgcagaacgaggctaagattaccgacatcatggaacctgagcacgccttgctcgctaaatccattttcaagctgacttatcagaataaagtagttcgggtgcaaagaccagccaagaacggcacagtcatggatgtgatcagtaggcgcgaccagagaggttctggacaggtgggaacctacggcctaaatacatttactaacatggaagcacagcttatacggcaaatggagagcgagggcattttctccccctcagaactggagacccctaacctcgcggggagggtcctggattggttggaaaaacatggagccgagcgtttaaagcgaatggctatcagtggtgacgactgtgttgtgaagccaatcgatgaccgctttgccacggcactgaccgctctcaatgatatgggcaaagtaagaaaggacattccccagtgggaaccgtctaaagggtggaacgattggcaacaggtgcctttctgcagccaccactttcatcaacttataatgaaggacggacgggagatcgtcgtgccctgtaggaatcaggatgagctggttggccgcgccagagtgtcccagggtgcagggtggtcactacgggaaacagcctgcctgggaaaaagctatgcgcagatgtggcaactcatgtacttccacaggcgagacttgcgtctggctgccaacgcaatttgttctgccgtcccagtggattgggtacctacttccagaaccacatggagtatccatgctcaccatcagtggatgactaccgaggacatgcttagcgtttggaatcgcgtgtggattgaagagaacccctggatggaagataagacgcacatctcgtcctggggcgacgtcccatatctgggcaagcgggaggaccagtggtgcgggtctctcataggattaacagccagggcaacctgggctactaatatccaagtggccattaaccaggttagacgcctgatcggtaatgagaactacttggattacatgacatcaatgaaacggtttaagaatgaaagcgaccccgagggcgcgctgtggtga

SEQ ID NO: 13692 - RNA, 9879 nt, synthetic construct
  misc_feature 1..9879: note = derived and/or modified CDS sequence (opt3) from DENV-1__FJ410257__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagctgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccgtgctgaggaaactttgcattgaagctaagatctctaatacgaccacagatagccggtgtccaactcaaggagaggccaccctggtcgaagagcaggacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatgtgtactggaagcttcaaactggagaaggaagtcgctgagacccagcacggtacggtgcttgttcagataaagtacgagggcacagacgcgccttgcaaaatcccattcaccactcaagatgaaaagggggtgacacagaacggacgcttgattaccgcaaatcccatcgtaactgacaaagagaagcctgtcaacatagaagccgagccaccctttggcgagtcgtatattgtgatcggtgctggggaaaaagccctgaagctctcttggttcaagaaaggctcctcaatcggaaagatgtttgaggcaaccgccagaggcgctaggcggatggccattctgggggatacagcatgggacttcggaagtatcggtggcgtttttacgagcgtggggaaacttgtccatcagattttcggaaccgcgtacggcgtgctgttttccggtgtatcttggactatgaagatagggatcggcgtgttgctcacatggctgggattaaatagccgatcaaccagtctgtccatgacatgtattgctgttggcctagtcactctctacctgggggtgatggtgcaggccgatagcggatgcgtcatcaactggaaaggccgcgaacttaagtgtggttctgggatcttcgttaccaatgaggtgcacacgtggacagaacaatataagtttcaggcagactcaccgaaaagattgagtgccgctattggaaaggcctgggaggagggcgtgtgcggtataaggagcgcaacccggctggaaaacatcatgtggaaacagatttccaacgagctcaatcatatcctgttagaaaacgacatgaagctgactgtagtcgtgggcgatgttgctgggattcttggacagggcaaaaagatgatccgccctcaacccatggagtacaaatattcttggaagtcgtgggggaaggccaaaataatcggagcggacgcccagaataccacattcattatcgatggcccaaacactcctgaatgtcccgacgatcagagagcttggaatatttgggaggtggaggactacggttttgggatcttcaccacaaacatatggttgaagctcagggatagctatacgcaggtctgcgaccaccgtctgatgtccgcagccattaaagattcaaaggctgtgcacgccgacatgggatactggatcgaaagtgagaaaaatgaaacctggaagctagcacgggcgtcttttattgaggttaagacttgtatctggccaaaaagccatacactgtggtccaacggcgtgctcgaatcagagatgataatccccaagatttatggtggccctatcagccaacacaattaccgaccagggtacttcacccagactgccggaccgtggcatctgggcaaacttgagttggatttcgacctgtgcgaagggacaaccgtagtcgtggatgagcactgcggaaacagaggcccctctttaaggacgactaccgtgacaggtaagattatccacgaatggtgttgccgctcctgtaccctccctccactgcggtttagaggggaggacggatgctggtatggcatggagataaggcccgtcaaagaaaaggaggaaaatcttgttaagagtatggtgagcgctggttctggcgaggtagactccttctcactggggttgctctgtattagtatcatgatcgaagaggtgatgcgcagccgatggtcgcggaaaatgctgatgactggaacactagccgtctttttcctgctcattatgggccagctgacctggaacgatcttatccgtttgtgcattatggtgggggcaaatgcttccgacagaatgggaatgggcacaacttacctggccttaatggcaacctttaagatgaggcctatgttcgccgttggtctcctgtttcgccggcttacgtctagagaggtgctgctactcacaatagggctgagcttggtcgcttcagtggaactgccaaacagtttagaggaactcggagatggcctggcgatgggcatcatgattcttaaactgttgaccgacttccaatcccatcagctctgggccactctgctatctctgacctttatcaagacaactttcagccttcactatgcatggaaaaccatggctatggttctctccattgtgtcactgtttcccttgtgtctgagcacgacaagtcagaagaccacttggttaccggtcctcctggggtctcttggatgcaagcctctgacaatgttcttgatcgccgagaataaaatatggggtaggaagtcctggccactcaacgaaggcatcatggccgtagggattgtgagcatcctgctatcgtcactgcttaaaaacgatgttcccctcgctggacctctgattgcaggcggtatgttgatcgcctgttacgtgatatctgggagttccgcggacttaagcctggagaaggctgccgaggtctcttgggaagaggaagcagagcatagcggagcctcccacaatattctcgtggaagtacaggatgacggcaccatgaaaatcaaggatgaggagcgagacgatactctgacaatccttctgaaagctaccttgctagcagtgtcaggcgtctatcccctgagtattccagccacgctctttgtttggtacttctggcaaaagaagaaacagcgcagcggggtgctgtgggacactccttctcccccagaagtggagcgggcggtccttgatgacggaatatatagaatcatgcagaggggtttactgggccgttcccaggtgggggttggagtattccaagaaaacgtgtttcataccatgtggcacgtcacacgcggcgctgtgctcatgtaccagggtaagcggttggagccgtcatgggccagtgttaaaaaggacctgattagctacgggggaggctggagactcaggggctcctggaataccggggaggaagtgcaggtcatcgcagtggagcctggaaaaaaccccaagaatgtacagacagccccaggtactttcaagacccccgaaggcgaggtcggggctattgccctggattttaaacctggaacgtctggctcgccaatcgtgaaccgagaaggtaagatagttgggctttatggaaatggcgtggtcacaactagcggcacctacgtgtcagcaatcgctcaagccaaagcgtcccaggaggggcccctgcctgagattgaagacgaggttttccggaagcgcaacttgacaatcatggatctacacccgggaagtggtaaaaccagaaggtatctgccagccattgtgcgggaagcaatcaagcgaaagctcagaactttaatactggctcccacccgcgtcgtggcctctgagatggctgaagcacttaaaggcatgcctattaggtaccagacaacggccgtaaagagcgagcatactgggaaagagatcgtggacctgatgtgccacgccacctttacaatgcgtctcttgtccccagttcgggtccccaattataacatgatcattatggatgaagctcatttcaccgacccttcatctatcgcggcaagaggatacataagcactagggtgggcatgggtgaggccgctgccatttttatgacagcaaccccgcccgggagtgtggaagccttcccacaatccaatgctgtcatccaggatgaggaacgcgacattcctgagcgaagctggaactctggatatgagtggatcacggatttttcaggcaagactgtatggttcgtgccctccataaaaagtggcaatgacattgcgaactgtctgagaaagaatgggaagcgggttatccagctcagcaggaaaacatttgataccgaataccagaagaccaaaaacaacgactgggactacgtggtcactacagatatctcggagatgggagccaatttccgcgcagaccgtgtgattgatccaagacggtgcctgaagcctgttatccttaaagacggtcccgaaagggtgattctagctggcccaatgccggtcaccgtggcctctgcagcccaacgccgagggagaataggacggaactataataaggagggcgatcagtacatctatatgggtcagcctctgaacaatgacgaggatcacgctcattggacagaagccaagatgttgttagacaacattaatactcccgaggggatcatcccagcgctgttcgaacccgagagggaaaaatccgcagccgtagatggcgagtaccgcctcagaggagaggctaggaagacgtttgtggaactgatgcggcgtggcgaccttcctgtttggctgagctataaagtcgcctcagaggggttccagtacagtgatcgccgatggtgctttgacggagaaagaaacaatcaagtgctcgaggaaaacatggatgtggagatttggaccaaggagggtgacaggaaaaagttgcggccacgctggctggacgctagaacatattctgatcccctagcactgagggaactcaaagagttcgccgctggccggcgatccgtcagcggggaccttatactggaaatcggaaagttacctcagcacttgactcagagagcccagaatgcactggataacctcgttatgctgcacaattcagagcaaggcggtcgcgcgtacaggcatgccatggaagagcttccggacaccattgagacactgatgctcttggctctgatcgccgtgttaaccgggggcgtaactctatttttcctgagtggacggggcctcgggaagacgagcattggacttctgtgtgtgatggcatcctctgtcttgctgtggatggctagcgtggaaccacactggatcgccgcatccataatcctcgagtttttcctgatggttcttctcattcccgaacctgatcgtcagagaaccccccaggacaaccagctggcctacgtggtcatcggtttgctgtttatgattttaacagtagctgcgaatgagatgggcctactggagactaccaaaaaggatctcgggatcggacatgtggccgttgaaaaccaccaccatgcagctatgcttgacgtggatctgcacccagcctcagcctggacattgtatgcagtcgctaccactataattacacctatgatgaggcatacgatcgagaacaccactgccaatatttctctgacagcgatcgctaaccaagccgcaatactcatgggcctggacaaaggttggcccatcagtaagatggatattggggtgccacttttagccctgggctgctactcgcaggtcaatcctctcaccttgaccgctgcagtgctgatgctagttgcccactatgcgatcattggaccgggcctgcaggctaaagccacacgcgaagcacaaaagcggactgccgctgggatcatgaagaaccccacggtggacggaatagtagccattgatctcgacccagtggtctacgacgcaaaattcgagaagcagcttggccagatcatgctgttgatcctgtgtaccagccagattctcctgatgcgaacaacttgggctttatgcgaatccatcacccttgccacaggtcctctgaccactctctgggaggggtctcccggaaaattttggaatacgacaatagcggtttcaatggccaacattttcagaggcagctatctagcaggtgctggcctggccttttccttgatgaagagtctggggggaggcaggcgcgggaccggagcacaaggcgagactctcggtgaaaaatggaagcggcagcttaatcagctgtctaagagcgagttcaacacctacaaaagatcagggatcatggaagtggatcgttccgaggctaaggaaggattgaaaaggggcgagacaactaagcatgccgtcagtcggggtaccgccaaactgcgctggttcgtggagcgaaatctcgtaaagccagaaggcaaggtgattgacttagggtgtggaagaggcgggtggagctattactgcgcgggactgaaaaaggttacagaggtgaaaggctacacgaagggtgggcctggacacgaagagcccatcccgatggctacctatggctggaaccttgtcaaactgcactctggcaaggatgtgtttttcataccacctgaaaaatgtgacactctactctgcgatatcggggagtcctcacccaatccaacaattgaggaaggaaggaccctgcgggtcttgaagatggtggagccctggctgcgcggtaaccagttttgtatcaagattctcaatccttacatgccgagcgttgtagaaactcttgagcaaatgcagagaaaacatggcgggatgctggtgaggaaccccttatcgcgaaattctacacacgagatgtattgggtcagttgcggaaccggcaacatcgtgtccgcagttaatatgacgagccggatgctgttgaaccgtttcaccatggcccatagaaagccaacatacgaacgcgacgtggatctcggtactgggaccaggcacgtcgctgtggagcctgaagtagccaacctggacattatcggacagcggatagagaatattaaacacgaacataagtcaacatggcactatgatgaggacaacccctacaaaacttgggcatatcatggctcctacgaggtgaagccttctggcagcgccagttccatggttaatggggtcgtgaagctacttaccaaaccatgggatgtgatccccatggtcacacagatcgctatgaccgacactacgccttttggacaacagagagttttcaaggaaaaagtggacacacgcaccccaaaggcgaaaaggggtactgcccagattatggaggtaaccgcacgatggctgtggggctttctcagccggaacaagaagcccagaatatgtacaagggaagagttcacgcgcaaagtgcgttctaatgctgccatcggggcagtctttgtggatgaaaaccaatggaattcagccaaggaggctgttgaggacgaacggttctgggatctggtgcacagagagagggaattgcataaacagggaaagtgcgccacctgcgtctacaacatgatgggcaaacgcgagaagaagctgggtgaatttgggaaagcgaagggaagtcgagcaatttggtatatgtggctcggcgcccggttccttgagtttgaggctctgggcttcatgaatgaagaccactggttctccagagagaacagcttatctggggtggaaggagagggtctgcacaaattgggctacatcctcagggatatttcgaagatcccggggggaaatatgtatgccgacgatactgcaggctgggacacacgcataaccgaggatgacctgcagaacgaagctaaaatcactgatattatggagcctgaacatgccctacttgctaaggccatctttaaactgacataccagaataaggtagttagagtgcaacggccagcaaagaacggtaccgtcatggacgtgatttcaaggcgtgatcagcgagggagcggacaggtgggcacatatggcctcaatactttcaccaacatggaggcgcagctgatccgccaaatggaatccgaggggatatttagtccctctgagttggaaacgcctaacttagccgagagagctctggactggctcgaaaaatacggagtcgagcggcttaagaggatggccattagcggtgacgattgtgttgtgaaaccaatcgacgatcgcttcgcaaccgctctgacagccctaaatgacatgggcaaggtaagaaaagatatcccccagtgggaaccgtccaaggggtggaacgactggcagcaggtgcctttttgctcacaccatttccaccaactgattatgaaggatggacgggagatagtcgtgccctgtaggaatcaggacgagctcgttggccgagcacgtgtgagtcagggtgccgggtggtctttgagagaaactgcgtgcctgggaaaaagctatgctcagatgtggcaacttatgtactttcaccgccgggatctgaggctcgccgcaaacgccatctgttccgctgtcccagtggactgggtacctacctcaagaacaacttggagcattcatgcccaccatcagtggatgaccacggaggatatgttatctgtttggaatcgcgtgtggatcgaagagaacccctggatggaagacaagacacacatttccagttgggaggacgtcccatacctgggcaaacgggaggatcagtggtgcggcagcttgatcgggctgaccgcaagggctacttgggccacaaatatacaagtggcgatcaaccaggttcgaagactcattggaaatgaaaactatcttgactacatgacctcgatgaagcggttcaaaaatgagtccgatcccgaaggtgctctgtggtga

SEQ ID NO: 13693 - RNA, 9879 nt, synthetic construct
  misc_feature 1..9879: note = derived and/or modified CDS sequence (opt3) from DENV-1__FJ461332__SS-prME
  source 1..9879: mol_type = other RNA
agcgtgaccatgctgctcatgcttatgcccactgcactggctttccacttgactacgagaggaggggagcctcatatgatcgtctccaagcaggaaaggggaaaatctttactgtttaagacctcagccggtgttaacatgtgcacattaattgccatggacctcggagagctgtgtgaagatactatgacctacaaatgcccacggattacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaattgctcaagacagaggtgaccaaccctgccgtgctgaggaaactttgcattgaagctaagatctctaatacgaccacagatagccggtgtccaactcaaggagaggccaccctggtcgaggaacaggacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatgtgtactggcagcttcaaactggagaaggaagtcgctgagacccagcacggtacggtgcttgttcagataaagtacgagggcacagacgcgccttgcaaaatcccattctcgacccaagatgaaaagggggtgactcagaacggacgcttgattacagcaaatcccatcgtaaccgacaaagagaagcctgtcaacatagaagccgagccaccctttggcgagtcttatattgtgatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtttttacatccgtggggaaacttattcatcagatattcggaacggcgtacggcgtcctgttttctggtgtgagctggaccatgaagatcgggattggcgtattgctcacttggctgggattaaattcacgaagtacatccctgagcatgacctgtatcgctgtgggcctagttacactctacctgggggtcatggtgcaggccgattctggatgcgtgatcaactggaaaggccgcgaacttaagtgtggttcagggattttcgtcactaatgaggttcacacctggacggaacaatataagtttcaggcagacagtccgaaaagattgagcgccgctataggaaaggcctgggaggagggcgtgtgcggtatcaggtccgcaacacggctggaaaacattatgtggaaacagatctctaacgagctcaatcatattctgttagaaaacgacatgaagctgaccgtggtagtcggcgatgtggctgggatccttggacagggcaaaaagatgatacgccctcaacccatggagtacaaatattcgtggaaaagctgggggaaggccaaaatcattggagcggacgcccagaatactaccttcatcattgatggcccaaacacacctgaatgtcccgacgatcagagagcttggaatatctgggaggttgaggactacggttttgggatattcactaccaacatttggttgaagctcagggattcctatacacaggtgtgcgaccaccgtctgatgtcagcagccatcaaagatagtaaggctgtccacgccgacatgggatactggattgaatctgagaaaaatgaaacgtggaagctagcacgggcgagctttatcgaggtgaagacctgtatatggccaaaatcccatactctgtggtcaaacggcgttctcgaaagcgagatgatcattcccaagatctatggtggccctatttctcaacacaattaccgaccagggtacttcacacagaccgccggaccgtggcatctgggcaaacttgagttggatttcgacctgtgcgaagggactacagtggtagtcgatgagcactgcggaaacagaggcccctccttaaggaccacgactgtgaccggtaagatcatacacgaatggtgttgccgcagttgtacactccctccactgcggtttagaggggaggacggatgctggtatggcatggagattaggcccgtgaaagaaaaggaggaaaatcttgtcaagagcatggtttctgctggttccggcgaggtggactcattcagtctggggttgctctgtatcagcatcatgattgaagaggtaatgcgctcgcgatggtcccggaaaatgctgatgaccggaactctagccgtgtttttcctgctcatcatgggccagctgacatggaacgatcttattcgtttgtgcataatggtcggggcaaatgcttttgacagaatgggaatgggcaccacatacctggccttaatggcaactttcaagatgaggcctatgtttgccgtgggtctcctgttccgccggcttacctctagagaggttctgctactcacgatcgggctgagcttggtggcttcagtcgaactgccaaacagtttagaggaactcggagatggcctggcgatgggcattatgatccttaaactgttgacagactttcaatcccatcagctctgggccaccctgctatctctgactttcattaagaccacatttagccttcactatgcatggaaaactatggctatggtgctctccatcgtttcactgttccccttgtgtctgagcaccacgagtcagaagacaacctggttaccggtgctcctggggtctcttggatgcaagcctctgactatgtttttgatagccgagaataaaatctggggtaggaagtcctggccactcaacgaaggcattatggccgtcgggatcgtaagcattctgctatcgtcactgcttaaaaacgatgtgcccctcgctggacctctgatcgcaggcggtatgttgatagcctgttacgttatttctgggagttccgcggacttaagcctggagaaggctgccgaggtgtcttgggaagaggaagcagagcatagcggagcctcccacaatatcctcgtcgaagtgcaggatgacggcacaatgaaaatcaaggatgaggagcgagacgataccctgactattcttctgaaagctacattgctagcagtatcaggcgtgtatcccctgagtataccagccaccctcttcgtctggtacttctggcaaaagaagaaacagcgcagcggggttctgtgggacacgccttctcccccagtggtggaacgggcggtccttgatgacggaatctatagaattatgcagaggggtttactgggccgttcccaggtgggggttggagtatttcaagagaacgtgttccatactatgtggcacgtcacccgcggcgctgtgctcatgtaccagggtaagcggttggaaccgtcatgggccagtgttaaaaaggacctgatcagctacgggggaggctggagactcaggggctcctggaatacaggggaggaggtgcaggtcattgcagtggaacctggcaaaaatcccaagaatgtacagaccgccccaggtacatttaagactcccgagggcgaagtcggggctatcgccctggatttcaaacctggaacctctggctcgccaatagtgaaccgagagggtaagatcgttgggctttatggaaatggcgtggtcacgacaagcggcacttacgtgtcagcaattgctcaagccaaagcgtcccaggaagggcccctgcctgagatcgaggacgaagtttttcggaagcgcaacttgaccattatggatctacacccgggaagtggtaaaacaagaaggtatctgccagccatcgtgcgggaggcaataaagcgaaagctcagaaccttaattctggctcccactcgcgtcgtggcctctgaaatggctgaggcacttaaaggcatgcctatcaggtaccagaccacagccgtaaagagcgaacatacggggaaagagatcgtggacctgatgtgccacgccactttcaccatgcgtctcttgtccccagttcgggtccccaattataacatgattatcatggatgaggctcattttacagacccttcatctatagcggcaagaggatacattagcaccagggtgggcatgggtgaagccgctgccatcttcatgactgcaacaccgcccgggagtgtggaggcctttccacaatccaatgctgtcattcaggatgaggaacgcgacatccctgaacgaagctggaactctggacacgagtggataaccgatttccccggcaagacggtatggtttgtgccatcaattaaatccggcaatgacatcgcgaactgtctgagaaagaatgggaagcgggttatccagctcagtaggaaaactttcgatacagagtatcagaagaccaaaaacaacgactgggactacgtggtcaccactgatattagcgaaatgggagccaatttccgcgcagaccgtgtgatcgatcctagacggtgcctgaagcccgttattcttaaagacggtccagagagggtgatactagctggcccgatgcctgtcacagtggcctcggcagcccaacgccgagggagaatcggacggaaccataataaggaaggcgatcagtacatttatatgggtcagcccctgaacaatgacgaggatcacgctcactggaccgaggccaagatgttgttagacaacatcaatacaccagaagggatcattcccgcgctgtttgagcctgaaagggagaaatctgcagccgtagatggcgaataccgcctcagaggagaggctaggaagactttcgtggagctgatgcggcgtggcgaccttccagtttggctgtcctataaagtcgccagcgaagggtttcagtactcagatcgccgatggtgcttcgacggagagagaaacaatcaagtgctcgaagagaacatggatgtggaaatatggacgaaggagggtgagaggaaaaagttgcggccccgctggctggacgctagaacctatagtgaccctctagcactgagggaatttaaagagttcgccgctggccggcgatctgtctccggggatctcatccttgaaattggaaagctgccgcagcatttaacacagagagcccagaatgcattggacaacctggttatgctccacaatagcgagcaaggcggtcgcgcgtacaggcatgccatggaggaactgccagatactatcgagacccttatgctgctcgctttgattgccgtgctgacagggggcgtaaccttatttttcctatcaggacggggcctggggaagacaagtatcggactcctttgtgtgatggcaagctccgtcctgttgtggatggcttctgtggaaccccactggatagccgcaagcatcattctggagtttttcctcatggttctgcttatccctgaacccgaccgtcagagaacgccacaggataaccagctcgcctatgtggtcattggtctgttgtttatgatcctgaccgtagctgcgaatgagatgggcttactagagacaactaaaaaggacctggggataggacacgtggccgttgaaaaccatcaccatgcagctatgctcgatgtggaccttcaccctgcctccgcctggaccctgtacgcagtcgctacaaccattatcactcccatgatgaggcatacaattgagaacacgaccgccaatatctcattgactgcgatagctaaccaagccgcaatcctgatgggcctcgataaaggttggccaatttctaagatggacatcggggtgcctctgcttgccttaggctgctacagtcaggtcaatccgctgacactcaccgctgcagtgttgatgctggttgcccactatgcgattatcggacccggcctacaggctaaagccacccgcgaagcacaaaagcggacagccgctgggataatgaagaacccaactgtggatggaattgtagccatcgacctggatcctgtggtctacgacgttaaattcgagaagcagctcggccagatcatgcttctgattttgtgtacgtcgcagatcctgctcatgcgaaccacatgggcactgtgcgaaagcataactttagctaccggtccccttacaaccctgtgggaggggtccccaggaaaattttggaatactacgattgccgtgtctatggcgaacatcttcagaggctcatatctcgccggtgcaggcctagctttcagcctgatgaagtccctagggggaggcaggcgcgggacaggagcccaaggcgagaccctgggtgaaaaatggaagcggcagctcaatcagcttagtaagtctgagtttaacacttacaaaagaagcgggattatggaagtcgaccgttcagaggcaaaggaaggactgaaaaggggcgagaccacaaagcacgctgtgtcccggggtactgccaaattgcgctggttcgtagagcgaaatctggtgaagcctgaaggcaaggttatcgatctcgggtgtggaagaggcgggtggagttattactgcgccggactaaagaaggtgaccgaggtcaaaggctatacaaagggtgggcccggacatgaggaaccgataccaatggcgacgtacggctggaacctggtgaaacttcacagcggcaaggacgtctttttcatccctcccgaaaaatgtgataccctgctatgcgacattggggagtcttccccaaatcccactatcgaggaaggaaggacactccgggtgctgaagatggttgagccttggttgcgcggtaaccagttttgtattaagatcctgaatccgtacatgccctcagtagtggaaaccctcgagcaaatgcagagaaaacatggcgggatgcttgtcaggaacccactgagccgaaattcgactcacgagatgtattgggtgtcttgcggaacaggcaacattgttagtgctgtgaatatgacctcccggatgttactgaaccgtttcacgatggcacacagaaagcctacctacgaacgcgatgtcgacttgggtacagggactaggcatgtggccgtagagcccgaagtggctaacctcgatatcataggacagcggattgagaatatcaaacacgaacataagagcacctggcactatgacgaggataacccttacaaaacatgggcctatcatggctcatacgaggttaagccatccggctctgcaagcagtatggtcaatggggtggtgaagctgctaactaaaccctgggacgtcatccctatggttacccagattgccatgacagataccactccatttggacaacagagagtgttcaaggaaaaagtagacacgcgcacacccaaggctaaaaggggtaccgcgcagataatggaggtgactgcccgatggctttggggctttctgtcccggaacaagaagccgagaatctgtaccagggaagagttcacacgcaaagtccgtagcaatgcagctattggggccgtgtttgttgacgaaaaccaatggaactctgcaaaggaggccgtggaggatgaacggttctgggacctcgtccacagagagagggaactgcacaaacagggaaagtgcgctacgtgcgtgtataacatgatgggcaaacgcgagaagaagttgggtgaatttgggaaagccaagggatcacgagcgatctggtacatgtggctgggcgcacggttcctcgagttcgaggcccttggctttatgaatgaagatcattggttcagtagagagaactccctgagcggggtagaaggagagggtttacacaaactgggctacattttgagggacatctctaagatacctgggggaaatatgtatgctgatgacaccgccggctgggatactcgcatcacagaggacgatctccagaacgaagcaaaaattaccgacatcatggagccagaacatgctctgctagccaaggctatttttaaacttacttaccagaataaggttgtgagagtccaacggcccgccaagaacggtacagtgatggatgtgatctcgaggcgtgaccagcgagggtcaggacaggtcggcacctatggcctgaatacattcactaacatggaggcacagctcatacgccaaatggaaagcgaggggatattttcccctagtgagctggaaaccccaaacttggcggagagagccttagattggctggaaaaatacggagttgagcggctcaagaggatggctatctctggtgacgactgtgtggtaaaacccatcgatgaccgcttcgccacggcacttaccgctctgaatgatatgggcaaggtgagaaaagacattccgcagtgggaacctagcaaggggtggaacgattggcagcaggtccccttttgctcccaccacttccatcaactaataatgaaggacggacgggagatcgtggttccatgtaggaatcaggatgagctggtgggccgagcccgtgtctcacagggtgcagggtggagtctcagagaaacagcctgcttgggaaaatcttatgcgcagatgtggcaactgatgtactttcaccgccgggaccttaggctggctgccaacgcaatttgtagcgccgtgcctgtagattgggttcccacttccagaaccacatggtcaatccatgctcaccatcagtggatgactaccgaggacatgctcagcgtgtggaatcgcgtctggattgaagagaacccatggatggaagataagacgcacatctcttcctgggaggacgtgccctatttaggcaaacgggaggaccagtggtgcggcagtctgatagggttgacagccagggcaacctgggctactaatatccaagttgccattaaccaggtgcgaagactgatcggaaatgaaaactacctcgattacatgacaagcatgaagcggttcaaaaatgagtcggaccctgaaggtgcgctttggtga

SEQ ID NO: 13694 - RNA, 9879 nt, synthetic construct
  misc_feature 1..9879: note = derived and/or modified CDS sequence (opt3) from DENV-1__FJ461333__SS-prME
  source 1..9879: mol_type = other RNA
agcgtgaccatgctgctcatgcttatgcccacagccctggctttccacttgactacgagaggaggggagcctcatatggtcgtttccaagcaagaaagaggaaaatctttactgtttaagacctcagcgggtgtgaatatgtgcacactgatcgccatggacctcggcgagctgtgtgaagatactatgacctacaaatgcccacggattacagaggcggaaccggacgatgtagactgttggtgcaatgctaccgatacttgggtgacatatgggacctgtagtcaaacgggagagcaccgccgagacaagcgtagcgtcgcccttgcaccccatgtgggcctgggtttggagactagaaccgaaacatggatgtcctctgagggggcctggaaacagatacagagggttgaaacttgggctctccggcaccctggattcaccgtgatcgcactgtttctggcccatgctattggcacatcgatcacccagaagggcattatcttcatactcttaatgctggtcacgccatcaatggccatgcgctgcgtggggatcggaagcagagattttgtagagggtcttagtggcgcgacttgggttgacgtggtcttggagcacgggtcctgtgtgacaaccatggcaaaggataaacccactctggacattgaactgctcaagacagaggtgaccaaccctgccatcctgaggaaactttgcattgaagctaagatctctaatacgaccacagatagccggtgtccaactcaaggagaggccaccctggtcgaagaacaagacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatgtgtactggtagcttcaaactggagaaggaagtcgctgagacccagcacggaacggtgcttgttcagataaagtacgagggcacagacgcgccttgcaaaatcccattctcgacccaagatgaaaagggggtgactcagaacggacgcttgattacagcaaatcccatcgtaaccgacaaagagaagcctgtcaacatagaagccgagccaccctttggcgagtcttatattgtgatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtttttacatccgtggggaaacttgtccatcagattttcggaacggcgtacggcgtgctgttttctggtgtaagctggaccatgaagatagggttgggcgtgctcctgacttggttaggactaaattcacgaagtacatccctaagcatgacctgtatcgctgttggcctcgtcacactgtaccttggggtgatggtgcaggccgattctggatgcgtcattaactggaaaggccgcgaattgaagtgtggttcagggatcttcgttactaatgaggtgcacacctggacggaacaatataagtttcaggcagacagtccgaaaagactgagcgccgctatcggaaaggcctgggaggagggcgtgtgcggtattaggtccgcaacacggctcgaaaacgtaatgtggaaacagatatctaacgagctgaatcatatcttactggaaaacgacatgaagttcaccgtcgtggttggcgatgtggctgggattcttgcccagggcaaaaagatgatccgccctcaacccatggagcacaaatactcgtggaaaagctggggcaaggcgaagattatcggggccgacgtccagaatactacctttataatcgatggaccaaacacacctgaatgtcccgacgatcagagagcttggaatatttgggaggtggaggactatggcttcggtatctttactaccaacatttggttgaagctcagggattcctacacacaggtttgcgaccaccgtctgatgtcagcagccatcaaagatagtaaggctgtgcatgccgacatggggtattggatagaatctgagaaaaatgaaacgtggaagctagcacgggcgagcttcattgaggtaaagacctgtatctggccaaaatcccacactctgtggtcaaacggagtcctcgaaagcgagatgattatccccaagatatacggcggtcctatctctcaacataattatcgaccaggctacttcacacagaccgccgggccgtggcacctgggaaaacttgagttggattttgacctgtgcgaaggcactacagtggtggtcgatgagcactgcgggaacagaggaccctccttaaggaccacgactgttaccggcaagattatccatgaatggtgttgccgcagttgtacactccctccactgcggttcagaggtgaggacgggtgctggtacggaatggagattaggcccgtgaaagaaaaggaggaaaatcttgtaaagagcatggtgtctgctggctccggtgaggtcgactcatttagtctgggcttgctctgtatcagcataatgattgaagaggtgatgcgctcgcgatggtcccggaaaatgctgatgaccgggactctagccgttttcctgctcctgatcatgggacagcttacatggaacgatttgatccgtctgtgcattatggtgggcgcaaatgcttctgacagaatggggatgggaaccacatatttagccctcatggcaacttttaagatgaggcctatgttcgccgtcggcctgctttttcgccggctgaccagcagagaggtgctactcctgacgatcggtttgtcactggttgctagtgtggaattaccaaactccctcgaggaactgggggatggacttgcgatgggcattatgatactgaaattgctcacagacttccaatctcaccagctgtgggccaccctactgagccttacttttatcaagaccacattctccctccattacgcatggaaaactatggctatggtcctgtcaattgtatccttgtttcccctgtgtttaagtaccacgtctcagaagacaacctggctcccggtgctgcttggctccctggggtgcaagcctttgactatgttcctcatcgccgagaataaaatttggggaaggcgaagctggccactgaacgaaggtatcatggccgttggcatagtgtcgatcctactgtcatctcttctcaagaacgatgtccccctggctgggcctttgattgcaggaggcatgttaatcgcctgttatgtgattagtggttccagcgcggacctgtctctcgagaaagctgccgaggtaagctgggaagaggaagcagagcactccggggcctcacataatatcctggtggaagtccaggatgacggaacaatgaagataaaagatgaggagcgcgacgatacccttactattctgttgaaggctacactactggcagttagtggcgtgtaccccctcagcatcccagccaccctgtttgtgtggtatttctggcagaaaaagaagcagcggtctggcgtcctttgggacacgccttcacccccagaagtggagagagcggttttagatgacgggatctacaggattatgcagcgtggactgctcggtcgcagccaggtaggcgtgggggtcttccaagaaaacgtgtttcacactatgtggcacgttacccggggagctgtgttgatgtatcagggcaaaagactggagccgagttgggccagcgtcaagaaagacctcatatcctacggtgggggatggaggctgcagggctcttggaatacaggcgaggaagtgcaggtaatcgcagtcgagcctgggaagaaccccaaaaatgtgcaaaccgccccaggaacattcaagactcccgaaggtgaggttggcgctattgcccttgattttaagcctgggacctcgggaagcccaatcgtgaaccgagaaggcaaaattgtcggtctgtacgggaatggagtggttacgacatcaggcacttatgtgtccgcaatcgctcaggccaaggcgagtcaggagggccccttgcctgagatagaagacgaggtcttccggaaacgcaacctaaccatcatggatctgcatccggggtctggaaagacaagaaggtacctcccagccattgtgcgggaagcaatcaaacgaaagttaagaaccctgattcttgctcccactcgcgtagtggccagcgagatggctgaagcactgaagggtatgcctatcaggtatcaaaccacagccgttaaatccgagcacacgggcaaggagatagtcgacctcatgtgccatgccacttttaccatgcgtttgctgtcaccagtgcgggtgcccaattacaacatgattatcatggatgaagctcacttcacagacccttctagcatcgcggcaagagggtatattagtaccagggtcggaatgggcgaggccgctgccatctttatgactgcaacaccgcccggttccgtagaagccttcccacagagcaatgctgtgatacaggatgaggaacgcgacattcctgagcgatcttggaactcagggtacgagtggatcaccgattttcccggaaaaacggtttggttcgtgccatccattaagagtggcaatgacatcgcgaactgtctcaggaaaaatggcaagcgggtcatacagctgagcaggaagacttttgatacagaatatcagaaaaccaagaacaacgactgggactacgtggttaccactgatatttcggagatgggggccaatttccgcgcagaccgtgtgatcgatcctagacggtgccttaaacccgtcatcctaaaggacggaccagaaagggtgattctggctggtccgatgcctgtaacagtggcctctgcagcccagcgccgaggcagaatcgggcggaaccataataaagagggagatcagtacatttatatgggccagcccttgaacaatgacgaggatcacgctcactggaccgaagccaagatgttactggacaacataaatacaccagagggtatcattcccgcactcttcgaacctgagagggaaaagtccgcagccatcgatggggagtaccgcctgagaggcgaggctaggaaaacttttgttgaacttatgcggcgtggagacctgccagtctggctcagctataaggtggcctcagagggcttccaatacagtgatcgccgatggtgctttgacggggaaagaaacaatcaggtgttggaggaaaacatggatgtcgagatctggacgaaagagggagaaaggaagaaactgcggccccgctggctagacgctagaacctattctgaccctctggcactcagggagttcaaggaatttgccgctggtcggcgatccgttagcggcgatcttattctggagatagggaaattaccgcagcatttgacacagagagcccaaaatgcactggacaacctcgtgatgctgcacaattcagaacagggaggccgcgcgtacaggcatgccatggaggagcttccagatactatcgaaaccctgatgctcttggctctgattgccgtattaacaggtggggtgaccctattctttctgagtggccggggactcggcaagactagcatcgggcttctgtgtgtcatggcatcctctgtgttgctgtggatggctagcgttgagccccactggattgccgcatccatcatactcgagttctttctgatggtgcttctcatccctgagcccgaccgtcagagaacgccacaggataaccaactggcctatgtcgtaattggattgctgttcatgatcttaaccgtggctgcgaatgagatgggtctactggaaacaactaagaaagacctcggcattgggcacgccgcagttggaaaccatcaccatgctgccatgcttgatgtggacctgcaccctgcctcagcatggaccttgtacgctgtcgccacaaccatcataactcccatgatgaggcatacaattgagaacacgaccgcgaatatctctctgactgctattgccaaccaggcagccatcctcatgggcctggataagggttggccaataagtaaaatggacatcggggtgcctcttttagctctgggctgctactcgcaggtcaatccgctcacattgaccgcagccgtgctgatgctagttgcgcactatgctattatcggacccggcctgcaagccaaggcaacccgcgaagcccagaaacggacagctgccgggattatgaagaacccaactgtggatggaatcgtagcaatagacctcgatcctgtggtctacgacgctaagtttgagaaacagcttggccagattatgctgttgatcctgtgtacgagccaaatcctcctgatgcgaaccacatgggccttatgcgaatccattactcttgcgaccggtcccctgacaaccctctgggaggggtctccaggaaagttctggaatactacgatcgccgtttcaatggcaaacatatttagaggcagctatctagctggtgccggcctggcattctccttgatgaaaagtctagggggaggcaggcgcgggacaggagctcagggcgagaccctcggtgaaaagtggaaacggcagcttaatcagctgtctaagagcgagttcaacacttacaagagatcagggattatggaagtggaccgttccgaggccaaagaaggattgaagaggggcgagaccacaaaacacgccgtcagtcggggtactgcgaagctgcgctggtttgtggagcgaaatctcgtaaaacctgaaggcaaggtgatcgatttagggtgtggaagaggcgggtggagctattactgcgctggactgaagaaagttaccgaggtgaagggctatacaaaaggtgggcccggacatgaagaaccgattccaatggcaacgtacggctggaaccttgtcaagctgcactctggcaaagacgtgttctttatccctcccgaaaagtgtgataccctactctgcgacataggggagtcctcaccaaatcccactatcgaggaaggaaggacactgcgggtcttgaaaatggtggagccttggctgcgcggtaaccaattctgtattaagatcctcaatccgtacatgcccagcgttgtagaaacccttgagcagatgcagagaaagcatggcgggatgctggtgaggaacccattatcgcgaaattctactcacgagatgtattgggtcagttgcggaacaggcaacattgtgtccgccgttaatatgaccagccggatgctgttgaaccgttttacgatggctcacagaaaacctacctacgaacgcgatgtggacctcggtgccgggacaaggcatgtcgcagtggagcccgaagtagccaacctggatatcattggacagcggatcgagaatataaagcacgaacataaatcaacttggcactatgacgaggataacccttacaagacctgggcttatcatggctcctacgaggtgaaaccatctggcagcgcgagttccatggttaatggggtcgtgaagctacttacaaagccctgggacgtgattcctatggtcactcaaatcgccatgaccgatacaaccccattcggacagcagagagtttttaaagaaaaggtggacactcgcacgcccaaagcaaagaggggtacagctcaaatcatggaggtaaccgccaaatggctgtggggcttcctcagccgaaacaagaagccgcggatttgtactagagaagagtttaccaggaaagtgcgctctaatgcagccataggggctgtcttcgtggacgaaaaccagtggaactcagccaaggaggcggttgaggatgaacgtttttgggacctggtgcaccgggagagagaattgcacaaacagggaaagtgcgcaacatgcgtctataacatgatgggcaaaagggagaagaagctgggtgagttcgggaaagccaagggaagtcgcgctatctggtacatgtggctcggcgcccgatttcttgagttcgaggcactgggcttcatgaatgaagatcattggttttcccgggagaacagcttatctggggtggaaggagagggtctgcacaaattgggctacattctcagagacatctcgaagattcctgggggaaatatgtatgctgatgacacggccggctgggataccaggatcactgaggacgatctgcagaacgaagctcgcataacagacatcatggagccagaacatgccctacttgcaaaatcaattttcaagctgacctaccaaaataaagtagttagagtgcagcggcccgcgaagaacggtactgtcatggatgtgatcagcaggcgtgaccagcgagggtccggacaggtgggcacatatggcctcaatacctttacaaacatggaggcccaactgattcgccagatggaaagtgaggggatcttctctcctagcgagttggaaactccaaacttagctgagagagtcctggattggctcgaaaagtacggagttgagcggcttaaaaggatggccatatccggtgacgactgtgtggtaaagcccattgatgaccgctttgcaaccgctctgacggccctaaatgatatgggcaaagtgagaaaggacatcccgcagtgggaaccttcaaaagggtggaacgattggcagcaagtccccttctgcagtcaccactttcatcagctgatcatgaaggacggacgggagattgtggttccatgtaggaatcaggatgagctcgtgggccgagcacgtgtctctcagggtgccgggtggagcttgagagaaaccgcgtgcctgggaaagtcctatgctcaaatgtggcagcttatgtacttccaccgccgggacctgaggctcgccgcaaacgccatatgttcagctgtgcctgtagattggatccccacaagcagaactacctggtctattcatgcccaccatcagtggatgacaactgaggacatgttatccgtttggaatcgcgtgtggatcgaagagaacccatggatggaagataaaacccacattagtagctggggcgacgtcccctatctgggcaagcgggaggaccaatggtgcgggtcgttgatcggactgacggcaagggctacatgggccaccaatgtgcaggttgcgataaaccaggtgcgaagactcatcggtaatgagaactaccttgattacatgacttccatgaaacggtttaagaatgaatctgaccctgagggcgctctgtggtga

SEQ ID NO: 13695 - RNA, 9879 nt, synthetic construct
  misc_feature 1..9879: note = derived and/or modified CDS sequence (opt3) from DENV-1__FJ410262__SS-prME
  source 1..9879: mol_type = other RNA
agcgtgaccatgctgctaatgcttatgcccaccgcactggctttccacttgactacgagaggcggggaacctcatatgatcgtctccaagcaggaaaggggaaaatctttactgtttaagacctcagccggtgttaacatgtgcacactaattgcaatggacctcggcgagttctgtgaagatactatgacctacaaatgcccgcggataacagaggcggaaccggacgatgtggactgttggtgcaatgctaccgatacttgggtaacatatgggacctgtagtcaaacgggagagcaccgccgagacaagcgtagcgtggcactggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaagacgcaaactttgtttgccgccgaacattcgtggatagaggctggggtaatgggtgtggactgtttggcaaaggctccttgataacttgcgctaagttcaagtgcgtaaccaaactcgaggggaagacagtgcagtacgaaaacctgaaatattcagtcattgtgaccgttcacactggagaccagcatcaagtgggtaatgagagtacggaacacggcacaaccgccactatcacaccccaggcgcctagcacagagattcagttaaccgactacggggccctgactctcgattgttctccaaggacaggacttgactttaacgaaatggtcctgttgacgatgaaggagaaatcctggctagtgcataagcagtggttcctggatctcccgctgccctggacctcaggcgcaagcacaagtcaagagacatggaatcggaaagaccttctggtaacctttaagacagctcacgccaagaaacaggaagttgtggtcttgggttctcaggagggggctatgcacactgccctcaccggcgcaacggaaatccaaacctccggaacaactaccatcttcgccggccatctgaagtgccgtttaaaaatggataagctgacactaaaagggatgagctatgtgatgtgtactggatcgttcaagctcgagaaggaagtcgctgagacccagcacggtacggtgctggttcagattaaatacgagggcacagacgcgccttgcaagataccattttctacccaggatgaaaaaggggtgactcaaaacggacgccttatcacagcaaatcccattgtaaccgacaaggagaaacctgtcaacatcgaagccgagccacccttcggcgagtcctatatagtgattggtgctggggaaaaggccttgaagctgtcatggtttaaaaagggcagtagcatcggaaaaatgttcgaggcaactgccagaggcgctaggcggatggccatcctcggggataccgcatgggactttggatccattggtggcgttttcacatctgtggggaagctggtccatcagatctttggaacggcgtacggcgtgcttttcagcggtgtatcatggaccatgaaaattgggataggcgtgctgttgacttggctcggactgaatagtcgatccactagcttatctatgacctgtatcgctgttggcctggtcacactatacctcggggtgatggtgcaggccgattcaggatgcgtcattaactggaagggccgcgaactgaagtgtggtagtgggatctttgttactaatgaggtgcacacctggacggaacagtataaattccaagcagacagcccgaagagactttccgccgctatcggaaaagcctgggaggagggcgtgtgcggtattaggtctgcaacacggttggaaaacataatgtggaagcagatctcgaacgagctgaatcatattctcctggaaaacgacatgaaatttaccgtagtcgtgggcgatgttgctgggatcttagcccagggaaagaaaatgattcgccctcagcccatggagtacaagtatagctggaagtcctggggcaaagcgaagatcataggggccgacgtgcaaaatactaccttcatcattgatggaccaaacacacctgaatgtcccgacgatcagagagcttggaatatctgggaggtcgaggactacggctttggtattttcactaccaacatctggctgaaacttagggattcatatacacaggtgtgcgaccaccgtttgatgagtgcagccataaaggattctaaagctgttcacgccgacatggggtactggattgaaagcgagaagaatgaaacgtggaagctcgcacgggcgtccttcatcgaggtgaaaacctgtatttggccaaagtcacatactctgtggagcaacggagtactagaatctgagatgatcatacccaaaatctatggcggtcctatttcccagcacaattaccgaccaggctactttacacaaaccgccgggccgtggcatctgggaaagctcgagctggatttcggcctttgcgaagggactacagtcgtggtggacgagcactgcggaaacagaggccccagtttgaggaccacgactgtcaccggtaaaatcattcacgaatggtgttgccgcagctgtacactgcctccattacggtttaagggggaggatggatgctggtatggcatggagatcagacccgttaaggaaaaagaggaaaatctcgtgaagtctatggtatccgctggttcaggcgaggtggacagtttcagcctggggcttctgtgtatatcgattatgatcgaagaggtcatgaggtcccgctggtctcgaaaaatgttgatgaccggaactctcgccgtgtttttcctgctaatcatgggccagctgacatggaacgacctcattcggctgtgcatcatggttggggcaaatgctagcgatcgtatgggaatgggcaccacataccttgccttgatggcaacttttaagatgagacctatgttcgccgtgggtctgttatttaggcgcctcacctcacgggaggtcctgcttctgacgattgggctaagtctcgtggcttccgttgaactgccaaactctttggaggaactgggagacggcttagcgatgggcataatgatcctcaaactgcttacagatttccagagccatcaactgtgggccaccttgctctccctgacttttattaagaccacattctcactacactatgcatggaagactatggctatggtgctgagcatcgtcagtctttttcccctctgtctgtctaccacgtcccagaaaacaacctggttgccggtactgttagggagcctcggatgcaagcctctgactatgttccttattgccgagaataaaatctggggtagaaagtcgtggccactgaacgaaggcataatggccgtggggatcgtttcaattttgctctctagtctgctcaagaatgacgtgcccctggctggacctcttatcgcaggcggtatgctcattgcctgttacgtcatctccgggagctctgcggatctgagcttggagaaggctgccgaggtgtcctgggaagaggaagcagagcattcaggagccagtcacaatatattagtagaagtgcaggacgatggcacaatgaaaattaaggacgaggagagggatgacaccctgactatcctcctgaaggctacacttctggcagtcagcggcgtttatcccttgtctatcccagccaccctattcgtgtggtacttttggcagaaaaagaaacaacgatccggggtgctgtgggatacgccttcacccccagaagtcgagcgcgcggtgctcgacgatggaatttatcggataatgcagagaggtctgcttggcaggagtcaggttggggtaggagtgttccaggaaaacgtctttcatactatgtggcacgtgacccgtggcgctgttttaatgtaccaaggtaagcgcctggagccgagctgggcctccgtgaaaaaggacctcatctcttacgggggaggctggcggttgcagggctcgtggaatacaggggaggaagtccaggtgattgcagtagagcctggaaagaaccccaaaaatgtccagaccgccccaggtacattcaagactagcgaaggcgaggtgggggctatcgccctggactttaaacccggaacctcaggctcccctattgttaacagagaaggtaagatcgtggggctctatggaaatggcgtcgtgacgacaagtggcacttacgtttctgcaatagctcaagccaaagcgagccaggaggggccactgcccgagatcgaagatgaggtgttcaggaagcgaaaccttaccattatggacctgcaccctggatccggtaagacacggcgctatttgccggccatcgtcagagaagcaattaaaaggaagctacggaccctgatcctcgctccaactcgagtggtagcctcagagatggctgaagcattaaaaggcatgcccataagataccagaccacagccgtgaagtctgagcatacggggaaagagattgttgatctgatgtgccacgccacttttaccatgcgccttctgagccctgtcagggtgccaaattataacatgatcatcatggacgaagctcatttcacagatcccagttccattgcggcacgtggatacatcagcacccgggtgggcatgggtgaggccgctgccatatttatgactgcaacacctccggggtctgtcgaagccttcccccaatcaaatgctgtaattcaggacgaggaaagagatatcccagagaggtcctggaacagtggatatgagtggattaccgactttcctggcaagacggtgtggttcgttcccagcatcaagtcgggcaatgatatagcgaactgtctccgcaaaaatgggaagcgagtgattcagttgtctagaaaaactttcgacacagaataccagaagaccaaaaacaacgattgggactacgtcgtgaccactgacatctccgagatgggagccaattttcgggcagatagggttatcgacccacgccgttgcctgaagcctgtgattctcaaggatggtcccgaaagagtcatcctggctggcccaatgccggtgacagtagccagcgcagcccaacggagggggcgcattggacgaaaccacaataaagagggcgaccagtatatatacatgggtcagcctcttaacaatgatgaggaccatgctcactggaccgaagccaagatgctactggataacatcaatacacccgaggggattatcccagcgttgttcgaacccgagagagaaaaatcagcagccatcgacggcgagtatcggttaaggggagaggctcgcaagacttttgtggaactgatgagaaggggcgatctccctgtttggctgagttacaaagtcgcctctgaggggttccagtattccgaccggcgttggtgctttgatggagaacgcaacaatcaagtgcttgaggaaaacatggacgtggagatttggacgaaggagggtgaacgaaagaaactgagaccaaggtggctcgatgctcggacctacagcgaccccttggcactgcgcgagttcaaagaatttgccgctggcagaaggtcagtcagtggggacctaatactggagatcggaaaactccctcagcaccttacacagcgggcccagaatgcactggataacttagttatgttgcataatagcgaacaaggcggtcgagcgtatagacacgccatggaggagctgccggacactattgaaaccctcatgctgcttgctctgatcgccgtgctcacagggggcgtaaccttgttctttctgtccggacgcggcttagggaagacttctattggactactgtgtgtgatggcaagctccgtcctcctttggatggcttcagtggagccacattggatcgccgcatctataatcctggagttctttttgatggttctgctcattcccgagcctgataggcagcggacgccccaggacaaccagctggcctacgtggtcatcggtcttctcttcatgattctgaccgtagctgcgaatgagatgggcttgctggaaacaactaaaaaggatttagggatcggacacgtggccgttgagaaccaccatcacgcagctatgctagacgtggatctgcatccagccagtgcctggaccctctacgcagtcgctacaaccataattactcctatgatgcgtcacacaatcgaaaacacgaccgccaatatttcgcttactgcgatcgctaaccaagccgcaatactgatgggcttggacaaaggttggcccatcagcaagatggatattggggtgccactgctcgccctgggctgctattcccaggtcaatcctcttacattaaccgctgcagtgctgatgctcgttgcccattacgcgatcattggaccgggcttgcaggctaaggccaccagagaggcacagaagaggacagccgctgggatcatgaagaaccccactgtggacggaatagtagccattgatctggacccagtggtctatgatgcaaaatttgaaaagcagctaggccagatcatgctgctcatcctttgtacgtctcagattctgttgatgcgcaccacatgggctctgtgcgagtcaatcactctcgccaccggtcctctgacaaccttatgggaggggagccccggaaaattctggaatactacgatagcggtttccatggccaacattttccggggcagttaccttgccggtgctggcctggccttttctctcatgaaaagcctagggggaggccgaagagggacaggagcacaaggcgaaaccctgggtgagaagtggaaaaggcagttgaatcagctgtcaaagtccgagttcaacacttataaacgcagtgggatcatggaggtggaccggagcgaagctaaggagggactcaaaagaggcgagaccacaaagcacgccgtctctcgtggtactgccaaacttaggtggtttgtggaacggaatctggtaaaaccagagggcaaggtgattgacttggggtgtggacgcggcgggtggtcctactattgcgcgggactgaaaaaggttaccgaagtgaaaggctacacaaagggtgggcctggacacgaggaacccatcccgatggctacgtacggctggaacctcgtcaaattacattcaggcaaggatgtgttctttataccacctgagaagtgtgacaccctgctttgcgatatcggggagagctcgcccaatccaactattgaagagggacgaacactgagagtcctaaaaatggtggaaccctggctcaggggtaaccagttctgtatcaagattctgaatccttatatgccgtctgttgtagagaccttggagcaaatgcagcggaaacacggcgggatgctggtgcgcaaccccctcagtagaaattccactcatgaaatgtactgggtcagctgcggaacaggcaacatcgtgtcagcagttaatatgacctccaggatgcttctgaaccgatttacgatggcccaccggaagccaacctatgagcgtgacgtggatttaggtgctgggacaagacacgtcgccgtggaacctgaggtagcaaacctggacattatcggacagcgcatagaaaatattaaacatgagcacaagtctacttggcattacgatgaggacaacccctataagacctgggcctaccacggcagctatgaagtgaaacctagtggctccgctagctctatggttaatggggtcgtgaagttgctcacaaaaccatgggatgtgatccccatggtcactcagatcgcgatgaccgacacaacccctttcggacaacagagggtttttaaggagaaagtggatactcggacgccaaaggccaagagaggtacagcacagattatggaagtaaccgctaaatggctgtggggcttcctatcacgcaacaagaaacccaggatatgtactcgagaggaatttacccggaaggtgagaagtaatgccgcaatcggggccgtcttcgtggacgagaaccaatggaactccgctaaagaggccgttgaagacgagaggttttgggatcttgtgcatcgcgaacgtgagctgcacaagcagggaaagtgcgcgacatgcgtctacaacatgatgggcaaacgggaaaagaaactcggtgagttcgggaaggcaaaaggaagcagagccatttggtacatgtggctgggcgctaggttcttggagtttgaagccctgggcttcatgaatgaggaccactggttttctcgcgaaaactcgctctcaggggtggagggagagggtcttcataagctgggctatatcttacgagatattagcaaaatcccagggggaaatatgtacgcagacgatacggctggctgggacacccggataactgaagatgacctgcagaacgaggccaagatcacagatattatggaacctgagcacgctttgctcgccaagtccatcttcaaactgacctatcagaataaggtagttagagtgcaaaggccagccaagaacggtactgtcatggacgtgattagtcgcagagatcagcgggggtctggacaggtgggcacatacggcctaaatacctttacaaacatggaagcgcagcttatcaggcaaatggagagcgaggggatattctccccctcagaactggagactcctaacctcgccggacgtgtcctggactggttggaaaagcatggtgttgagcgattaaaacgcatggctattagtggcgatgactgtgtggtaaagccaatcgacgatagatttgccaccgcactgacggctctcaatgacatggggaaggtgcggaaagatatcccccagtgggaaccgtctaagggatggaacgactggcagcaggtccctttctgcagccaccactttcatcaacttattatgaaagatggcagggagatagtggttccctgtcgcaatcaggacgagctggtgggtagagcccgggtctcccagggggcaggatggtcactaagggaaaccgcctgcctgggcaagagctatgcgcagatgtggcaactcatgtacttccaccgacgtgatttgagactggctgccaacgcaatctgttctgccgtgccagtagactgggttcctacatcccgcactacctggagtattcatgctcaccatcagtggatgacaactgaggatatgcttagcgtgtggaatcgggtctggatcgaagagaacccctggatggaagacaaaacccacatttcgtcctggggcgatgtgccatatctggggaagagggaggaccagtggtgcggatctctcatcggtttaacggccagagcaacatgggctaccaatatacaagttgccatcaaccaggtgcgccggctgattggcaatgagaactacttggactacatgacttcaatgaagaggtttaaaaatgaaagcgatcccgagggggcgctgtggtga

SEQ ID NO: 13696 - RNA, 9879 nt, synthetic construct
  misc_feature 1..9879: note = derived and/or modified CDS sequence (opt3) from DENV-1__FJ410263__SS-prME
  source 1..9879: mol_type = other RNA
agcgtgacaatgctgctcatgcttatgcccacagcactggctttccacttgactacgcggggaggggaacctcatatgatcgtctccaagcaggaaaggggaaaatctttactgtttaagacctcagccggtgttaacatgtgcacactaattgccatggacctcggcgaactgtgtgaagatataatgacttacaaatgcccacggatcaccgaaacagaaccggacgatgtggactgttggtgcaatgcgaccgatacttgggtgacatatgggacctgtagtcaaacgggagagcaccgccgagacaagcgtagcgtggctcttgcaccccatgtcggcctgggtttggagactagaaccgaaacatggatgtcctctgagggggcatggaaacagattcagagggtggaaacttgggccctccggcaccctggattcaccgttatcgctctgtttctggcacatgccattggcacatcgatcacccagaagggcataatcttcattctcttaatgctggtgacgccatcaatggctatgcgctgcgtcgggatcggaagcagagattttgtggagggtcttagtggcgccacttgggtagacgttgtgttggagcacgggtcctgtgtcacaaccatggcgaaggataaacccactctggacattgaactactcaagacagaggtgaccaaccctgcagtgctgaggaaactttgcatcgaagccaagatatctaatacgaccacagatagccggtgtccaactcaaggagaggctaccctggtcgaagaacaggacgccaacttcgtttgccgccgaacatttgtggatagaggctggggtaatgggtgtggattgttcggcaaaggctccctcattacttgcgcaaagtttaagtgcgtaaccaaactggaggggaagatcgtgcagtacgaaaacttaaaatattcagtcattgtgacagttcacaccggagaccagcatcaagtgggtaatgagagtactgaacacggcacgacagctaccatcactccccaggcccctaccacagagatccagctgaccgactacggggcgctcactcttgattgtagcccaaggacaggactggacttcaacgaaatggtcttgctaacgatgaaggagaaatcttggctggtgcataagcagtggtttctcgatctgccgcttccctggacctccggcgcctcaactagccaagagacatggaatcggcaggacctgttggtaaccttcaaaacagcacacgctaagaagcaggaagttgtggtcctcggtagtcaagagggggccatgcacactgctctgaccggcgccacggaaattcagacctctggaacaactaccatatttgcaggccatttaaaatgccgtctgaagatggataaactaacactcaaggggatgtcctatgtgatgtgtactgggagcttcaaactggagaaggaagtcgccgagacccagcacggtacggtgcttgttcagatcaagtacgagggcacagacgctccttgcaaaattccattctcgacccaagatgaaaagggggtgactcagaacggacgcttgatcacagcgaatcccatagtaaccgacaaagagaagcctgtcaacattgaagcagagccaccctttggcgagtcttatatcgtgatcggtgccggggaaaaagctctgaagctctcctggttcaagaaaggctcaagtattggaaagatgtttgaggccactgcaagaggcgccaggcggatggctatcctgggggataccgcctgggacttcggaagcattggtggcgtttttacatccgtggggaaacttgtccatcagatattcggaacggcatacggcgtgctgttttctggtgtaagctggaccatgaagatcgggattggcgtgttgctcacttggctgggattaaattcacgaagtacatccctgagcatgacctgtatcgcggttggcctagtcacactctacctgggggtgatggtgcaggctgattctggatgcgtcatcaactggaaaggccgcgaacttaagtgtggttcagggattttcgttactaatgaggtgcacacctggacggaacaatataagtttcaggccgacagtccgaaaagattgagcgcagccataggaaaggcttgggaggagggcgtgtgcggtatcaggtccgccacacggctggaaaacattatgtggaaacagatctctaacgagctcaatcatattctgttagaaaacgacatgaagttcaccgtagtcgtgggcgatgttgcagggatcctggctcagggcaagaagatgatacgccctcaacccatggagtacaaatattcgtggaaaagctggggcaaggccaagatcattggggcggacgtgcagaatactacctttatcattgatggaccaaacacacctgaatgtcccgacgatcagagagcctggaatatctgggaggtcgaggactacggcttcggtatatttactaccaacatttggcttaagttgagggattcctatacacaggtgtgcgaccaccgtctcatgtcagctgcaatcaaagatagtaaggccgttcacgctgacatggggtactggattgaatctgagaaaaatgaaacgtggaagctggcccgggcatccttcatcgaggtgaagacctgtatatggccaaaatcccatactctatggtcaaacggagtactggaaagcgagatgatcattcccaagatctatggcggtcctatttctcaacacaattaccgaccaggctacttcacacaggcggccgggccgtggcatctcggaaaactggagcttgattttgacttgtgcgaaggcaccactgtcgtggtggatgagcactgcgggaacagaggaccctccctgaggacaaccacggtcactggcaagatcatacacgaatggtgttgccgcagttgtaccttacctccactccggttcagaggtgaggacgggtgctggtatggaatggagattaggcccgttaaagaaaaggaggaaaatctggtaaagagcatggtatctgctggctccggtgaggtggactcatttagtcttggcctgttgtgtatcagcatcatgattgaagaggtcatgcgctcgcgatggtcccggcgtatgctcatgacagggaccctggccgtgttctttctactgatcatgggacagctcacttggaacgatctgattagactttgcataatggttggcgcaaatgcttctgacaggatggggatgggaacaacctacttggccctgatggcaacattcaaaatgcgccctatgtttgccgtgggcttactcttccggagactgactagcagggaggtccttctgctaaccatcggtctctcactggtggctagtgttgaattgccaaactccctggaggaattaggggatggactcgcgatgggcattatgatcctgaaacttctgacggactttcaatctcatcagttgtgggccacactcctgagcctaaccttcattaaaactaccttttccctgcactatgcatggaagacaatggctatggtgctttcaatcgtcagcctcttccccctgtgtttgagtactacctctcagaaaacgacatggctgccggtattactcggctccctggggtgcaagcctcttaccatgtttctgatagccgagaataagatctggggacgacgcagctggccattgaacgaaggtattatggccgtgggcatcgtttcgattctcctgtcatctctactgaaaaacgatgtgccccttgctgggcctctcatcgcaggaggcatgctgatagcctgttacgtcattagtggttccagcgcggacttgtctttagagaaggctgccgaggtgagctgggaagaggaagcagagcattccggggcctcacacaatatcctggtagaagtgcaggatgacggaactatgaaaatcaaggatgaggagcgggacgatacactcaccattctgcttaaagctactctgttggcagtcagtggcgtttatcccctaagcataccagccacactgttcgtgtggtacttctggcaaaagaaaaagcagagatctggcgtgctctgggacaccccttcacccccagaagtcgagagggcggtgctggatgacgggatctatcgtattatgcagcgcggacttttaggtcggagccaggttggcgtaggggtgtttcaagaaaacgtcttccatacgatgtggcacgtgactagaggagctgttctgatgtaccagggcaagaggctcgagccgagttgggccagcgtgaaaaaggacttgatctcctacggtgggggatggcgactgcagggctcttggaataccggcgaggaagtccaggtgattgcagtagagcctgggaaaaaccccaagaatgtccaaacagccccaggaacctttaaaacacccgaaggtgaggtgggcgctatcgccctcgatttcaagcctgggacttcgggaagcccaatagttaaccgggaaggcaagatcgtgggtctgtatgggaatggagtcgtgaccacgtcaggcacatacgtttccgcaattgctcaggccaaagcgagtcaggagggcccccttcctgagatcgaagacgaggtgtttcgcaagagaaacctgactattatggatttgcacccggggtctggaaaaaccaggcggtatctaccagccatcgtccgagaagcaataaagagaaaactgcgcacactcattttagctcccaccagggtggtagccagcgagatggctgaagcactgaagggtatgcctatccgttaccaaactaccgccgtgaagtccgagcatacaggcaaagagatcgttgaccttatgtgccacgccacgttcactatgcggctgctctcaccagtcagagtgcccaattataacatgattatcatggatgaagctcattttaccgacccttctagcatagcggcaagggggtacattagtacacgcgtgggaatgggcgaggccgctgccatcttcatgaccgcaactccgcccggttccgtcgaagcctttccacagagcaatgctgtaattcaggatgaggaacgagacatccctgagagatcttggaactcagggtatgagtggataacagatttccccggaaagaccgtgtggtttgttccatccattaaaagtggcaatgacatcgcgaactgtttgcggaagaatggcaaaagggtgatccagctgagccgcaagacgttcgatactgaataccaaaagaccaagaataacgactgggactacgtcgtgaccaccgatatttcggagatgggggccaatttccgtgcagacagagttatcgatcctcggaggtgcctcaagcccgtgattctgaaagacggaccagaacgcgtcatacttgctggtccgatgcctgtgactgtagcctctgcagcccagcgaagaggccggatcgggaggaaccacaataaggagggagatcagtatatttacatgggccagcccctaaacaatgacgaggatcatgctcactggacagaagccaaaatgctgttggacaacatcaataccccagagggtatcattcccgcgttatttgaacctgagcgcgaaaagtccgcagccatagatggggagtatagactgaggggcgaggctcggaagacattcgtggaactcatgcgtcgcggagacctgccagtttggcttagctacaaagtcgcctcagagggctttcaatatagtgatcgaagatggtgcttcgacggggaaaggaacaatcaggtgctggaggaaaacatggatgtggagatctggactaaggagggagaacggaaaaagctccgccccagatggttggacgctaggacgtactctgaccctctggcactacgggagtttaaagagttcgccgctggtcgaagatccgtcagcggcgatctgattctcgagatcgggaaacttccgcagcacctgacccagcgcgcccaaaatgcattagacaacttggttatgctgcataattcagaacagggaggcagggcgtatcggcacgccatggaggagctcccagatacaattgaaactctgatgcttctggctctcatcgccgtgttgaccggtggggtaacactgtttttcttaagtggccgtggactaggcaaaaccagcatagggctgctctgtgtgatggcatcctctgtccttctgtggatggctagcgtggagccccattggatcgccgcatccattatcttggaatttttcctgatggttctcctgattcctgagcccgacagacagaggactccacaggataaccaacttgcctacgtggtcatcggactcctgtttatgatattgacggtagctgcgaatgagatgggtctgttagaaaccacaaagaaggacctaggcattgggcacgtggccgttgagaaccaccatcacgcagctatgctggatgtggacctccatcctgcctcagcctggactctttacgcagtcgctaccacaatcattacccccatgatgcgccacactatcgaaaacacaacggccaatatatctctgaccgcgatcgctaaccaggccgcaattttgatgggactggataaaggctggccaatcagtaagatggacattggtgtgcctctcctggcccttgggtgctattcgcaggtcaatccgttaactctgacagctgcagtgctcatgttggttgcccattacgcgatcataggccccggactgcaagctaaagccacccgggaggcacagaagcgaaccgccgctggcattatgaaaaacccaacagtggatgggatcgtagccatcgacctagatcctgtggtctatgacgcaaagttcgaaaagcagctgggacagattatgctccttatcctgtgtactagccaaatattgctgatgagaacgacctgggctctctgcgagtccattacactggccactggccccttaaccacactttgggagggttctccagggaaattttggaataccactatcgcggtttcaatggccaacattttcaggggaagctacctggcaggcgctggtctcgccttctccctaatgaagagtctgggcgggggacgccggggcacgggggcacagggagaaacattgggcgagaaatggaagagacagctgaatcagctctctaaaagcgaatttaacacctataagcgttcaggtatcatggaggtggacaggtccgaagctaaggaggggcttaaacggggagagactaccaagcacgccgtcagtcgcggcacagccaaactgcgatggttcgtggaaagaaatttggtaaagcctgagggtaaagtgatagatctgggctgtgggaggggaggctggagctactattgcgcggggctcaagaaggttactgaagtgaaaggatacaccaagggcggtcccgggcacgaggaaccgatcccaatggctacatacggatggaacttagtcaaactgcattctggcaaggacgtgtttttcattcctcccgagaaatgtgatacgcttctgtgcgacatcggcgagtcctcaccaaatcccaccattgaagaggggcggactctacgcgtcctcaagatggtggaaccttggctgagaggaaaccaattttgtatcaaaattttgaatccgtatatgcccagcgttgtagagacactggagcagatgcagaggaagcacggtggcatgctcgtgcgaaacccactttcgagaaattctacccatgaaatgtactgggtcagttgcgggactggaaacatcgtgtccgcagttaatatgacaagccgtatgctgttaaacagattcaccatggcccaccgcaagcctacgtatgagagggatgtggacctgggcgctggtacccggcacgtcgccgtggaacccgaggtagcaaacttggatataattgggcagagaatcgaaaatatcaaacatgagcacaagtcaacatggcattacgacgaggataacccttataaaacttgggcctaccacggatcctatgaagtgaagccatctggcagcgctagttccatggttaatggcgtcgtgaaactcctgaccaagccctgggacgtgattcctatggtcacacaaatagcgatgactgataccacaccatttgggcagcagcgcgttttcaaggagaaagtggacaccaggactcccaaggccaaacgaggaacggcacaaatcatggaagtaacagctaagtggctatggggttttcttagccggaacaaaaagccgagaatttgtaccagggaggagttcactcgcaaggtgcgttctaatgccgcaatcggcgccgtctttgtggacgagaaccagtggaactcagctaaagaggccgttgaagatgagcggttctgggacctggtgcatagagaaagggagctccacaagcaggggaaatgcgcgacctgcgtctacaacatgatgggaaagcgcgagaaaaagctgggcgagtttggtaaggcaaaagggagtcgagccatttggtacatgtggttgggagctcggttcctggagttcgaagccctcggctttatgaatgaggatcactggttctccagagaaaacagcctttctggcgtggagggggagggactgcataagttaggttatatcctgagggacatatcgaaaatccctggcgggaatatgtacgcagatgacacagctggatgggatacgcgcattaccgaagacgatttgcagaacgaggccagaatcactgacattatggaaccagagcacgctctcctggccaagtcaatctttaaactaacatatcaaaataaggtagttcgggtgcagaggcccgccaaaaacggcaccgtcatggatgtgataagccgtcgagaccagcgcggttccggacaggtgggaacttacggccttaatacattcaccaacatggaagcgcaactgattagacagatggagagtgagggcatcttttctcctagcgaactcgagacaccaaacctggccgaacgggtcttggattggttagagaagtatggggttgaaaggctgaagcgcatggctatctccggagacgactgtgtggtaaaacccattgatgacagattcgccactgcactcaccgctcttaatgatatgggtaaggtgcggaaagacataccgcagtgggagccttcaaagggctggaacgattggcagcaagtccccttttgcagtcatcacttccaccagctgatcatgaaagacgggagggagattgtggttccatgtcgaaatcaggatgagctagtgggacgtgccagagtctctcagggcgcaggttggagcctgcgcgagacggcctgcctcgggaagtcctacgcgcaaatgtggcagttgatgtattttcatcggagggacctgagacttgctgccaacgcaatctgttcagccgtgcctgtagattggattcccaccagccgcacaacttggtctatccacgctcatcaccagtggatgaccacagaagacatgctgtccgtttggaatcgggtgtggatagaggaaaacccatggatggaggataagactcatatcagtagctggggagacgtcccctacctcggcaaaagggaggaccaatggtgcggctcgttaattgggctgaccgcccgagcaacgtgggctacaaatatccaggtggccattaaccaggttagacggttgatcggaaatgaaaactacctggattatatgacctccatgaagaggttcaaaaatgagtctgaccctgaaggtgcgctctggtga

SEQ ID NO: 13697 - RNA, 9879 nt, synthetic construct
  misc_feature 1..9879: note = derived and/or modified CDS sequence (opt3) from DENV-1__FJ410264__SS-prME
  source 1..9879: mol_type = other RNA
agcgtgaccatgctgctcatgcttatgcccaccgcactggctttccacttgactacgaggggaggggaacctcatatgatcgtaaccaagcaggaaaggggaaaatccttactgtttaagacatctgccggtgttaatatgtgcactctaattgccatggacctcggcgaactgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggtagcttcaaactggagaaggaagtggctgagacccagcacggaacggtccttgtgcagataaagtacgagggcacagacgcgccttgcaaaatcccattctcgacccaagatgaaaagggggttattcagaacggacgcttgatcactgcaaatcccatagtgacagacaaagagaagcctgtaaacattgaagccgagccaccctttggcgagtcttatatcgtcatcggtgctggggaaaaagccctgaagctctcctggttcaagaaaggctcaagtattggaaagatgtttgaggcaaccgccagaggcgctaggcggatggccatcctgggggatactgcatgggacttcggaagcgtgggtggcgtttttacctccgtggggaaacttgtccatcagattttcggaacagcgtacggcgtgctgttttctggtgtaagctggacgatgaagatagggatcggcgtgttgctcacctggctgggattaaattcacgaagtacttccctgagcatgacatgtattgctgttggcctagtcaccctctacctgggggtgatggtgcaggccgattctggatgcgtcatcaactggaaaggccgcgaacttaagtgtggttcagggatcttcgttacaaatgaggtgcacacttggaccgaacaatataagtttcaggcagacagtccgaaaagattgagcgccgctattggaaaggcctgggaggagggcgtgtgcggtataaggtccgcaacgcggctggaaaacatcatgtggaaacagatttctaacgagctcaatcatatcctgttagaaaacgacatgaagttcacagtagtcgtgggcgatgttgtggggattctggctcagggcaaaaagatgatccgccctcaacccatggagcacaaatactcgtggaaaagctggggcaaggccaagataatcggggcggacgtccagaataccacttttattatcgatggaccaaacacccctgaatgtcccgacgatcagagagcctggaatatttgggaggtggaggactatggcttcggtatctttacaactaacatatggcttaagttgagggattcctacacccaggtttgcgaccaccgtctcatgtcagctgcaattaaagatagtaaggccgtgcatgctgacatggggtattggatcgaatctgagaaaaatgaaacatggaagctggcccgggcatccttcattgaggtaaagacgtgtatctggccaaaatcccacaccctatggtcaaacggagtcctggaaagcgagatgataatccccaagatttacggcggtcctatctctcaacataattatcgaccaggctacttcactcagacagcggggccgtggcacctcggaaaactggagcttgattttgacttgtgcgaaggcaccactgtggtggtcgatgagcactgcgggaacagaggaccctccctgaggacaaccacggttactggcaagattatccatgaatggtgttgccgcagttgtaccttacctccactccggttcaaaggtgaggacgggtgctggtacggaatggagataagacccgtgaaggaaaaggaggaaaatctggtaaaaagcatggtgtctgccggctccggtgaggtcgactcatttagtcttggcctgttgtgtattagcatcatgatcgaagaggtgatgaggtcgcgctggtcccgaaagatgctcatgacagggaccctggctgttttcctactgctcattatgggacagctgacttggaacgatcttatccggttgtgcattatggtgggcgccaatgcatctgaccgtatggggatgggaacaacctatctggctttaatggccacatttaaaatgagacctatgttcgcagtcggcctcctgtttaggcgccttactagccgggaggtgctgctactcaccataggtctgtcattggttgccagtgtggaactgccaaactccttagaggaactcggggatggactggctatgggcatcatgattcttaagctgttgacggacttccaatctcaccagctctgggcgacactgctaagcctgacctttatcaaaactaccctttccctccattacgcctggaagacaatggcaatggtcctgtcaattgtcagcttgttccccctgtgtttaagtactacctctcagaagacgacatggctcccggtgctgcttggctccctggggtgcaaacctttgaccatgtttctcatcactgagaataagatatggggaagaaaaagctggccactgaacgaaggtatcatggctgttggcgtggtctcgattctactgtcatctcttctcaagaacgatgtgcccctggccgggcctttgatcgccggaggcatgttaattgcttgttatgtaatcagtggttccagcgcagacctgtctctcgagaaagccgcggaggtgagctgggaagaggaagctgagcactccggggcctcacataatatactggtcgaagttcaggatgacggaacaatgaagattaaagatgaggagagggacgatacccttactatcctgttgaaggcaacactactggccgtgagtggcgtgtaccccctcagcatcccagctaccctgttcgtctggtatttttggcaaaagaaaaagcagcgatctggcgtgctttgggacacgccttcacccccagaagttgagcgcgcagtattagatgacgggatttaccggataatgcagagaggactgctcggtaggagccaggtgggcgtcggggtgttccaagaaaacgttttccacactatgtggcacgtgacccgtggagccgtcttgatgtatcagggcaaacgcctggagccgagttgggcgagcgtgaagaaagacctcatctcctacggtgggggatggcggctgcagggctcttggaatacaggcgaggaagtacaggtcattgctgtggagcctgggaagaaccccaagaatgttcaaaccgccccaggaacatttaaaactcccgaaggtgaggtgggcgcaatcgcccttgatttcaagcctgggacctcgggaagcccaattgtcaacagagaaggcaaaatcgtgggtctgtacgggaatggagttgtgacgacatcaggcacttatgtctccgctatagcccaggcaaaggctagtcaggagggccccttgcctgagatcgaagacgaggtgtttaggaaacgaaacctaaccattatggatctgcatccggggtctggaaagacacggcgctacctcccagccatcgtaagagaagcgattaagaggaaattacggaccctgatccttgcccccactcgagtggttgcaagcgagatggctgaagccctgaagggtatgcctataagatatcaaaccacagctgtcaaatccgagcacacgggcaaggagattgtggacctcatgtgccatgcaactttcaccatgcgcttgctgtcaccagtgagggtccccaattacaacatgatcatcatggatgaagcccactttacagacccttctagcattgccgctcgtgggtatatcagtacccgggtaggaatgggcgaggcggcagccatattcatgactgctacaccgcccggttccgtggaagcctttccacagagcaatgcagttattcaggatgaggaaagagacatccctgagaggtcttggaactcagggtacgagtggattaccgatttccccggaaaaacggtgtggtttgtcccatccatcaagagtggcaatgacatagccaactgtctccgcaagaatggcaaacgagtgattcagctgagcagaaagactttcgatacagaatatcagaaaaccaagaacaacgactgggactacgttgtgaccactgatatctcggagatgggggctaattttcgggcggacagggtcatcgatcctcgccgttgccttaaacccgtgattctaaaggacggaccagaaagagtaatcctggccggtccgatgcctgtgacagttgcatctgctgcccagcggaggggccgcattgggcgaaaccataataaggagggagatcagtacatatatatgggccagcccttgaacaatgacgaggatcacgcacactggaccgaagccaaaatgttactggacaacatcaatacaccagagggtattatccccgctctcttcgaacctgagagagaaaagtccgccgcgatcgatggggagtaccggctgaggggcgaggcacgcaaaactttcgtcgaacttatgagaaggggagacctgccagtgtggctcagctataaggtggcctcagagggctttcaatacagtgatcggcgttggtgcttcgacggggaacgcaacaatcaggtcttggaggaaaacatggatgttgagatttggacgaaagagggagaacgaaagaaactgagacccaggtggctagacgctcggacctattctgaccctctggccctccgcgagtttaaggagttcgctgcaggtagaaggtccgtgagcggcgatcttatactggagatcgggaagttaccgcagcatttgacacagcgggcccaaaatgctctggacaacctcgtaatgctgcacaattcagaacagggaggccgagcctacagacatgcaatggaggagcttccagatactattgaaaccctgatgctcttggcgctgatcgccgtgttaacaggtggggtcaccctatttttcctgagtggccgcggactcggcaaaactagcattgggcttctgtgtgtgatggcttcctctgttttgctgtggatggccagcgtggagccccactggatcgcagcttccataatcctcgaatttttcctgatggtccttctcattcctgagcccgacaggcagcggacgccacaggataaccaactggcctatgtagtgatcggattgctgtttatgattttaaccgttgcagccaatgagatgggtctactggaaacaactaagaaagacctcggcatcgggcacgtggctgtcgagaaccatcaccatgcgaccatgcttgatgtggacctgcaccctgcctcagcatggacattgtacgctgtcgccaccactataattacacccatgatgcgtcatacgatcgaaaacaccactgccaatatttctctgacagcaatcgctaaccaggccgcgatactcatgggactggataagggctggccaatcagtaaaatggacattggtgtgcctcttttagctctggggtgctactcgcaggttaatccgctcaccttgaccgccgcagtgctgatgctagtagcccactatgctatcattggccccggactgcaagcaaaggccacaagagaggcgcagaagaggactgctgccggcatcatgaaaaacccaacggtggatgggatagtcgcaattgacctcgatcctgttgtgtacgacgccaagttcgaaaaacagcttggacagatcatgctgttgatcctgtgtaccagccaaattctcctgatgcgcacaacttgggctttatgcgagtccatcacccttgccacaggccccctgaccactctctgggagggttctccagggaagttttggaatacgacaatagcagtctcaatggctaacattttccggggaagctatctagccggcgcgggtctggccttttccttgatgaaaagtctgggcgggggacgaagaggcaccggggcacagggagaaactctcggcgagaagtggaagaggcagcttaatcagctgtctaaaagcgagttcaacatctacaagcgctcaggtattatggaggtggaccggtccgaagctaaagaggggttgaagagaggagagaccacacgtcacgccgtaagtaggggcactgcaaaactgcggtggttcgtggaacgcaatctcgttaagcctgagggtaaggtgatcgatttaggctgtgggcgaggaggctggagctattactgcgctgggctgaaaaaggtcaccgaagtgaaaggatatacaaagggcggtcccgggcatgaggaaccgataccaatggccacgtacggatggaaccttgtcaaactgcactctggcaaggacgtgtttttcacccctcccgagaaatgtgatactctactctgcgacatcggcgagtcctcaccaaatcccacaattgaagaggggagaaccctgagggttttgaagatggtagaaccttggctgcggggaaaccaattttgtatcaagattctcaatccgtacatgcccagcgtggtcgagactcttgagcagatgcagcgcaaacatggtggcatgctggtgagaaacccattatcgagaaattctacacacgaaatgtattgggttagttgcgggaccggaaacatcgtgtccgccgtcaatatgacgagccgaatgctgttgaaccggttcaccatggcgcaccgtaagcctacatacgagagagatgtggacctcggcgctggtactcgccatgtagcagtggaacccgaggttgccaacctggatattatcgggcagaggatagaaaatattaaacacgagcataagtcaacctggcactatgacgaggataacccttacaaaacatgggcttatcatggatcctacgaagtcaagccatctggcagcgccagttccatggtgaatggcgtggtcaagctacttactaaaccctgggacgttatccctatggtgacccaaatcgcaatgacagataccactccatttgggcagcagcgggtattcaaggagaaagtggacacgagaacacccaaggccaaacgcggaaccgctcaaattatggaagtcactgcgaggtggctgtggggttttctcagccgaaacaagaagccgcggatatgtaccagagaggagttcacaaggaaagtgcgctctaatgccgcaatcggcgctgtttttgtggacgagaaccagtggaactcagccaaggaggcagtcgaagatgagcgtttctgggacctggtgcagaaagaacgggagttgcacaagcaggggaaatgcgccacgtgcgtatataacatgatgggaaagagagaaaagaaactgggcgagtttggtaaggctaaagggagtagggccatttggtacatgtggctcggagcgcgcttccttgagtttgaagcactgggcttcatgaatgaggatcactggttctcccgagaaaacagcttatctggcgttgagggggagggactgcataagttgggttacatcctccgggacatttcgaaaatccctggcgggaatatgtatgccgatgacaccgctggatgggatactagaataacagaagacgatctgcaaaacgaggccaagatcaccgacattatggaaccagagcacgcactacttgctacttcaatctttaaactgacataccagaataaggtggtcagggtgcagcgccccgccaagaacggcaccgtgatggatgtcattagcagacgggaccagaggggttccgggcaagttggaacatatggcctcaatactttcaccaacatggaagctcagctgatccgtcagatggagagtgagggcatatttttgccttctgaattagagacgccaaacctggccgaacgagtgctcgattggcttgagaaatacggggtagaacgcctgaagagaatggcaattagcggagacgactgtgtggtcaaacccatcgatgaccggttcgcgaccgccctaacagctctgaatgatatgggtaaggtgaggaaagacatcccgcagtgggagccttccaagggctggaacgattggcaacaggttcccttttgctcacatcacttccaccagctcattatgaaggacgggcgcgagatagtggtcccatgtagaaatcaggatgaattggtgggacgggccagggtaagtcaaggcgcaggttggtctctgcgagagactgcttgccttgggaaaagctatgcccagatgtggcagctgatgtactttcatcgtagagacctccgcttagcagccaacgcgatctgttccgctgttcctgtggattgggtccccacctcacggacaacttggagcattcacgcccatcaccaatggatgaccacggaagacatgctgtctgtgtggaatagggtttggatcgaggaaaacccatggatggaggataagacacatgtgtccagttggggagacgtcccctatttgggcaaaagagaggaccagtggtgcggcagcctgattgggctcaccgcacgcgccacttgggcttcgaatatccaggtggccataaaccaggtacggaggcttatcggaaatgaaaactacctggattacatgacatccatgaagcgattcaaaaatgagggtgaccctgaaggcgcactatggtga

SEQ ID NO: 13698 - RNA, 9879 nt, synthetic construct
  misc_feature 1..9879: note = derived and/or modified CDS sequence (opt3) from DENV-1__FJ410265__SS-prME
  source 1..9879: mol_type = other RNA
agcgtgaccatgctgctcatgcttatgcccaccgccctggctttccacttgactacgcggggaggggaacctcatatgatcgtctccaagcaggaaaggggaaaatctttactgtttaagacctcagccggtgttaatatgtgcacgctaattgccatggacctcggcgaactgtgtgaagatactatgacctacaaatgcccacggataacagaaaccgaaccggacgatgtggactgttggtgcaatgcgactgatacatgggtgacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaggacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaggcccctacaaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccgggagcttcaaactggagaaggaagtcgccgagacgcagcacggtacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattgtgatcggtgccggggaaaaagctctgaagctctcctggttcaagaaaggctcaagtatcggaaagatgtttgaggccaccgcaagaggcgccaggcggatggctattctgggggatacagcctgggacttcggaagcatcggtggcgtttttacgtccgtggggaaacttgtccatcagattttcggaaccgcatacggcgtgctgttttctggtgtaagctggactatgaagatagggatcggcgtgttgctcacatggctgggattaaattcacgaagtacctccctgagcatgacatgtattgcggttggcctagtcactctctacctgggggtgatggtgcaggctgattctggatgcgtcatcaactggaaaggccgcgaacttaagtgtggttcagggatcttcgttaccaatgaggtgcacacgtggacagaacaatataagtttcaggccgacagtccgaaaagattgagcgcagccattggaaaggcttgggaggagggcgtgtgcggtataaggtccgccacccggctggaaaacatcatgtggaaacagatttctaacgagctcaatcatatcctgttagaaaacgacatgaagttcactgtagtcgtgggcgatgttgcagggattctggctcagggcaagaagatgatccgccctcaacccatggagtacaaatattcgtggaaaagctggggcaaggccaagataatcggggcggacgtgcagaataccacatttattatcgatggaccaaacactcctgaatgtcccgacgatcagagagcctggaatatttgggaggtcgaggactacggcttcggtatctttaccacaaacatatggcttaagttgagggattcctatacacaggtgtgcgaccaccgtctcatgtcagctgcaattaaagatagtaaggccgttcacgctgacatggggtactggatcgaatctgagaaaaatgaaacctggaagctggcccgggcatccttcattgaggtgaagacttgtatctggccaaaatcccatacactatggtcaaacggagtactggaaagcgagatgataatccccaagatttatggcggtcctatctctcaacacaattaccgaccaggctacttcacccaggcggccgggccgtggcatctcggaaaactggagcttgattttgacttgtgcgaaggcactacagtcgtggtggatgagcactgcgggaacagaggaccctccctgaggaccacgactgtcaccggcaagattatccacgaatggtgttgccgcagttgtacattacctccactccggttcagaggtgaggacgggtgctggtatggaatggagataaggcccgttaaagaaaaggaggaaaatctggtaaagagcatggtatctgctggctccggtgaggtggactcatttagtcttggcctgttgtgtaccagcattatgatcgaagaggtcatgcgctcgcgatggtcccggcgtatgctcatgactgggacactggccgtgttctttctactgatcatgggacagctcacctggaacgatctgattagactttgcatcatggttggcgcaaatgcttctgacaggatggggatgggaacaacttacttggccctgatggcaaccttcaaaatgcgccctatgtttgccgtgggcttactcttccggagactgacgagcagggaggtccttctgctaacaattggtctctcactggtggctagtgttgaattgccaaactccctggaggaattaggggatggactcgcgatgggcataatgatcctgaaacttctgaccgactttcaatctcatcagttgtgggccactctcctgagcctaaccttcattaaaacaactttttccctgcactatgcatggaagaccatggctatggtgctttcaatcgtcagcctcttccccctgtgtttgagtacgacatctcagaaaaccacttggctgccggtattactcggctccctggggtgcaagcctcttacaatgtttctgattgccgagaataagatctggggacgacgcagctggccattgaacgaaggtataatggccgtgggcatcgtttcgattctcctgtcatctctactgaaaaacgatgtgccccttgctgggcctctcatcgcaggaggcatgctgattgcctgttacgtcatcagtggttccagcgcggacttgtctttagagaaggctgccgaggtgagctgggaagaggaagcagagcattccggggcctcacacaatatactggtagaagtgcaggatgacggaaccatgaaaattaaggatgaggagcgggacgatactctcacaatcctgcttaaagctaccctgttggcagtcagtggcgtttatcccctaagcatcccagccacgctgttcgtgtggtacttctggcaaaagaaaaagcagagatctggcgtgctctgggacactccttcacccccagaagtcgagagggcggtgctggatgacgggatttatcgtataatgcagcgcggacttttaggtcggagccaggttggcgtaggggtgtttcaagaaaacgtcttccataccatgtggcacgtgacaagaggagctgttctgatgtaccagggcaagaggctcgagccgagttgggccagcgtgaaaaaggacttgatctcctacggtgggggatggcgactgcagggctcttggaataccggcgaggaagtccaggtgattgcagtagagcctgggaaaaaccccaagaatgtccaaacagccccaggaacttttaaaacccccgaaggtgaggtgggcgctatcgccctcgatttcaagcctgggacgtcgggaagcccaattgttaaccgggaaggcaagatcgtgggtctgtatgggaatggagtcgtgacaacttcaggcacctacgtttccgcaatagctcaggccaaagcgagtcaggagggcccccttcctgagatcgaagacgaggtgtttcgcaagagaaacctgacaattatggatttgcacccggggtctggaaaaaccaggcggtatctaccagccatcgtccgagaagcaattaagagaaaactgcgcactctcatcttagctcccaccagggtggtagccagcgagatggctgaagcactgaagggtatgcctatacgttaccaaacaacggccgtgaagtccgagcatactggcaaagagattgttgaccttatgtgccacgccaccttcacaatgcggctgctctcaccagtcagagtgcccaattataacatgatcatcatggatgaagctcattttaccgacccttctagcattgcggcaagggggtacatcagtactcgcgtgggaatgggcgaggccgctgccatattcatgacagcaaccccgcccggttccgtcgaagcctttccacagagcaatgctgtaattcaggatgaggaacgagacatccctgagagatcttggaactcagggtatgagtggattacggatttccccggaaagactgtgtggtttgttccatccatcaaaagtggcaatgacatagcgaactgtttgcggaagaatggcaaaagggtgattcagctgagccgcaagacattcgataccgaataccaaaagaccaaaaacaacgactgggactacgtcgtgactacagatatctcggagatgggggccaatttccgtgcagacagagttatcgatcctcggaggtgcctcaagcccgtgattctgaaagacggaccagaacgcgtcatccttgctggtccgatgcctgtgaccgtagcctctgcagcccagcgaagaggccggattgggaggaaccacaataaggagggagatcagtatatatacatgggccagcccctaaacaatgacgaggatcatgctcactggacagaagccaaaatgctgttggacaacatcaatactccagagggtattatccccgcgttatttgaacctgagcgcgaaaagtccgcagccatcgatggggagtatagactgaggggcgaggctcggaagacgttcgtggaactcatgcgtcgcggagacctgccagtttggcttagctacaaagtcgcctcagagggctttcaatatagtgatcgaagatggtgcttcgacggggaaaggaacaatcaggtgctggaggaaaacatggatgtggagatttggaccaaggagggagaacggaaaaagctccgccccagatggttggacgctaggacatactctgaccctctggcactacgggagtttaaagagttcgccgctggtcgaagatccgtcagcggcgatctgatactcgagatcgggaaacttccgcagcacctgactcagcgcgcccaaaatgcattagacaacttggttatgctgcataattcagaacagggaggcagggcgtatcggcacgccatggaggagctcccagataccattgaaacactgatgcttctggctctcatcgccgtgttgaccggtggggtaactctgtttttcttaagtggccgtggactaggcaaaacgagcattgggctgctctgtgtgatggcatcctctgtccttctgtggatggctagcgtggagccccattggatcgccgcatccataatcttggaatttttcctgatggttctcctgattcctgagcccgacagacagaggaccccacaggataaccaacttgcctacgtggtcatcggactcctgtttatgattttgacagtagctgcgaatgagatgggtctgttagaaactaccaagaaggacctaggcatcgggcacgtggccgttgagaaccaccatcacgcagctatgctggatgtggacctccatcctgcctcagcctggacactttacgcagtcgctaccactataattacacccatgatgcgccacacgatcgaaaacaccactgccaatatttctctgacagcgatcgctaaccaggccgcaatattgatgggactggataaaggctggccaatcagtaagatggacattggtgtgcctctcctggcccttgggtgctattcgcaggtcaatccgttaaccctgaccgctgcagtgctcatgttggttgcccattacgcgatcattggccccggactgcaagctaaagccacacgggaggcacagaagcgaactgccgctggcatcatgaaaaacccaacggtggatgggatagtagccattgacctagatcctgtggtctatgacgcaaagttcgaaaagcagctgggacagatcatgctccttatcctgtgtaccagccaaattttgctgatgagaacaacttgggctctctgcgagtccatcaccctggccacaggccccttaaccactctttgggagggttctccagggaaattttggaatacgacaatagcggtttcaatggccaacattttcaggggaagctacctggcaggcgctggtctcgccttctccctaatgaagagtctgggcgggggacgccggggcaccggggcacagggagaaactttgggcgagaaatggaagagacagctgaatcagctctctaaaagcgaatttaacacctataagcgttcaggtatcatggaggtggacaggtccgaagctaaggaggggcttaaacggggagagacaactaagcacgccgtcagtcgcggcaccgccaaactgcgatggttcgtggaaagaaatttggtaaagcctgagggtaaagtgattgatctgggctgtgggaggggaggctggagctactattgcgcggggctcaagaaggttacagaagtgaaaggatacacgaagggcggtcccgggcacgaggaaccgatcccaatggctacctacggatggaacttagtcaaactgcattctggcaaggacgtgtttttcatacctcccgagaaatgtgatactcttctgtgcgacatcggcgagtcctcaccaaatcccacaattgaagaggggcggaccctacgcgtcctcaagatggtggaaccttggctgagaggaaaccaattttgtatcaaaattttgaatccgtatatgcccagcgttgtagagactctggagcagatgcagaggaagcacggtggcatgctcgtgcgaaacccactttcgagaaattctacacatgaaatgtactgggtcagttgcgggaccggaaacatcgtgtccgcagttaatatgacgagccgtatgctgttaaacagattcaccatggcccaccgcaagcctacatatgagagggatgtggacctgggcgctggtactcggcacgtcgccgtggaacccgaggtagcaaacttggatattatcgggcagagaatagaaaatattaaacatgagcacaagtcaacctggcattacgacgaggataacccttataaaacatgggcctaccacggatcctatgaagtgaagccatctggcagcgctagttccatggttaatggcgtcgtgaaactcctgactaagccctgggacgtgatccctatggtcacccaaatcgcgatgacagataccactccatttgggcagcagcgcgttttcaaggagaaagtggacacgaggacacccaaggccaaacgaggaaccgcacaaattatggaagtaactgctaagtggctatggggttttcttagccggaacaaaaagccgagaatatgtaccagggaggagttcacacgcaaggtgcgttctaatgccgcaatcggcgccgtctttgtggacgagaaccagtggaactcagctaaagaggccgttgaagatgagcggttctgggacctggtgcatagagaaagggagctccacaagcaggggaaatgcgcgacgtgcgtctacaacatgatgggaaagcgcgagaagaagctgggcgagtttggtaaggcaaaagggagtcgagccatttggtacatgtggttgggagctcggttcctggagttcgaagccctcggctttatgaatgaggatcactggttctccagagaaaacagcctttctggcgtggagggggagggactgcataagttaggttatatcctgagggacatttcgaaaatccctggcgggaatatgtacgcagatgacaccgctggatgggatactcgcataacagaagacgatttgcagaacgaggccaagatcaccgacattatggaaccagagcacgctctcctggccaaatcaatctttaagctaacttatcaaaataaagtagttagagtgcagcggcccgcaaagaacggcacagtcatggatgtgattagcaggcgtgaccagcgaggttccggacaggtgggaacctacggccttaatacattcactaacatggaagcgcaactgatccgccagatggagagtgagggcatattttctcctagcgaactcgagaccccaaacctggccgaaagagctttggattggttagagaagtatggggtcgaacggctgaaaaggatggccatttccggagacgactgtgttgtgaagcccatcgatgaccgcttcgcaacggctctcaccgcccttaatgatatgggtaaagtaagaaaggacatcccgcagtgggagccttcaaaaggctggaacgattggcagcaagtgcccttttgcagtcatcacttccaccagctgattatgaaggacgggcgggagatagtcgtgccatgtaggaatcaggatgagctagttggacgagcacgtgtgtctcagggcgccggttggagcctgagagagacagcgtgcctcgggaagtcctacgctcaaatgtggcagttgatgtattttcatcgccgggacctgaggcttgccgcaaacgccatctgttcagctgtccctgtggattggattcccactagcagaaccacatggtctatccacgcccatcaccagtggatgactaccgaagacatgctgtccgtatggaatcgcgtttggattgaggaaaacccatggatggaggataaaacgcatatcagtagctggggagacgtgccctacctcggcaagcgggaggaccaatggtgcggctcgttaatagggctgacagcaagggctacctgggccactaatatccaggtcgcgattaaccaggtgcgaagattgatcggaaatgaaaactacctggattatatgacatccatgaaacggttcaagaatgagtctgaccctgaaggtgctctctggtga

SEQ ID NO: 13699 - RNA, 9879 nt, synthetic construct
  misc_feature 1..9879: note = derived and/or modified CDS sequence (opt3) from DENV-1__FJ461336__SS-prME
  source 1..9879: mol_type = other RNA
agcgtgaccatgctgctcatgcttatgcccacggccctggctttccacttgactacgagaggaggggagcctcatatgatcgtctccaagcaggaaagaggaaaatctttactgtttaagacctcagccggtgttaacatgtgcacattgattgccatggacctcggcgagctgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaaacagagattttgtggagggtcttagcggcgccacatgggtagacgttgtgttggagcacgggagttgtgtcaccactatggcgaaggataaacccacactggacatcgaactactcaagaccgaggtgacgaatcctgcagtgctgaggaaactttgcattgaagccaagatctccaacaccacaactgattctcggtgtccaacccaaggagaggctacactggtcgaggaacaagacgccaatttcgtttgccgccgaacttttgtggatagaggctggggtaacgggtgtggattgttcggcaaaggcagcctcataacctgcgcaaagtttaagtgcgtaacaaaactggaggggaagattgtgcagtacgaaaatttaaaatattccgtcatcgtgaccgttcacactggagaccagcatcaagtgggtaacgagtcaacggaacacggcacaaccgctactattacaccccaagcccctaccaccgagatccagctgactgactacggggcgctcacacttgattgtagtccaaggacgggactggacttcaatgaaatggtcttgctaaccatgaaggagaaaagctggctggtgcataagcagtggtttctcgatctgccgcttccctggacttctggcgcctccacatcacaagagacctggaaccggcaggacctgttggtaacattcaaaactgcacacgctaagaagcaggaagttgtggtcctcggtagccaagagggggccatgcacaccgctctgacgggcgccaccgaaatccagacaagtggaactaccacaatttttgcaggccatttaaaatgccgtctgaagatggataaactaactctcaaggggatgtcttatgtgatgtgtaccggatccttcaaactggagaaggaagtcgccgagacgcagcacggtacagtgcttgttcagataaagtacgagggcaccgacgctccttgcaaaatcccattcagcactcaagatgaaaagggggtgacacagaatggacgcttgattaccgcgaaccccatcgtaactgacaaagagaagcctgtcaatatagaagcagagccaccctttggcgagtcgtatattgtgatcggtgccggggaaaaagctctgaagctctcttggttcaagaaaggctcctcaatcggaaagatgtttgaggccaccgcaagaggcgccaggcggatggctattctgggggatacagcctgggacttcggaagtatcggtggcgttcttacgagcgtggggaaactggtccatcagatttttggaaccgcatacggcgtgttgttctccggtgtatcttggactatgaagatagggatcggcgtgctcctgacatggttaggactgaacagccgatcaaccagtctatccatgacatgtattgcggttggcctcgtcactctgtaccttggggtgatggtgcaggctgatagcggatgcgtcatcaattggaaaggccgcgaattgaagtgtggttctgggatctttgttaccaacgaggtgcacacgtggacagaacaatataagttccaggccgactcaccgaaaagactgagtgcagccattggaaaggcttgggaggagggcgtgtgcggtataaggagcgccacccggctcgaaaacatcatgtggaaacagatttccaatgagctgaaccatatcttactggaaaatgacatgaagtttactgtagtcgtgggcgatgttgcagggattcttgctcagggcaagaagatgatccgccctcaacccatggagtacaaatattcttggaagtcgtggggcaaggccaaaataatcggggcggacgtgcagaacaccacattcattatcgatggaccaaatactcctgaatgtcccgacgatcagagagcctggaacatttgggaggtcgaggactacggctttggtatcttcaccacaaatatatggttgaagctcagggatagctatacacaggtgtgcgaccaccgtctgatgtccgctgcaattaaagattcaaaggccgttcacgctgacatggggtactggatcgaaagtgagaaaaacgaaacctggaagctagcccgggcatcttttattgaggtgaagacttgtatctggccaaaaagccatacactgtggtccaatggagtactcgaatcagagatgataatccccaagatttatggcggtcctatcagccaacacaactaccgaccaggctacttcacccagactgcggggccgtggcatctgggaaaacttgagttggatttcgacctgtgcgaaggcacaaccgtcgtggtggatgagcactgcgggaatagaggaccctctttaaggacgactaccgtcacaggcaagattatccacgaatggtgttgccgctcctgtaccctccctccactgcggtttagaggtgaggacgggtgctggtatggaatggagataaggcccgttaaagaaaaggaggaaaaccttgtgaagagtatggtaagcgccggctctggtgaggtggactccttctcactgggcttgctctgtattagtatcatgatcgaagaggtcatgcgcagccgatggtcgcggaaaatgctgatgactgggacactagctgtgtttttcctgctcattatgggacagctgacctggaatgatcttatccgtttgtgcattatggttggcgccaacgcatccgacagaatggggatgggaacaacttacctggctttaatggccacctttaagatgaggcctatgttcgcagtgggcctcctgtttcgccggcttacgtctagagaggtcctgctactcacaataggtctgagcttggtggcctcagttgaactgccaaatagtttagaggaactcggggatggactggctatgggcatcatgattcttaaactgttgaccgacttccaatcccatcagctctgggcgactctgctatctctgacctttatcaagacaactttcagccttcactatgcctggaaaaccatggcaatggtgctctccattgtctcactgtttcccttgtgtctgagcacgacaagtcagaagaccacttggttaccggtactcctgggctctcttgggtgcaagcctctgacaatgttcttgatcgctgagaacaaaatatggggaaggcgatcctggccactcaacgaaggtatcatggccgtgggcattgttagcatcctgctatcgtcactgcttaagaatgatgtgcccctcgccgggcctctgattgctggaggcatgttgatcgcatgttacgtcatatctggtagttccgccgacttaagcctggagaaagcggctgaggtgtcttgggaagaggaagccgagcatagcggggcatcccacaacattctcgtagaagtgcaggatgacggaaccatgaagatcaaagatgaggagcgcgacgatactctgacaatccttctgaaggccaccttgctagctgtctcaggcgtttatcccctgagtattccagcaacgctctttgtgtggtacttctggcagaaaaagaagcagcggagcggcgtgctgtgggacactccttctcccccagaagtcgggagagccgtgcttgatgacggaatatataggatcatgcagcgtggtttactgggccgctcccaggttggggtaggagtgttccaagagaatgtctttcataccatgtggcacgtgacacggggcgcggttctcatgtaccagggtaaaagattggaaccgtcatgggctagtgtgaagaaagacctgattagctacgggggaggctggaggctccagggctcctggaacaccggggaggaggtccaggtgatcgccgtagaacctggaaagaatcccaaaaacgtccaaacagcaccaggtactttcaagacccccgagggcgaagtgggggccattgctctggattttaagcctggaacgtctggctcgccaatcgttaatcgagagggtaaaatagtggggctttatggaaacggcgtcgtgacaactagcggcacctacgtttcagccatcgcacaggctaaggcctcccaggaagggcccctgcctgagattgaggacgaagtgttccggaaacgcaatttgacaatcatggatctacacccgggaagtggtaagaccagaaggtatctgccagcgattgtccgggaggccatcaaacgaaagctcagaactttaatactggcacccacccgcgtggtagcttctgaaatggccgaggctcttaagggcatgcctattaggtaccaaacaacggcagtgaaaagcgaacatactgggaaggagatcgttgacctgatgtgccacgccacctttacaatgcgtctcttgtccccagtccgggtgcccaactataatatgatcattatggatgaggcccatttcaccgacccttcatctatcgctgcgagaggatacataagcactagggtgggcatgggtgaagcagccgctatttttatgacagccaccccgcccgggagtgtcgaggcattcccacagtccaacgccgtaatccaggatgaagaacgcgacattcctgaacgaagctggaactctggatatgagtggatcacggattttcccggcaaaactgtgtggttcgttccatcaataaagtccggcaacgacattgctaattgtctgaggaaaaatgggaagcgggtgatccagctcagtaggaagacatttgataccgagtaccagaaaaccaagaacaatgactgggactacgtcgtgactacagatatcagcgaaatgggagcgaacttccgcgccgaccgtgttattgatcctagacggtgcctgaaacccgtgatccttaaggacggtccagagagggtcattctagcaggcccgatgcctgtgaccgtagcttcggccgcacagcgccgagggagaataggacggaatcacaacaaagaaggcgatcagtatatctacatgggtcagcccctgaataacgacgaggatcatgcccactggacagaggctaagatgttgttagacaatattaacactccagaagggatcatccccgccctgttcgagcctgaaagggagaagtctgcggcaattgatggcgaatatcgcctcagaggagaggccaggaaaacgtttgtggagctgatgcggcgtggcgaccttccagtttggctgtcctacaaggtcgctagcgaagggttccaatattcagatcgccgatggtgctttgacggagagagaaataaccaggtgctcgaagagaatatggatgtggaaatatggaccaaagagggtgagaggaagaaattgcggccccgctggctggacgccagaacatacagtgaccctctagctctgagggagttcaaggagtttgcagccggccggcgatctgtctccggggatctcatccttgaaattggaaaactgccgcagcacttaactcagagagctcaaaacgccttggacaatctggttatgctccataacagcgagcagggcggtcgcgcatataggcacgcgatggaggaactgccagataccatcgagacacttatgctgctcgccttgattgctgtgctgaccgggggcgtaactttattctttctatcaggacggggcctggggaagacgagtatcggactcctttgtgtgatggccagctccgtcctgttgtggatggcatctgtggaaccccattggatagctgccagcatcattctggagttctttctcatggttctgcttatccctgaacccgaccgtcagagaaccccacaggataatcaactcgcatacgtggtcattggtctgttgttcatgatcctgacagtagccgctaacgagatgggcttactagagactaccaagaaagacctggggataggacacgtggcggttgaaaaccaccatcacgccgcaatgctcgatgtggaccttcatcctgcttccgcctggacactgtacgccgtcgcaaccactattatcacacccatgatgaggcacacgattgagaataccactgctaacatctcattgacagccatagcgaatcaggctgccatcctgatgggcctcgataagggttggccaatttctaaaatggacatcggggtgcctctgcttgcattaggctgctatagtcaggtcaacccgctgaccctcaccgccgctgtgttgatgctggttgcacattacgccattatcggacccggcctacaagcgaaggctacacgcgaagcccagaaacggactgcagccgggataatgaagaatccaacggtggatggaattgtagctatcgacctggatcctgtggtctatgacgccaagtttgagaaacagctcggccagatcatgcttctgattttgtgtacctcgcaaatcctgctcatgcgaacaacttgggcactgtgcgaaagcataaccttagctacaggtccccttaccactctgtgggaggggtccccaggaaagttctggaacacgacaattgccgtttctatggcgaatatctttagaggctcatacctcgccggtgcaggcctagctttcagcctgatgaaatccctagggggaggcaggcgcgggaccggagcccagggcgagactctgggtgaaaagtggaaacggcagctcaaccagcttagtaagtctgagttcaatacctataagagaagcgggattatggaagtggaccgttcagaggcaaaagaaggactgaagaggggcgagacaactaaacacgctgtctcccggggtaccgccaagttgcgctggtttgtggagcgaaacctggtaaaacctgaaggcaaggtgatcgatctcgggtgtggaagaggcgggtggagttactattgcgccggattaaagaaagttacagaggtgaagggctacacgaaaggtgggcccggacacgaggaaccgataccaatggcgacctacggctggaatctggtcaaacttcatagcggcaaagacgtgttctttatccctcccgaaaagtgtgatactctgctatgcgacattggggagtcttccccaaaccccacaatcgaggaaggaaggaccctccgggtcctgaaaatggtggagccttggttgcgcggtaatcaattctgtattaagatcctgaacccgtatatgccctcagttgtagaaactctcgagcagatgcagagaaagcacggcgggatgcttgtgaggaatccactgagccgaaactcgacacatgagatgtactgggtctcttgcggaaccggcaatattgtgagtgctgttaacatgacgtcccggatgttactgaaccgttttaccatggcacacagaaaacctacatatgaacgcgatgtggacttgggtgccgggactaggcacgtcgctgtggagcccgaagtagccaatctcgatatcataggacagcggattgagaacatcaagcatgaacacaaaagcacctggcattacgacgaggataatccttataagacatgggcataccacggctcatatgaggtgaaaccatccggctctgccagcagtatggttaacggggtcgtgaagctgctaactaagccctgggacgtgatccctatggtcacccaaattgctatgacagataccactccattcggacagcagagagtttttaaagaaaaggtggacacgcgcacacccaaagcgaagaggggtaccgcccaaataatggaggtaactgcaaaatggctttggggcttcctgtcccgaaataagaagccgcggatctgtaccagagaagagtttacaaggaaagtgcgcagcaacgctgccattggggcagtcttcgtggacgaaaatcagtggaactctgccaaggaggctgttgaggatgaacgtttttgggacctcgtgcatcgggagagagaactgcacaaacagggaaagtgcgccacgtgcgtctacaatatgatgggcaaaagggagaagaagttgggtgagttcgggaaagcgaagggatcacgcgcaatctggtacatgtggctgggcgcccgatttctcgagttcgaggctcttggcttcatgaacgaagatcactggtttagtcgggaaaattccctgagcggggtggaaggagagggtttacataaactgggctatattttgagagacatctctaacatacctgggggaaatatgtacgccgatgacaccgcaggctgggatactaggatcacagaggacgatctccagaacgaagctcgcattaccgacatcatggagccagaacacgccctgctagctaagtcgattttcaaacttacttatcaaaataaggtagttagagtgcagcggcccgccaaaaacggtacagtcatggatgtgatctcaaggcgtgaccagcgagggagcggacaggtgggcacctacggcctgaacacatttactaatatggaggcacaactcatacgccagatggaatccgaggggattttcagtccttctgagctggaaaccccaaacttggcggagagagtcttagattggctggaaaagtatggagttgagcggctcaagaggatggccatcagcggtgacgactgtgtggtaaaacccatcgatgaccgctttgctacggcccttaccgcactgaatgatatgggcaaggtgagaaaagacattccgcagtgggaaccttccaaggggtggaacgattggcagcaagtccccttctgctcacatcactttcaccagctaataatgaaagacggacgggagatcgtggttccatgtaggaatcaggatgagctggtgggccgagctcgtgtcagtcagggtgccgggtggtctctcagagaaacagcatgcttgggaaagagctacgcccaaatgtggcagctgatgtatttccatcgccgggaccttaggctggcggctaacgccatttgttccgcagtgcctgtagattggatccccacttcaagaaccacatggagcattcacgcccatcaccagtggatgactaccgaggacatgctctctgtttggaatcgcgtgtggatcgaagagaacccatggatggaagataagacgcatatatccagttggggcgacgtcccctacttaggcaaacgggaggaccaatggtgcgggagcctgatcggattgacagctagggccacctgggcaactaatattcaggtggctatcaaccaggttcgaagactgattggtaatgagaactacctcgattatatgacatcgatgaagcggtttaaaaatgaatccgaccctgagggcgccctttggtga

SEQ ID NO: 13700 - RNA, 9879 nt, synthetic construct
  misc_feature 1..9879: note = derived and/or modified CDS sequence (opt3) from DENV-1__FJ410266__SS-prME
  source 1..9879: mol_type = other RNA
agcgtgaccatgctgctaatgcttatgcccacagcactggctttccacttgactacgcggggaggggaacctcatatgatcgtcaccaagcaggaaaggggaaaatccttactgtttaagacatctgccggtgttaatatgtgcactctaattgccatggacctcggcgagctgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaggacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaagcgcctaccagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggatcgttcaaactggagaaggaagtggctgagacccagcacggtacggtccttgtgcagataaagtacgagggcacagacgcgccttgcaaaatcccattctcgacccaagatgaaaagggggttactcagaacggacgcttgattacagcaaatcccatcgtgaccgacaaagagaagcctgtaaacatagaagccgagccaccctttggcgagtcttatattgtcatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtgtttacatccgttgggaaacttgtgcatcagattttcggaacggcgtacggcgtcctgttttctggtgtgagctggaccatgaagatagggatcggcgtattgctcacttggctgggattaaattcacgaagtacatccctgagcatgacctgtattgctgtgggcctagttacactctacctgggggtcatggtgcaggccgattctggatgcgtgatcaactggaaaggccgcgaacttaagtgtggttcagggatcttcgtcactaatgaggttcacacctggacggaacaatataagtttcaggcagacagtccgaaaagattgagcgccgctattggaaaggcctgggaggagggcgtgtgcggtataaggtccgcaacacggctggaaaacatcatgtggaaacagatttctaacgagctcaatcatatcctgttagaaaacgacatgaagttcaccgtggtagtcggcgatgtggttgggattctggctcagggcaagaagatgatccgccctcaacccatggagcacaaatactcgtggaaaagctggggcaaggccaagataatcggggcggacgtgcagaatactacctttattatcgatggaccaaacacacctgaatgtcccgacgatcagagagcctggaatatttgggaggtcgaggactatggcttcggtatctttactaccaacatatggcttaagttgagggattcctacacacaggtgtgcgaccaccgtctcatgtcagctgcaattaaagatagtaaggccgttcatgctgacatggggtattggatcgaatctgagaaaaatgaaacgtggaagctggcccgggcatccttcattgaggtgaagacctgtatctggccaaaatcccacactctatggtcaaacggagtactggaaagcgagatgataatccccaagatttacggcggtcctatctctcaacataattatcgaccaggctacttcacacagaccgcggggccgtggcacctcggaaaactggagcttgattttgacttgtgcgaaggcactacagtcgtggtggatgagcactgcgggaacagaggaccctccctgaggaccacgactgtcaccggcaagattatccatgaatggtgttgccgcagttgtacattacctccactccggttcaaaggtgaggacgggtgctggtacggaatggagataagacccgttaaggaaaaggaggaaaatctggtgaaaagcatggtatctgccggctccggtgaggtggactcatttagtcttggcctgttgtgtattagcatcatgatcgaagaggtcatgaggtcgcgctggtccaagaaaatgctcatgaccgggactctggctgtgttcctactgctcattatgggacagctgacatggaacgatcttatccgattgtgcattatggttggcgccaatgcatctgaccggatggggatgggaaccacatatctggctttaatagccacttttaagatgcgtcctatgttcgcagtgggcctcctgtttagaaggcttaccagccgcgaggtcctgctactcacgatcggtctgtcattggtggccagtgttgaactgccaaactccttagaggaactcggggatggactggctatgggcattatgatccttaaactgttgacagacttccaatctcaccagctctgggcgaccctgctcagctttactttcattaagaccacactgtcccttcattacgcctggaagactatggcaatggtgctctcaatcgtcagcctgtttcccttgtgtctgagtaccacgtctcagaaaacaacctggttaccggtactcctgggctcccttgggtgcaagcctctgactatgttcttgatagctgagaataaaatctggggaagaaagagctggccactcaacgaaggtattatggccgtgggcgttgtgtcgatcctgctatcatctctgcttaaaaacgatgtccccctcgccgggcctctgattgctggaggcatgttgatcgcatgttatgtgataagtggttccagcgccgacttatctctggagaaggcggctgaggtaagctgggaagaggaagccgagcactccggggcatcacataatattctcgtggaagtccaggatgacggaacaatgaaaatcaaggatgaggagagagacgataccctgactatccttctgaaggccacattgctagctgttagtggcgtgtaccccctgagcattccagcaaccctctttgtgtggcacttctggcagaagaagaaacagaggtctggcgtcctgtgggacacgccttcacccccagaagtggagcgagccgttcttgatgacgggatatatcgcatcatgcagcggggattactgggtagaagccaggtaggcgtgggggtcttccaagaaaacgtgtttcacactatgtggcatgttaccaggggagcggtgctcatgtaccagggcaagcgtttggagccgagttgggctagcgtcaaaaaggacctgatttcctatggtgggggatggcgcctccagggctcttggaatacaggcgaggaagtgcaggtaatcgccgtcgagcctgggaagaaccccaaaaatgtgcaaaccgcaccaggaacattcaagactcccgaaggtgaggttggcgccattgctctggattttaaacctgggacctcgggaagcccaatcgtgaaccgggaaggcaagatagtcggtctttacgggaatggagtggttacgacatcaggcacttacgtgtccgccatcgcacaggctaaagccagtcaggagggccccctgcctgagattgaagacgaggtcttcagaaagaggaacttgaccatcatggatctacacccggggtctggaaagacacgacggtatctgccagcgattgtgcgcgaagccatcaaaagaaagctcaggaccttaatactggcacccactcgggtagtggctagcgagatggccgaagctcttaaaggtatgcctattcgataccaaaccacagcagttaagtccgagcatacgggcaaagagatcgtcgacctgatgtgccacgccacttttaccatgagactcttgtcaccagtgcgcgtgcccaattataacatgatcattatggatgaagcccatttcacagacccttctagcatcgctgcgagggggtacataagtacccgtgtcggaatgggcgaggcagccgctatttttatgactgccacaccgcccggttccgtagaagcattcccacagagcaatgccgtgatccaggatgaggaacgggacattcctgagagatcttggaactcagggtatgagtggatcaccgattttcccggaaagacggtttggttcgtgccatccataaagagtggcaatgacattgctaactgtctgaggaaaaatggcaagcgcgtcatccagctcagccgaaaaacttttgatacagaataccaaaagaccaaaaacaacgactgggactatgtggttaccactgatatctcggagatgggggcgaatttcagagccgaccgggtgattgatcctaggcgctgcctgaagcccgtcatccttaaggacggaccagaacgtgtgattctagcaggtccgatgcctgtaacagtggcttctgccgcacagagacggggcaggatagggcgcaaccacaataaagagggagatcagtacatctacatgggccagcccctgaacaatgacgaggatcacgcccattggaccgaagctaagatgttgttagacaacattaatacaccagagggtatcatccccgccctgttcgaacctgagcgagaaaaatccgcggcaattgatggggagtatagactccggggcgaggccaggaagacttttgttgaactgatgcgcagaggagaccttccagtctggctgagctacaaagtggcttcagagggcttccaatatagtgataggcggtggtgctttgacggggaacgtaacaatcaggtgctcgaggaaaacatggatgtcgagatatggacgaaggagggagaacgcaaaaagttgcgacccagatggctggacgccaggacctactctgaccctctagctctgcgggagttcaaggaatttgcagccggtcgcagatccgttagcggcgatctcatccttgagattgggaaactgccgcagcacttaacacagagggctcaaaatgccttggacaacctggtgatgctccataattcagaacagggaggccgggcatatcgacacgcgatggaggagctgccagatactatcgaaacccttatgctgctcgccttgattgctgtactgacaggtggggtgaccttattctttctaagtggcagaggactgggcaagactagcatcgggctcctttgtgtcatggcctcctctgtgctgttgtggatggcaagcgttgagccccactggatagctgcctccatcattctggagttctttctcatggtgctgcttatccctgagcccgaccgccagaggacgccacaggataaccaactcgcatacgtcgtaattggactgttgttcatgatcctgaccgtggccgctaatgagatgggtttactagaaacaactaaaaaggacctgggcatagggcatgttgcggtggagaaccaccatcacgccaccatgctcgatgtcgaccttcatcctgcatcagcttggacactgtatgccgtggccaccactattatcacacccatgatgcggcacacgattgaaaacaccactgcaaatatctctttgacagctatagccaaccaggcggctatcctgatgggactcgataaaggctggccaattagtaagatggacatcggtgtccctctgcttgccttagggtgctacagccaggtgaatccgctgaccctcaccgcagccgttttgatgctggtggctcactacgcaattatcggccccggactacaagccaaggcgacacgtgaggctcagaaaagaactgccgcaggcataatgaagaacccaacggtagatgggattgtggccatcgacctggatcctgtcgtttatgacgctaaatttgaaaagcagctcggacagatcatgcttctgattttgtgtaccagccaaatcctgctcatgaggacaacttgggccctgtgcgagtccataaccttagcaacaggcccccttaccactctgtgggagggttctccagggaaattctggaatacgacaattgctgtgtcaatggccaacatctttcgcggaagctacctcgcgggcgccggtctagcattctccctgatgaagagtttgggcgggggacggcgaggcaccggggctcagggagaaactctgggcgagaagtggaaaagacagctcaatcagctttctaagagcgagttcaacacctataaaaggtcaggtattatggaggtcgaccgctccgaagccaaggaggggctgaaacggggagagacaactagacatgcagtgagtcgtggcaccgctaagttgaggtggtttgtagaacggaatctggtgaagcctgagggtaaagttatcgatctcggctgtgggcgcggaggctggagctactattgcgccgggttaaagaaagtgacagaagtcaagggatacacgaaaggcggtcccgggcacgaggaaccgataccaatggccacctatggatggaacctggtgaaacttcattctggcaaagacgtcttctttactcctcccgagaagtgtgatacactgctatgcgacatcggcgagtcctcaccaaatcccaccattgaagaggggcgaactctcagagtgctgaagatggttgaaccttggttgaggggaaaccaattctgtatcaaaattctgaatccgtacatgcccagcgtagtggagacactcgagcagatgcagcggaagcacggtggcatgcttgtccgcaacccactgtcgagaaattctacccacgaaatgtactgggtgagttgcgggacgggaaacatcgtttccgcggtgaatatgaccagcaggatgttactgaaccgatttacaatggctcatcggaaacctacttatgagcgtgatgtcgacttgggcgcaggtaccagacacgtggccgtagaacccgaggtggctaacctcgatattatcgggcagcgcatagaaaatattaagcatgagcacaaatcaacatggcattacgacgaggataacccttataagacttgggcctaccacggatcctatgaagttaagccatctggcagcgcaagttccatggtcaatggcgtggtgaaactgctaaccaagccctgggacgtcatccctatggttacacaaatcgccatgaccgatactacgccattcgggcagcagagggtgtttaaagagaaggtagacacacggacccccaaagctaagagaggaactgcgcaaattatggaagtgaccgccaagtggctttggggtttcctgagccgcaacaaaaagccgaggatatgtacacgagaggaatttacgcggaaagtcagatctaatgcagctatcggcgccgtgttcgttgacgagaaccagtggaactcagcaaaggaggccgtggaagatgagaggttttgggacctcgtccagaaagaacgcgagctgcacaagcaggggaagtgcgctacctgcgtgtacaacatgatgggaaaacgtgaaaagaaattgggcgagttcggtaaggccaaagggagtcgggcgatttggtatatgtggctgggagcaagatttctcgagttcgaagcccttggcttcatgaatgaggatcattggttttccagggaaaacagcctgtctggcgtagagggggagggattacacaagctgggttacatcttgcgcgacatttcgaaaatccctggcgggaatatgtacgctgatgacactgccggatgggatacacgaataaccgaagacgatctccaaaacgaggcaaagatcactgacattatggaaccagagcatgctctgctagccacatcaatcttcaaacttacctatcagaataaagttgtgcgggtccagagacccgctaagaacggcacagtgatggatgtgattagcaggcgcgaccagagaggttccgggcaagtcggaacttacggcctgaatacctttacgaacatggaagcccagctcatccggcagatggagagtgagggcatattcctgcctggggaattggagaccccaaacttagcagaaagggttctggattggctcgagaaatatggagtggaacgtcttaagcgaatggcgatttctggtgacgactgtgtagtgaaacccatcgatgaccgctttgccacagctctgactgccctaaatgatatgggcaaggtcagaaaggacatcccgcagtgggagcctagcaaagggtggaacgattggcaacaggtgcccttctgctcccaccactttcatcagctgattatgaaggacggacgggagatagttgtgccatgtaggaatcaggatgaactcgtcggccgcgcaagagtgtcacaaggtgctgggtggagtttgcgggagaccgcctgcctgggaaaatcttacgcacagatgtggcagcttatgtatttccacaggcgagacctgcgtctcgccgcgaacgctatctgtagcgccgtacctgttgattgggtgcccacatccagaactacctggtcaattcatgcacaccatcaatggatgacgacagaagacatgttaagcgtctggaatcgcgtgtggatcgaggaaaacccatggatggaggataagacccacgtttcttcctggggcgacgtgccctacctgggcaaacgggaggaccagtggtgcgggagtttgattggactgactgccagggctacatgggccagcaatatccaggtcgcaataaaccaggtgagacgcctcatcggtaatgaaaactatcttgattacatgacctcgatgaagcggtttaagaatgagggcgaccctgaaggggctctgtggtga

SEQ ID NO: 13701 - RNA, 9879 nt, synthetic construct
  misc_feature 1..9879: note = derived and/or modified CDS sequence (opt3) from DENV-1__FJ410269__SS-prME
  source 1..9879: mol_type = other RNA
tccgtgaccatgctgctcatgcttatgcccacagcactggctttccacttgactacgaggggaggggaacctcatatgatcgtcaccaagcaggaaaggggaaaatccttactgtttaagacatctgccggtgttaatatgtgcactttaattgccatggacctcggcgaactgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggttgacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggatcgttcaaactggagaaggaagtggctgagacccagcacggtacggtccttgtgcagataaagtacgagggcacagacgcgccttgcaaaatcccattctcgacccaagatgaaaagggggttattcagaacggacgcttgatcactgcaaatcccatagtgacagacaaagagaagcctgtaaacattgaagccgagccaccctttggcgagtcttatatcgtcatcggtgtgggggaaaaagctctgaagctctcctggttcaagaaaggctcaagtattggaaagatgtttgaggccaccgcaagaggcgccaggcggatggctatcctgggggatactgcctgggacttcggaagcattggtggcgtttttacctccgtggggaaacttgtccatcagatattcggaacagcatacggcgtgctgttttctggtgtaagctggacgatgaagatcgggattggcgtgttgctcacctggctgggattaaattcacgaagtacttccctgagcatgacatgtatcgcggttggcctagtcaccctctacctgggggtgatggtgcaggctgattctggatgcgtcatcaactggaaaggccgcgaacttaagtgtggttcagggattttcgttacaaatgaggtgcacacttggaccgaacaatataagtttcaggccgacagtccgaaaagattgagcgcagccataggaaaggcttgggaggagggcgtgtgcggtatcaggtccgtaacgcggctggaaaacattatgtggaaacagatctctaacgagctcaatcatattctgttagaaaacgacatgaagttcacagtcgtggttggcgatgtggtcgggatcctggcccagggcaagaagatgatacgccctcaacccatggagcacaaatactcgtggaaaagctggggcaaggcaaaaatcattggggctgacgtgcagaataccacttttatcattgatggaccaaacacccctgaatgtcccgacgatcagagagcctggaatatctgggaggttgaggactatggcttcggtatatttacaactaacatttggcttaagttgagggattcctacacccaggcgtgcgaccaccgtctcatgtcagccgctatcaaagatagtaaggcagtgcatgccgacatggggtattggattgaatctgagaaaaatgaaacatggaagctggctcgggccagcttcatcgaggtaaagacgtgtatatggccaaaatcccacaccctatggtcaaacggagtcctggaaagcgagatggtgatccccaagatttacggcggtcctatctctcaacataattatcgaccaggctacttcactcagacagcagggccgtggcacctcggaaaactggagcttgattttgacttgtgcgaaggcaccactgtggtcgttgatgagcactgcgggaacagaggaccctccctgaggacaaccacggtgactggcaagattatccatgaatggtgttgccgcagttgtaccttacctccactccggttcaaaggtgaggacgggtgctggtacggaatggagataagacccgtaaaggaaaaggaggaaaatctggtgaaaagcatggtctctgcgggctccggtgaggtggactcatttagtcttggcctgttgtgtattagcatcatgatcgaagaggttatgaggtcgcgctggtcccgaaagatgctcatgacagggaccctggccgtgttcctactgctcattatgggacagctgacttggaacgatcttatccggttgtgcattatggtcggcgctaatgcctctgaccgtatggggatgggaacaacctatctggcattaatggctacatttaaaatgagacctatgttcgccgtgggcctcctgtttaggcgccttactagccgggaggttctgctactcaccataggtctgtcattggtggcaagtgtcgaaatcccaaactccctggaggaattaggggatggactcgccatgggcattatgatcctgaaacttctgacggacttccaatctcaccagttgtgggctacactcctgagcctaacctttattaaaactaccctgtcccttcattacgcgtggaagacaatggccatggtactctcaatcgtgagcctgttccccttgtgtctgagtactacctctcagaagacgacatggttaccggttctcctgggctcccttgggtgcaaacctctgaccatgtttttgatagcagagaataagatctggggaagaaaaagctggccactcaacgaaggtattatggctgtgggcgtcgtgtcgatcctgctatcatctctgcttaagaacgatgtacccctcgccgggcctctgattgccggaggcatgttgatcgcttgttatgtgataagtggttccagcgcagacttatctctggagaaagccgcggaggtcagctgggaagaggaagctgagcactccggggcctcacataatattctcgttgaagtgcaggatgacggaactatgaagatcaaagatgaggagagggacgatacactgaccatccttctgaaggcaactttgctagccgtgagtggcgtctaccccctgagcattccagctacactcttcgtgtggtatttttggcaaaagaaaaagcagcgatctggcgttctgtgggacaccccttcacccccagaagtagagcgcgcagtgcttgatgacgggatataccggatcatgcagagaggattactgggtaggagccaggtcggcgtgggggttttccaagaaaacgtgttccacacgatgtggcacgtcactcgtggagccgtgctcatgtatcagggcaaacgcttggagccgagttgggcgagcgtaaagaaagacctgatttcctacggtgggggatggcggctccagggctcttggaataccggcgaggaagtccaggtgatcgctgttgagcctgggaagaaccccaagaatgtgcaaacagccccaggaacctttaaaacacccgaaggtgaggtcggcgcaattgccctggatttcaagcctgggacttcgggaagcccaatcgtgaacagagaaggcaaaatagttggtctttacgggaatggagtggtcaccacgtcaggcacatatgtgtccgctatcgcccaggcaaaggctagtcaggagggccccctgcctgagattgaagacgaggtatttaggaaacgaaacttgactatcatggatctacatccggggtctggaaagacccggcgctacctgccagccattgtgagagaagcgatcaagaggaaactccggacattaatactggcccccacccgagttgtcgcaagcgagatggctgaagcccttaagggtatgcctattagatatcaaactaccgctgtgaaatccgagcacacaggcaaggagatcgtggacctgatgtgccatgcaacgttcactatgcgcctcttgtcaccagtcagggtacccaattacaacatgatcattatggatgaagcccactttaccgacccttctagcatcgccgctcgtgggtatataagtacacgggtgggaatgggcgaggcggcagccattttcatgaccgctactccgcccggttccgttgaagcctttccacagagcaatgcagtgatccaggatgaggaaagagacattcctgagaggtcttggaactcagggtacgagtggatcacagatttccccggaaaaaccgtctggtttgtgccatccataaagagtggcaatgacattgccaactgtctgcgcaagaatggcaaacgagttatccagctcagcagaaagacgttcgatactgaatatcagaaaaccaagaacaacgactgggactacgtggtcaccaccgatatctcggagatgggggctaattttcgggcggacagggtgattgatcctcgccgttgcctgaaacccgtaatccttaaggacggaccagaaagagtgattctagccggtccgatgcctgttactgtcgcatctgctgcccagcggaggggccgcatagggcgaaaccataataaggagggagatcagtacatctatatgggccagcccctgaacaatgacgaggatcacgcacactggacagaagccaaaatgttgttagacaacattaataccccagagggtatcatccccgctctgttcgaacctgagagagaaaagtccgccgcgattgatggggagtaccggctcaggggcgaggcacgcaaaacattcgtggaactgatgagaaggggagaccttccagtgtggctgagctataaggtcgcctcagagggctttcaatacagtgatcggcgttggtgcttcgacggggaacgcaacaatcaggttctcgaggaaaacatggatgtggagatatggactaaagagggagaacgaaagaaattgagacccaggtggctggacgctcggacgtattctgaccctctagccctgcgcgagtttaaggagttcgctgcaggtagaaggtccgtaagcggcgatctcatccttgagattgggaagctgccgcagcatttaacccagcgggcccaaaatgctttggacaacctggtgatgctccacaattcagaacagggaggccgagcctacagacatgcaatggaggagctgccagatacaatcgaaactcttatgctgctcgcgttgattgccgtcctgaccggtggggtgacattatttttcctaagtggccgcggactgggcaaaaccagcatcgggctcctttgtgttatggcttcctctgtgctgttgtggatggccagcgtcgagccccactggatagcagcttccatcattctggaatttttcctcatggtactgcttatccctgagcccgacaggcagcggactccacaggataaccaactcgcctatgtggttattggactgttgtttatgatcctgacggtggcagccaatgagatgggtttactagaaaccacaaagaaagacctgggcatagggcacgtcgctgtggagaaccatcaccatgcgactatgctcgatgtcgaccttcaccctgcctcagcatggaccctgtacgctgtggccacaaccattatcactcccatgatgcgtcatacaattgaaaacacgaccgccaatatctctttgactgcaatagctaaccaggccgcgatcctgatgggactcgataagggctggccaattagtaaaatggacatcggtgttcctctgcttgctttagggtgctacagccaggtgaatccgctgacactcaccgccgcagtattgatgctggtggcccactatgctattatcggccccggactacaagcaaaggccaccagagaggcgcagaagaggacagctgccggcataatgaaaaacccaactgtcgatgggattgttgcaatcgacctggatcctgtggtctacgacgccaagttcgaaaaacagctcggacagatcatgcttctgattttgtgtacgagccaaatcctgctcatgcgcaccacatgggctctgtgcgagtccataactttagccaccggcccccttacaaccctgtgggagggttctccagggaagttttggaatactacgattgcagtgtcaatggctaacatcttccggggaagctatctcgccggcgcgggtctagccttttccctgatgaaaagtttgggcgggggacgaagaggcacaggggcacagggagaaaccctgggcgagaagtggaagaggcagctcaatcagctttctaaaagcgagttcaacatttacaagcgctcaggtatcatggaggtagaccggtccgaagctaaagaggggctgaagagaggagagactacccgtcacgccgtgagtaggggcacagcaaaattgcggtggttcgttgaacgcaatctggtgaagcctgagggtaaggtcatagatctcggctgtgggcgaggaggctggagctattactgcgctgggctaaagaaggtgactgaagtcaaaggatataccaagggcggtcccgggcatgaggaaccgatcccaatggccacatacggatggaacctggtgaaacttcactctggcaaggacgtatttttcacgcctcccgagaaatgtgataccctgctatgcgacattggcgagtcctcaccaaatcccactatcgaagaggggagaacactcagggtactgaagatggtggaaccttggttgcggggaaaccaattttgtattaagatcctgaatccgtacatgcccagcgtcgtggagaccctcgagcagatgcagcgcaaacatggtggcatgcttgttagaaacccactgtcgagaaattctactcacgaaatgtattgggtgagttgcgggacaggaaacattgtctccgccgtgaatatgaccagccgaatgttactgaaccggttcacgatggcgcaccgtaagcctacctacgagagagatgtagacttgggcgctggtacacgccatgtggcagttgaacccgaggtcgccaacctcgatatcatagggcagaggattgaaaatatcaaacacgagcataagtcaacttggcactatgacgaggataacccttacaaaacctgggcttatcatggatcctacgaagtgaagccatctggcagcgccagttccatggtgaatggcgtcgttaagctgctaacaaaaccctgggacgtgatccctatggtaactcaaattgcaatgaccgatacaaccccatttgggcagcagcgggtgttcaaggagaaagtcgacactagaacgcccaaggccaaacgcggaacagctcaaataatggaagtgaccgcgaggtggctttggggttttctgagccgaaacaagaagccgcggatctgtactagagaggagttcaccaggaaagttcgctctaatgccgcaattggcgctgtgtttgtcgacgagaaccagtggaactcagccaaggaggcagtggaagatgagcgtttctgggacctcgtacagaaagaacgggagctgcacaagcaggggaaatgcgccacatgcgtttataacatgatgggaaagagagaaaagaaattgggcgagtttggtaaggctaaagggagtagggccatctggtacatgtggctgggagcgcgcttcctcgagtttgaagcacttggcttcatgaatgaggatcactggttctcccgagaaaacagcctgtctggcgtggagggggagggattacataagctgggttacattttgcgggacatctcgaaaatacctggcgggaatatgtatgccgatgacacggctggatgggataccagaatcactgaagacgatctccaaaacgaggccaagattacagacatcatggaaccagagcacgcactgctagctacctcaatttttaaacttacttaccagaataaggtcgtgagggtgcagcgccccgccaagaacggcacagtcatggatgttatcagcagacgggaccagaggggttccgggcaagtgggaacctatggcctgaatacattcactaacatggaagctcagctcatacgtcagatggagagtgagggcatttttctgccttctgaattggagaccccaaacttagccgaacgagtactggattggctcgagaaacatggggtggaacgccttaagagaatggcaatcagcggagacgactgtgtcgtgaaacccatcgatgaccggttcgcgacggccctgaccgctctaaatgatatgggtaaggttaggaaagacattccgcagtgggagccttccaagggctggaacgattggcaacaggtgcccttttgctcacaccacttccatcagctgataatgaaggacgggcgcgagatcgtcgtgccatgtagaaatcaggatgaactcgtaggacgggccagggttagtcaaggcgcaggttggtctttgcgagagacagcttgcctggggaaaagctacgcccagatgtggcagcttatgtattttcaccgtagagacctgcgcctcgcagccaacgcgatttgttccgctgtgcctgtcgattgggtgcccacttcacggaccacatggagcatccatgcccaccatcaatggatgactaccgaagacatgttatctgtttggaatagggtgtggattgaggaaaacccatggatggaggataagacgcacgtctccagttggggagacgtgccctacctgggcaaaagagaggaccagtggtgcggcagcttgatcgggctgacagcacgcgccacctgggcttcgaatatacaggtagccatcaaccaggtgcggaggctcattggaaatgaaaactatcttgattacatgacttccatgaagcgattcaaaaatgagggtgaccctgaaggcgcactgtggtga

SEQ ID NO: 13702 - RNA, 9879 nt, synthetic construct
  misc_feature 1..9879: note = derived and/or modified CDS sequence (opt3) from DENV-1__FJ410273__SS-prME
  source 1..9879: mol_type = other RNA
agcgtgaccatgctgctcatgcttatgcccacagcactggctttccacttgactacgagaggaggggagcctcatatgatcgtctccaagcaggaaaggggaaaatctttactgtttaagacctcagccggtgttaatatgtgcacactaattgccatggacctcggcgagctgtgtgaagatactatgacctacaaatgcccacggattacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccgtgctgaggaaactttgcattgaagctaagatctctaatacgaccacagatagccggtgtccaactcaaggagaggccaccctggtcgaagaacaagacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctagcaccgagatccagctgacagactacggggccctcacccttgattgttctccaaggactggactggacttcaacgaaatggtcttgctaacaatgaaggagaaatcctggctggtgcataagcagtggtttctcgatctgccgcttccctggacgtcaggcgcaagcaccagtcaagagacttggaatcggcaggacctgttggtaacattcaaaaccgctcacgccaagaagcaggaagttgtggtcctcggttctcaagagggggctatgcacacagccctgactggcgcaaccgaaatccagacgtccggaaccacaactatttttgccggccatttaaaatgccgtctgaagatggataaactaaccctcaaggggatgagctatgtgatgtgtacaggatcgttcaaactggagaaggaagtcgctgagactcagcacggtaccgtgcttgttcagataaagtacgagggcacggacgcgccttgcaaaatcccattctctacacaagatgaaaagggggtgacccagaacggacgcttgattactgcaaatcccatcgtaacagacaaagagaagcctgtcaacatagaagccgagccaccctttggcgagtcctatattgtgatcggtgctggggaaaaagccctgaagctctcatggttcaagaaaggcagtagcatcggaaagatgtttgttgcaaccgccagaggcgctaggcggatggccattctgggggatactgcatgggacttcggatccatcggtggcgtgtttacctctgtcgggaaacttgtgcatcagattttcggaacagcgtacggcgtactgtttagcggtgtgtcatggacgatgaagatagggatcggcgttttgctcacctggctgggattaaatagtcgatccactagcctgtctatgacatgtattgctgtcggcctagtgaccctctacctgggggtgatggtccaggccgattcaggatgcgttatcaactggaaaggccgcgagcttaagtgtggtagtgggatcttcgtgacaaatgaagtgcacacttggaccgagcaatataagtttcaggcagacagcccgaaaagattgtccgccgctattggaaaggcctgggaagagggcgtatgcggtataaggtctgcaacgcggctggagaacatcatgtggaaacagatttcgaacgaactcaatcatatcctgttagagaacgacatgaagttcacagtcgtggttggcgatgtggctgggattctgacccagggcaagaaaatgatccgccctcaacccatggaatacaaatatagctggaagtcctggggcaaggccaaaataatcggggcggacgtccagaatactacctttattatcgatggaccaaacacacctgagtgtcccgacgatcagagagcctggaatatttgggaagtggaggactacggcttcggtatctttactaccaacatatggcttaagttgagggattcatatacacaggtttgcgaccaccgtctcatgagtgctgcaattaaagattctaaggccgtgcacgctgacatggggtactggatcgagagcgagaagaatgagacgtggaagctggcccgggcatccttcattgaagtaaagacctgtatctggccaaaatcacatactctatggagcaacggagtcctggagtctgaaatgataatccccaagatttatggcggtcctatctcccaacacaattaccgaccaggctacttcacacagaccgcggggccgtggcatctcggaaaactggagcttgattttaacttgtgcgagggcactacagtggtggtcgacgaacactgcgggaatagaggacccagtctgaggaccacgactgttaccggcaagattatccacgagtggtgttgccgcagctgtacattacctccactccggttcaaaggtgaagatgggtgctggtatggaatggagataagacccgtgaaggagaaggaagagaacctggtaaaatctatggtgtccgccggctcaggtgaagtcgacagttttagccttggcctgttgtgtatttcgatcatgatcgaggaagtgatgaggtcccgctggtctcgaaagatgctcatgaccgggactctggctgttttctttctactgattatgggacagctcacatggaatgacctgatccggctttgcattatggtgggcgccaacgcaagcgatcgtatggggatgggaaccacatacttggctctgatggccactttcaaaatgagacctatgttagcagtcggcctcctgtttaggcgccttacctcacgggaggtgctgctactcacgataggtctgagtttggttgcctccgtggagctgccaaattctttagaagaactcggggacggactggctatgggcatcatgattcttaagctgttgacagatttccaaagccatcagctctgggcgaccctgctatccctgacttttatcaaaaccacatattcacttcactacgcctggaagactatggcaatggtcctcagcattgtaagtctgttccccttgtgtctgtctaccacgtcccagaagacaacctggttaccggtgctcctgggcagccttgggtgcaaacctctgactatgtttttgatcgctgaaaacaagatatggggaagaaaatcgtggccactcaacgagggtatcatggccgttggcattgtgtcaatcctgctatctagtctgcttaagaatgacgtccccctcgccgggcctctgattgctggaggcatgttgatcgcatgttatgtgatatccggtagctctgccgatttaagcctggaaaaagcggctgaggtatcctgggaggaagaggccgaacattcaggggcaagtcacaacattctcgtggaggtccaggacgatggaacaatgaagatcaaagacgaagagagggatgacaccctgactatccttctgaaggccacattgctagctgttagcggcgtgtaccccctgtctattccagcaaccctcttcgtgtggtatttttggcaaaagaaaaagcagcgatccggcgtcctgtgggatacgccttcacccccagaggtggaacgcgccgttcttgacgatgggatataccggatcatgcagagaggattactgggtaggagtcaggtaggcgtgggggtcttccaagagaatgtgttccatactatgtggcacgttacccgtggagcggtgctcatgtaccagggcaaacgcttggaaccgagctgggcttccgtcaagaaagacctgatttcttatggtgggggatggcggctccagggctcgtggaacacaggcgaggaggtgcaggtaatcgccgtcgaacctgggaagaatcccaagaacgtgcaaaccgcaccaggaacatttaaaactagcgagggtgaagttggcgccattgctctggacttcaagcccgggacctcaggatcccctatcgtgaatagagagggcaaaatagtcggtctttacgggaacggagtggttacgacaagtggcacttatgtgtctgccatcgcacaggctaaggccagccaggaaggcccactgcccgagattgagaatgaagtctttaggaaacgaaacttgaccatcatggatctacaccctgggtccggaaagacacggcgctacctgccggcgattgtgagagaggccatcaagaggaaactccggaccttaatactggcaccaactcgagtagtggcttcagaaatggccgaggctcttaagggtatgcccattagatatcaaaccacagcagttaaatctgaacatacgggcaaggagatcgtcgacctgatgtgccacgccactttcaccatgcgcctcttgagccctgtgagggtgccaaattacaacatgatcattatggatgaggcccattttacagaccccagttccatcgctgcgcgtgggtatataagcacccgggtcggaatgggcgaagcagccgctattttcatgactgccacacctccgggttctgtagaggcatttccccagtcaaatgccgtgatccaggatgaagagagagacattccagaaaggtcctggaacagtgggtacgagtggatcaccgatttccctggaaaaacggtttggtttgtgcccagcataaagtcgggcaatgacattgctaactgtctgcgcaagaacggcaaacgagtcatccagctctctagaaagactttcgatacagagtaccagaaaaccaagaataacgactgggattatgtggttaccactgacatctccgaaatgggggcgaattttcgggccgacagggtgattgatccacgccgttgcctgaaacctgtcatccttaaggacggacccgagagagtgattctagcaggtccaatgccggtaacagtggctagcgccgcacagcggaggggccgcatagggcgaaaccacaataaggaaggagatcagtacatctatatgggccagcctctgaacaatgacgaggatcatgcccactggaccgaggctaaaatgttgttagacaacattaatacacccgaaggtatcatcccagccctgttcgagcccgaaagagagaagtcagcggcaattgatggggaataccggctcaggggcgaggcccgcaaaactttcgttgagctgatgagaaggggagaccttcctgtctggctgagttataaggtggcttctgaaggctttcaatactccgatcggcgttggtgcttcgacggggagcgcaacaatcaggtgctcgaagagaacatggatgtcgaaatatggacgaaagagggagagcgaaagaaattgagaccaaggtggctggacgcccggacctatagcgatcccctagctctgcgcgaatttaaggagttcgcagccggtagaaggtcagttagtggcgacctcatccttgaaattgggaagctgcctcagcacttaacacagcgggctcaaaatgccttggacaacctggtgatgctccataatagcgagcagggaggccgagcatacagacacgcgatggaggaactgccggatactatcgagacccttatgctgctcgccttgattgctgtactgacaggtggggtgaccttatttttcctatccggccgcggactgggcaaaacttctatcgggctcctttgtgtcatggccagctccgtgctgttgtggatggcatcagttgaaccacattggatagctgcctctatcattctggagtttttcctcatggtgctgcttatccccgaacctgacaggcagcggacgccccaggataaccaactcgcatacgtcgtaattggactgttgtttatgatcctgaccgtggccgctaacgagatgggtttactagagacaactaagaaagacctgggcatagggcacgttgcggtggaaaatcaccatcacgccgcaatgctcgatgtcgaccttcatccagctagtgcctggaccctgtatgccgtggcaacaaccattatcactcctatgatgcgtcacacaattgagaacacgaccgctaatatctcgttgactgccatagcgaaccaggctgccatcctgatgggactcgataagggctggcccattagcaaaatggacatcggtgtcccactgcttgcattagggtgctactcccaggtgaatcctctgacactcaccgccgctgttttgatgctggtggcacattatgccattatcggcccgggactacaagcgaaggctaccagagaagcccagaagaggacagcagccggcataatgaaaaaccccactgtagatgggattgtggctatcgacctggatccagtcgtttacgacgccaagttcgagaaacagctcggacagatcatgcttctgattttgtgtacgtctcaaatcctgctcatgcgcaccacatgggcactgtgcgaatcaataactttagctaccggccctcttacaaccctgtgggagggtagccccgggaagttttggaatactacgattgccgtgtccatggcgaacatcttccggggaagttatctcgccggcgcaggtctagctttttctctgatgaagtcattgggcgggggacgaagaggcacaggggcccagggagagaccctgggcgaaaagtggaagaggcagctcaatcagcttagcaaatccgagttcaacacttacaagcgcagtggtattatggaagtcgatcggagcgaggcaaaagaagggctgaagagaggagagaccacaaaacacgctgtgtctcgtggcactgccaagttgaggtggttcgtagagcggaatctggtgaagccagaaggtaaagttatcgacctcggctgtgggcgcggaggctggtcctattactgcgccgggttaaagaaagtgaccgaggtcaagggatacacaaaaggcggtcctgggcacgaggagcccataccgatggcgacgtatggatggaacctggtgaaacttcattcaggcaaagacgtctttttcatcccacctgaaaagtgtgataccctgctatgcgacattggcgagagctcgcccaatccaactatcgaggaagggcgaacactcagagtgctgaagatggttgagccctggttgaggggaaaccaattttgtattaaaatcctgaatccttacatgccgtctgtagtggaaaccctcgagcagatgcagcggaagcacggtggcatgcttgtccgcaaccccctgagtagaaattccactcatgagatgtattgggtgagctgcgggacaggaaacattgtttcagctgtgaacatgacctccaggatgttactgaatcgattcacgatggcacaccggaaaccaacctacgaacgtgatgtcgacttgggcgccggtacaagacacgtggctgtagagcctgaagtggccaacctcgatatcatagggcagcgcattgagaatatcaagcatgaacacaaatctacttggcattatgacgaggataacccctacaagacctgggcatatcacggaagctacgaggttaagcctagtggctccgccagctctatggtcaatggcgtggtgaaactgctaacaaagccatgggacgtcatccccatggttactcaaattgctatgaccgatacaaccccttttgggcagcagagggtgttcaaagaaaaggtagacactcggacgccaaaagcgaagagaggaacagcccaaataatggaggtgaccgcaaagtggctttggggttttctgtcacgcaacaaaaagcccaggatctgtactcgagaagagttcacccggaaagtcagaagtaatgctgccattggcgcagtgtttgttgatgaaaaccagtggaactccgccaaggaggctgtggaggacgaaaggttctgggacctcgtccatcgcgagcgtgaactgcacaaacaggggaagtgcgccacatgcgtgtacaacatgatgggaaagcgggagaaaaagttgggcgaatttggtaaagcgaaggggagcagagcaatctggtatatgtggctgggagccaggttcctcgagtttgaggctcttggcttcatgaatgaagatcactggttctctcgcgagaactcgctgtcaggcgtagaaggggagggattacataaactgggttacattttgcgagacatcagcaagataccgggcgggaatatgtatgccgatgacacggcaggatgggatacccggatcactgaggacgatctccagaacgaagctaaaattacagacatcatggagcctgaacacgccctgctagctaagtccatttttaaacttacctaccaaaataaagttgtgagagtccagaggccagccaagaacggcactgtgatggatgtgatcagtcgcagagaccagcggggttctgggcaggtcggaacatatggcctgaacaccttcacaaatatggaggcacaactcataaggcagatggaaagcgagggcatattttccccctcagagctggaaactcctaacttggcggggcgtgttttagattggctggagaaacatggagtggaacgactcaagcgcatggccatcagtggtgacgattgtgtagtgaaaccaatcgacgacagattcgctaccgcccttacggcactgaatgatatgggcaaggtccggaaggacattccccagtgggagccgtctaaagggtggaacgattggcagcaagtgcctttttgcagccaccacttccatcagctaataatgaaggacggaagggaaatcgttgtgccctgtcgcaatcaggatgagctggtcggcagagctcgggtgtcccagggtgccgggtggtcactcagggagaccgcatgcttgggaaaaagctacgcccaaatgtggcagctgatgtattttcaccgacgtgaccttagactggcggctaacgccatttgttctgcagtaccagttgattgggtgcctacatcccgcactacctggagtatccatgcccaccatcagtggatgacaactgaagacatgctcagcgtctggaatcgggtgtggattgaggaaaacccctggatggaggataagacccacatctcgtcctggggcgacgttccatacttaggcaaaagggaagatcaatggtgcgggtctctgataggattgacggctagagccacatgggcaaccaatatccaggtggctattaaccaggtccgccggctgatcggtaatgagaactacctcgactatatgacttcaatgaagaggttcaagaatgagagcgaccccgaaggcgccctttggtga

SEQ ID NO: 13703 - RNA, 9879 nt, synthetic construct
  misc_feature 1..9879: note = derived and/or modified CDS sequence (opt3) from DENV-1__FJ410276__SS-prME
  source 1..9879: mol_type = other RNA
agcgtgaccatgttcctgatgctcatgcccacggcccttgcttttcacctgactacgcggggaggggaacctcatatgatcgtctccaagcaggaaagggggaaatctttgttattcaagacctcagccggtgttaatatgtgcacactgattgccatggacctaggagaactctgtgaagatactatgacctacaaatgcccacggataacagagaccgaaccggacgatgtggactgttggtgcaatgcgactgatacatgggtaacctatgggacgtgtagtcaaactggggagcaccgccgagacaagcgtagcgtggctctggcaccccatgtcggccttggtctggagaccagaacagaaacttggatgtcctctgagggggcatggaaacagatccagagggtggaaacctgggccttgcggcaccctggatttacagttattgctctcttcctggcacatgccatcggcacctcgattacgcagaagggcatcatatttatcctgctcatgttagtgactccatcaatggctatgcgctgcgtcgggattggaagcagagatttcgtggagggtctgagtggcgccacatgggtagacgttgtgcttgagcacgggtcctgtgtcaccactatggcgaaggataaacccacattggacatcgaactgctaaagaccgaggtgacgaaccctgcagtgctcaggaaactgtgcattgaagccaagatctctaataccacaactgatagccggtgtccaacccaaggagaggctacacttgtcgaagaacaggacgccaactttgtttgccgccgaactttcgtggatagaggctggggtaatgggtgtggactgtttggcaaaggctccttgataacctgcgcaaagttcaagtgcgtaacaaaactcgaggggaagattgtgcagtacgaaaacctgaaatattcagtcatcgtgaccgttcacactggagaccagcatcaagtgggtaatgagagtacggaacacggcacaaccgctactattacaccccaagcccctaccaccgagatccagttaactgactacggggcgctgacactcgattgtagcccaaggacgggacttgactttaacgaaatggtcctgttgaccatgaaggagaaatcttggctagtgcataagcagtggttcctggatctcccgctgccctggacttccggcgcctcaacaagccaagagacctggaatcggcaggaccttctggtaacatttaaaactgcacacgctaagaagcaggaagttgtggtcttgggtagtcaagagggggccatgcacaccgctctcacgggcgccaccgaaatccagacatctggaactaccacaattttcgcaggccatctgaaatgccgtttaaagatggataaactgactctaaaggggatgtcctatgtgatgtgtaccggcagcttcaaactcgagaaggaactggccgagacgcagcacggtacagtccttgtgcagataaagtacgagggcaccgacgctccttgcaaaatcccatttttgactcaagatgaaaagggggttacacagaacggacgcctgattaccgcgaatcccatcgtgactgacaaagagaagcctgtaaacatagaagcagagccacccttcggcgagtcgtatattgtcatcggtgccggggaaaaagctctcaagctgtcttggtttaagaaaggctcctcaatcggaaagatgttcgaggccaccgcaagaggcgccaggcggatggctattcttggggatacagcctgggactttggaagtatcggtggcgtgttcacgagcgttgggaaactggtgcatcagatttttggaaccgcatacggcgtcttgttctccggtgtgtcttggactatgaagatagggatcggcgtactcctgacatggttaggactgaatagccgatcaaccagtctatccatgacatgtattgcggtgggcctcgttactctgtaccttggggtcatggtgcaggctgatagcggatgcgtgatcaactggaaaggccgcgaattgaagtgtggttctgggatctttgtcaccaatgaggttcacacgtggacagaacaatataagttccaggccgactcaccgaaaagactgagtgcagccattggaaaggcttgggaggagggcgtgtgcggtataaggagcgccacccggctcgaaaacatcatgtggaaacagatttccaacgagctgaatcatatcttactggaaaacgacatgaagtttactgtggtagtcggcgatgtggcagggattcttgctcagggcaaaaagatgatccgccctcaacccatggagtacaaatattcttggaagtcgtggggcaaggccaaaataatcggggcggacgttcagaataccacattcattatcgatggaccaaacactcctgaatgtcccgacgatcagagagcctggaatatttgggaggtggaggactacggctttggtatcttcaccacaaacatatggttgaagctcagggatagctatacgcaggtctgcgaccaccgtctgatgtccgctgcaattaaagattcaaaggccgtgcacgctgacatggggtactggatcgaaagtgagaaaaatgaaacctggaagctagcccgggcatctttcattgaggttaagacttgtatctggccaaaaagccatacactgtggtccaacggagtgctcgaatcagagatgataatccccaagatttatggcggtcctatcagccaacacaattaccgaccaggctactttacccagactgcggggccgtggcatctgggaaaacttgagttggatttcgacctgtgcgaaggcacaaccgtagtcgtggatgagcactgcgggaacagaggaccctctttaaggacgactaccgtgacaggcaagattatccacgaatggtgttgccgctcctgtaccctccctccactgcggtttagaggtgaggacgggtgctggtatggaatggagataaggcccgtcaaagaaaaggaggaaaatcttgttaagagtatggtgagcgccggctctggtgaggtagactccttctcactgggcttgctctgtattagtatcatgatcgaagaggtgatgcgcagccgatggtcgcggaaaatgctgatgactgggacactagctgtctttttcctgctcattatgggacagctgacctggaacgatcttatccgtttgtgcattatggtgggcgccaatgcatccgacagaatggggatgggaacaacttacctggctttaatggccacctttaagatgaggcctatgttcgcagttggcctcctgtttcgccggcttacgtctagagaggtgctgctactcacaataggtctgagcttggtcgcctcagtggaactgccaaacagtttagaggaactcggggatggactggctatgggcatcatgattcttaaactgttgaccgacttccaatcccatcagctctgggcgactctgctatctctgacctttatcaagacaactttcagccttcactatgcctggaaaaccatggcaatggttctctccattgtgtcactgtttcccttgtgtctgagcacgacaagtcagaagaccacttggttaccggtcctcctgggctctcttgggtgcaagcctctgacaatgttcttgatcgctgagaataaaatatggggaaggcgatcctggccactcaacgaaggtatcatggccgtaggcattgtgagcatcctgctatcgtcactgcttaagaacgatgttcccctcgccgggcctctgattgctggaggcatgttgatcgcatgttacgtgatatctggtagttccgccgacttaagcctggagaaagcggctgaggtctcttgggaagaggaagccgagcatagcggggcatcccacaatattctcgtggaagtacaggatgacggaaccatgaagatcaaagatgaggagcgcgacgatactctgacaatccttctgaaggccaccttgctagctgtgtcaggcgtctatcccctgagtattccagcaacactcttcgtttggtacttttggcagaaaaagaagcagcggagcggcgtgctgtgggacactccttctcccccagaagtggagagagccgtccttgatgacgggatatataggatcatgcagcgtggattactgggtcgctcccaggtgggcgttggggtattccaagaaaacgtgtttcataccatgtggcacgtcacacggggagcggtgctcatgtaccagggcaaaagattggagccgtcatgggctagtgttaagaaagacctgattagctacggtgggggatggaggctccagggctcctggaataccggcgaggaagtgcaggtcatcgccgtggagcctgggaagaaccccaaaaatgtacaaacagcaccaggaactttcaagacccccgaaggtgaggtcggcgccattgctctggattttaagcctgggacgtctggatcgccaatcgtgaaccgagaaggcaaaatagttggtctttatgggaatggagtggtcacaactagcggcacctacgtgtcagccatcgcacaggctcgggcctcccaggagggccccctgcctgagattgaagacgaggttttccgcaagagaaacttgacaatcatggatctacacccggggagtggaaaaaccaggcggtatctgccagcgattgtgcgagaagccatcaagagaaaactccgcactttaatactggcacccaccagggtcgtggcttctgagatggccgaagctcttaagggtatgcctattcgttaccaaacaacggcagtaaagagcgagcatactggcaaagagatcgtggacctgatgtgccacgccacctttacaatgcggctcttgtccccagttagagtccccaattataacatgatcattatggatgaagcccatttcaccgacccttcatctatcgctgcgagggggtacataagcactcgcgtgggaatgggcgaggcagccgctatttttatgacagccaccccgcccggtagtgtggaagcattcccacagtccaatgccgtcatccaggatgaggaacgagacattcctgagagaagctggaactctgggtatgagtggatcacggattttcccggaaagactgtatggttcgtgccatcaataaaatccggcaatgacattgctaactgtctgcggaagaatggcaaaagggttatccagctcagtcgcaagacattcgataccgaataccaaaagaccaaaaacaacgactgggactacgtggtcactacagatatcagcgagatgggggcgaattttcgtgccgacagagtgattgatcctcggaggtgcctgaagcccgttatccttaaagacggaccagaacgcgtgattctagcaggtccgatgcctgtcaccgtggcttcggccgcacagcgaagaggccggatagggaggaaccacaataaggagggagatcagtatatctacatgggccagcccctgaacaatgacgaggatcatgcccactggacagaagctaaaatgttgttagacaacattaatactccagagggtatcatccccgccctgttcgaacctgagcgcgaaaagtctgcggcaattgatggggagtatagactcaggggcgaggcccggaagacgtttgtagaactgatgcgtcgcggagaccttccagtgtggctgtcctacaaagttgctagcgagggcttccaatattcagatcgaagatggtgctttgacggggaaaggaacaatcaggtcctcgaggaaaacatggatgtggagatatggaccaaggagggagaacggaaaaagttgcgccccagatggctggacgccaggacatacagtgaccctctagctctgcgggagttcaaagaatttgcagccggtcgaagatctgtgtccggcgatctcatccttgagattgggaagctgccgcagcacttaactcagcgcgctcaaaatgccttggacaacctggtcatgctccataatagcgaacagggaggcagggcatatcggcacgcgatggaggagctgccagataccatcgaaacacttatgctgctcgccttgattgctgttctgaccggtggggtgactttattctttctatcaggccgtggactgggcaaaacgagtatcgggctcctttgtgtaatggccagctccgtgctgttgtggatggcatctgtcgagccccattggatagctgccagcatcattctggagttctttctcatggtgctgcttatccctgagcccgacagacagaggaccccacaggataaccaactcgcatacgttgtgattggactgttgttcatgatcctgacagtcgccgctaatgagatgggtttactagaaactaccaagaaggacctgggcatagggcacgtagcggtggagaaccaccatcacgccgcaatgctcgatgttgaccttcatcctgcttccgcctggacactgtacgccgtggcaaccactattatcacacccatgatgcgccacacgattgaaaacaccactgctaatatctcattgacagccatagcgaaccaggctgccatcctgatgggactcgataaaggctggccaatttctaagatggacatcggtgtccctctgcttgcattagggtgctatagtcaggtgaatccgctgaccctcaccgccgctgtcttgatgctggtggcacattacgccattatcggccccggactacaagcgaaagctacacgggaggcccagaagcgaactgcagccggcataatgaaaaacccaacggttgatgggattgtggctatcgacctggatcctgtagtgtatgacgccaagtttgaaaagcagctcggacagatcatgcttctgattttgtgtacctcgcaaatcctgctcatgagaacaacttgggcactgtgcgagagcataaccttagctacaggcccccttaccactctgtgggagggttccccagggaaattctggaatacgacaattgccgtctctatggcgaacatcttcaggggatcatacctcgccggcgcaggtctagcttttagcctgatgaagtccttgggcgggggacgccggggcaccggggcccagggagaaactctgggcgagaaatggaagagacagctcaatcagcttagtaaatctgagttcaacacctataagcgtagcggtattatggaggttgacaggtcagaagcaaaggaggggctgaaacggggagagacaactaagcacgctgtgtcccgcggcaccgccaaattgcgatggtttgtcgaaagaaatctggtgaagcctgagggtaaagtaatcgatctcggctgtgggaggggaggctggagttactattgcgccgggttaaagaaggtgacagaagttaaaggatacacgaagggcggtcccgggcacgaggaaccgataccaatggcgacctacggatggaacctggtgaaacttcatagcggcaaggacgtcttctttatccctcccgagaaatgtgatactctgctatgcgacattggcgagtcttccccaaatcccacaatcgaagaggggcggaccctccgcgtgctgaagatggtcgaaccttggttgagaggaaaccaattctgtattaaaatcctgaatccgtatatgccctcagtggttgagactctcgagcagatgcagaggaagcacggtggcatgcttgtacgaaacccactgagcagaaattcgacacatgaaatgtactgggtgtcttgcgggaccggaaacattgtcagtgctgtgaatatgacgtcccgtatgttactgaacagatttaccatggcacaccgcaagcctacatatgagagggatgttgacttgggcgccggtactcggcacgtggctgtcgaacccgaggtggccaacctcgatatcatagggcagagaattgaaaatatcaaacatgagcacaagagcacctggcattacgacgaggataacccttataaaacatgggcataccacggatcatatgaagtaaagccatccggctctgccagcagtatggtgaatggcgttgtcaaactgctaactaagccctgggacgtgatccctatggtgacccaaattgctatgacagataccactccattcgggcagcagcgcgtctttaaggagaaagttgacacgaggacacccaaggcgaaacgaggaaccgcccaaataatggaagtgactgcaaagtggctttggggtttcctgtcccggaacaaaaagccgagaatctgtaccagggaggaatttacacgcaaggtacgtagcaatgctgccattggcgcagtgttcgtcgacgagaaccagtggaactctgccaaagaggctgtggaagatgagcggttttgggacctcgttcatagagaaagggagctgcacaagcaggggaaatgcgccacgtgcgtgtacaacatgatgggaaagcgcgagaaaaagttgggcgagttcggtaaggcgaaagggtcacgagcaatctggtacatgtggctgggagcccggttcctcgagtttgaagctcttggcttcatgaatgaggatcactggtttagtagagaaaactccctgagcggcgtcgagggggagggattacataagctgggttatattttgagggacatctctaaaatacctggcgggaatatgtacgccgatgacaccgcaggatgggatactcgcatcacagaagacgatctccagaacgaggctagaattaccgacatcatggaaccagagcacgccctgctagctaagtcgattttcaaacttacttatcaaaataaggtggtacgggttcagaggcccgccaaaaacggcacagtgatggatgtcatctcacgtcgagaccagcgcggtagcggacaggtgggaacctacggcctgaatacatttactaacatggaagcacaactcataagacagatggagtccgagggcattttcagtccttctgaactggagaccccaaacttggcggaacgggtgttagattggctggagaagtatggggtcgaaaggctcaagcgcatggccatcagcggagacgactgtgttgtgaaacccatcgatgacagatttgctacggcccttaccgcactgaatgatatgggtaaggtacggaaagacattccgcagtgggagccttccaagggctggaacgattggcagcaagtgcccttctgctcacatcactttcaccagctaataatgaaagacgggagggagatcgtcgtgccatgtcgaaatcaggatgaactggttggacgtgctagagtgagtcagggcgccggttggtctctccgcgagacagcatgcttgggaaagagctacgcccaaatgtggcagctgatgtatttccatcggagggaccttagactggcggctaacgccatttgttccgcagtccctgtggattggatccccacttcacgcaccacatggagcattcacgcccatcaccagtggatgactaccgaagacatgctctctgtatggaatcgggtttggatcgaggaaaacccatggatggaggataagacgcatatatccagttggggagacgtgccctacttaggcaaaagggaggaccaatggtgcggcagcctgatcgggttgacagctcgagccacctgggcaactaatattcaggtcgctatcaaccaggtgagacggctgattggaaatgaaaactacctcgattatatgacatcgatgaagaggtttaaaaatgagtccgaccctgaaggtgccctttggtga

SEQ ID NO: 13704 - RNA, 9879 nt, synthetic construct
  misc_feature 1..9879: note = derived and/or modified CDS sequence (opt3) from DENV-1__FJ410278__SS-prME
  source 1..9879: mol_type = other RNA
agcgtgaccatgctgctcatgcttatgcccaccgccctggctttccacttgactacgagaggaggggaacctcatatgatcgtctccaagcaggaaaggggaaaatctttactgtttaagacctcagccggtgttaatatgtgcacactaattgccatggacctcggagaactgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaggacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaggcccctacaaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccgggtcgttcaaactggagaaggaagtcgccgagacgcagcacggtacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattgtgatcggtgccggggaaaaagctctgaagctctcctggttcaagaaaggctcaagtatcggaaagatgtttgaggccaccgcaagaggcgccaggcggatggctattctgggggatacagcctgggacttcggaagcatcggtggcgtttttacgtccgtggggaaacttgtccatcagattttcggaaccgcatacggcgtgctgttttctggtgtaagctggactatgaagatagggatcggcgtgttgctcacatggctgggattaaattcacgaagtacctccctgagcatgacatgtattgcggttggcctaatcactctctacctgggggtcatggtgcaggctgattctggatgcgtgatcaactggaaaggccgcgaacttaagtgtggttcagggattttcgtcaccaatgaggttcacacgtggacagaacaatataagtttcaggccgacagtccgaaaagattgagcgcagccataggaaaggcttgggaggagggcgtgtgcggtatcaggtccgccacccggctggaaaacattatgtggaaacagatctctaacgagctcaatcatattctgttagaaaacgacatgaagttcactgtggtagtcggcgatgtggcagggatcctggctcagggcaagaagatgatacgccctcaacccatggagtacaaatattcgtggaaaagctggggcaaggccaagatcattggggcggacgttcagaataccacatttatcattgatggaccaaacactcctgaatgtcccgacgatcagagagcctggaatatctgggaggtggaggactacggcttcggtatatttaccacaaacatttggcttaagttgagggattcctatacgcaggtctgcgaccaccgtctcatgtcagctgcaatcaaagatagtaaggccgtgcacgctgacatggggtactggattgaatctgagaaaaatgaaacctggaagctggcccgggcatccttcatcgaggttaagacttgtatatggccaaaatcccatacactatggtcaaacggagtgctggaaagcgagatgatcattcccaagatctatggcggtcctatttctcaacacaattaccgaccaggctacttcacccaggcggccgggccgtggcatctcggaaaactggagcttgattttgacttgtgcgaaggcactacagtagtcgtggatgagcactgcgggaacagaggaccctccctgaggaccacgactgtgaccggcaagatcatacacgaatggtgttgccgcagttgtacattacctccactccggttcagaggtgaggacgggtgctggtatggaatggagattaggcccgtcaaagaaaaggaggaaaatctggttaagagcatggtgtctgctggctccggtgaggtagactcatttagtcttggcctgttgtgtatcagcatcatgattgaagaggtgatgcgctcgcgatggtcccggcgtatgctcatgaccgggactctggccgtcttctttctactgatcatgggacagctcacatggaacgatctgattagactttgcataatggtgggcgcaaatgcttctgacaggatggggatgggaaccacatacttggccctgatggcaactttcaaaatgcgccctatgtttgccgttggcttactcttccggagactgaccagcagggaggtgcttctgctaacgatcggtctctcactggtcgctagtgtggaattgccaaactccctggaggaattaggggatggactcgcgatgggcattatgatcctgaaacttctgacagactttcaatctcatcagttgtgggccaccctcctgagcctaactttcattaaaaccacattttccctgcactatgcatggaagactatggctatggttctttcaatcgtgagcctcttccccctgtgtttgagtaccacgtctcagaaaacaacctggctgccggtcttactcggctccctggggtgcaagcctcttactatgtttctgatagccgagaataagatctggggacgacgcagctggccattgaacgaaggtattatggccgtaggcatcgtgtcgattctcctgtcatctctactgaaaaacgatgttccccttgctgggcctctcatcgcaggaggcatgctgatagcctgttacgtgattagtggttccagcgcggacttgtctttagagaaggctgccgaggtcagctgggaagaggaagcagagcattccggggcctcacacaatatcctggtggaagtacaggatgacggaacaatgaaaatcaaggatgaggagcgggacgataccctcactattctgcttaaagctacactgttggcagtgagtggcgtctatcccctaagcataccagccaccctgttcgtttggtacttctggcaaagaaagaaacagaggtctggcgtgctctgggacacgccttcacccccagaagtggagcgtgcggtcctggatgacgggatctatcgcattatgcagcggggacttttaggtagaagccaggtgggcgttggggtatttcaagaaaacgtgttccatactatgtggcacgtcaccaggggagctgtgctgatgtaccagggcaagcgactcgagccgagttgggccagcgttaagaaagacttgatctcctacggtgggggatggcggctgcagggctcttggaatacaggcgaggaagtgcaggtcattgcagtggagcctgggaagaaccccaaaaatgtacaaaccgccccaggaacatttaagactcccgaaggtgaggtcggcgctatcgccctcgatttcaaacctgggacctcgggaagcccaatagtgaaccgcgaaggcaagatcgttggtctgtatgggaatggagtggtcacgacatcaggcacttacgtgtccgcaattgctcaggccaaggcgagtcaggagggcccccttcctgagatcgaagacgaggtttttagaaaaaggaacctgaccattatggatttgcacccggggtctggaaagacacggcgatatctaccagccatcgtgagagaagcaataaaacgcaagctgaggaccctcattttagctcccactcgtgtcgtggccagcgagatggctgaagcactgaaaggtatgcctatccggtaccaaaccacagccgtaaagtccgagcatacgggcaaggagatcgtggaccttatgtgccacgccactttcaccatgagactgctctcaccagttagggtccccaattataacatgattatcatggatgaagctcattttacagacccttctagcatagcggcacgcgggtacattagtacccgagtgggaatgggcgaggccgctgccatcttcatgactgcaacaccgcccggttccgtggaagcctttccacagagcaatgctgtcattcaggatgaggaaagagacatccctgagcggtcttggaactcagggtatgagtggataaccgatttccccggaaaaacggtatggtttgtgccatccattaagagtggcaatgacatcgcgaactgtttgaggaaaaatggcaagcgcgttatccagctgagccgtaaaactttcgatacagaataccaaaagaccaagaacaacgactgggactacgtggtcaccactgatatttcggagatgggggccaatttcagagcagaccgggtgatcgatcctaggcgctgcctcaaacccgttattctgaaggacggaccagaacgagtgatacttgctggtccgatgcctgtcacagtggcctctgcagcccagagacggggcaggatcgggcgcaaccacaataaagagggagatcagtatatttacatgggccagcccctaaacaatgacgaggatcatgctcactggaccgaagccaagatgctgttggacaacatcaatacaccagagggtatcattcccgcgttatttgaacctgagagagaaaaatccgcagccatagatggggagtataggctgcggggcgaggctcgtaagactttcgtagaactcatgcgccgaggagacctgccagtgtggcttagctacaaggttgcctcagagggctttcaatatagtgatagaaggtggtgcttcgacggggaacggaacaatcaggtcctggaggaaaacatggatgtggagatctggacgaaagagggagaacgcaagaaactcagacccaggtggttggacgctcggacctactctgaccctctggcactacgagagtttaaggagttcgccgctggtagacgctccgtgagcggcgatctgattctcgagatcgggaaacttccgcagcacctgacacagagggcccaaaatgcattagacaacttggtcatgctgcataattcagaacagggaggccgggcgtatcgtcacgccatggaggagctcccagatactattgaaaccctgatgcttctggctctcatcgccgttttgacaggtggggtgaccctgtttttcttaagtggcagaggactaggcaagactagcatagggctgctctgtgtaatggcatcctctgtgcttctgtggatggctagcgtcgagccccattggatcgccgcatccattatcttggaatttttcctgatggtgctcctgattcctgagcccgacaggcagcgcacgccacaggataaccaacttgcctacgttgtgatcggactcctgtttatgatattgaccgtcgctgcgaatgagatgggtctgttagaaacaactaaaaaggacctaggcattgggcacgtagccgtggagaaccaccatcacgcagctatgctggatgttgacctccatcctgcctcagcctggaccctttacgcagtggctacaaccatcattactcccatgatgcggcacacaatcgaaaacacgaccgccaatatatctctgactgcgatcgctaaccaggccgcaattttgatgggactggataagggctggccaatcagtaaaatggacattggtgtccctctcctggcccttgggtgctatagccaggtgaatccgttaacactgaccgctgcagtcctcatgttggtggcccattacgcgatcataggccccggactgcaagctaaggccacccgagaggcacagaaaagaacagccgctggcattatgaagaacccaactgttgatgggatcgtggccatcgacctagatcctgtagtgtatgacgcaaaattcgaaaagcagctgggacagattatgctccttatcctgtgtacgagccaaatattgctgatgaggaccacatgggctctctgcgagtccattactctggccaccggccccttaacaaccctttgggagggttctccagggaagttttggaatactacgatcgcggtctcaatggccaacattttccgcggaagctacctggcaggcgctggtctcgccttctccctaatgaaaagtctgggcgggggacggagaggcacaggggcacagggagaaaccttgggcgagaagtggaaacgtcagctgaatcagctctctaagagcgaatttaacacttataaaaggtcaggtatcatggaggttgaccggtccgaagctaaggaggggcttaagcgcggagagaccacaaaacacgccgtgagtcgaggcactgccaagctgagatggttcgtcgaaaggaatttggtgaaacctgagggtaaggtaatagatctgggctgtgggcggggaggctggagctactattgcgcggggctcaaaaaggtgaccgaagttaagggatacacaaaaggcggtcccgggcacgaggaaccgatcccaatggctacgtacggatggaacttagtgaagctgcattctggcaaagacgtctttttcattcctcccgagaagtgtgatacccttctgtgcgacatcggcgagtcctcaccaaatcccactattgaagaggggcgcacactaagagtgctcaaaatggtcgaaccttggctgaggggaaaccaattttgtatcaagattttgaatccgtatatgcccagcgtggttgagaccctggagcagatgcagcgaaaacacggtggcatgctcgtacggaacccactttcgcgtaattctactcatgaaatgtactgggtgagttgcgggacaggaaacatcgtctccgcagtgaatatgaccagcagaatgctgttaaaccgcttcacgatggcccacaggaagcctacctatgagcgggatgttgacctgggcgctggtacaagacacgtggccgtcgaacccgaggtggcaaacttggatataattgggcagcgcatcgaaaatatcaagcatgagcacaaatcaacttggcattacgacgaggataacccttataagacctgggcctaccacggatcctatgaagtaaaaccatctggcagcgctagttccatggtgaatggcgttgtcaagctcctgacaaaaccctgggacgtgattcctatggtgactcaaatagcgatgaccgatacaaccccatttgggcagcagagggtcttcaaggagaaggttgacactcgaacgcccaaagccaagcggggaacagcacaaatcatggaagtgaccgctaaatggctatggggttttcttagcagaaacaagaaaccgaggatttgtactcgcgaggagttcacccgtaaggtacggtctaatgccgcaatcggcgccgtgtttgtcgacgagaaccagtggaactcagctaaggaggccgtggaagatgagagattctgggacctggttcatagggaacgcgagctccacaaacaggggaagtgcgcgacatgcgtgtacaacatgatgggaaaacgagaaaagaaactgggcgagtttggtaaggcaaaggggagtcgggccatttggtacatgtggttgggagctagattcctggagttcgaagccctcggctttatgaatgaggatcactggttctccagggaaaacagcctttctggcgtcgagggggagggactgcataaattaggttatatcctgcgcgacatatcgaagatccctggcgggaatatgtacgcagatgacacggctggatgggataccagaattactgaagacgatttgcagaacgaggcccggatcacagacattatggaaccagagcacgctctcctggccaaatcaatctttaagctaacctatcaaaataaagtggtaagggttcagcgtcccgcaaagaacggcactgtgatggatgtcataagccgacgcgaccagagaggttccggacaggtgggaacatacggccttaataccttcacaaacatggaagcgcaactgattcggcagatggagagtgagggcatcttttctcctagcgaactcgagactccaaacctggccgaaagggtgttggattggttagagaaatatggggtcgaacgcctgaagagaatggctatctccggagacgactgtgttgtgaagcccattgatgaccggttcgccaccgcactcacggctcttaatgatatgggtaaagtaaggaaggacataccgcagtgggagccttcaaaaggctggaacgattggcagcaagtgcccttttgcagtcatcacttccaccagctgatcatgaaggacgggcgagagattgtcgtgccatgtcgtaatcaggatgagctagttggcagagcccgcgtgtctcagggcgcaggttggagcctgcgggagaccgcctgcctcgggaaatcctacgcgcaaatgtggcagttgatgtattttcataggagagacctgcgccttgctgccaacgcaatctgttcagccgtccctgtggattggattcccacaagccggactacctggtctatccacgctcatcaccagtggatgacaactgaagacatgctgtccgtatggaatagggtttggatagaggaaaacccatggatggaggataagacccatatcagtagctggggagacgtgccctacctcggcaagcgagaggaccaatggtgcggctcgttaattgggctgacggccagagcaacatgggctaccaatatccaggtcgccattaaccaggtgcggaggttgatcggaaatgaaaactacctggattatatgacttccatgaaacgcttcaagaatgagtctgaccctgaaggtgcgctctggtga

SEQ ID NO: 13705 - RNA, 9879 nt, synthetic construct
  misc_feature 1..9879: note = derived and/or modified CDS sequence (opt3) from DENV-1__FJ410279__SS-prME
  source 1..9879: mol_type = other RNA
agcgtgaccatgctgctcatgcttatgcccacagcactggctttccacttgactacgagaggaggggaacctcatatgatcgtctccaagcaggaaagggggaaatctttactgtttaagacctcagccggtgttaatatgtgcacactaattgccatggacctcggcgagttctgtgaagatactatgacctacaaatgcccacggataacagaagcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaagacgcaaactttgtttgccgccgaacattcgtggatagaggctggggtaatgggtgtggactgtttggcaaaggctccttgataacttgcgctaagttcaagtgcgtaaccaaactcgaggggaagattgtgcagtacgaaaacctgaaatattcagtcatcgtgacagttcacaccggagaccagcatcaagtgggtaatgagagtactgaacacggcacgacagccaccattactccccaggcgcctagcaccgagatccagttaacagactacggggccctgaccctcgattgttctccaaggactggacttgactttaacgaaatggtcctgttgacaatgaaggagaaatcctggctagtgcataagcagtggttcctggatctcccgctgccctggacgtcaggcgcaagcaccagtcaagagacttggaatcggcaggaccttctggtaacatttaaaaccgctcacgccaagaagcaggaagttgtggtcttgggttctcaagagggggctatgcacacagccctcactggcgcaaccgaaatccagacgtccggaaccacaactattttcgccggccatctgaaatgccgtttaaagatggataaactgaccctaaaggggatgagctatgtgatgtgtacaggatcgttcaaactcgagaaggaagtcgctgagactcagcacggtaccgtgctggttcagataaagtacgagggcacggacgcgccttgcaaaatcccattttctacacaagatgaaaagggggtgacccagaacggacgccttattactgcaaatcccatcgtaacagacaaagagaagcctgtcaacatagaagccgagccacccttcggcgagtcctatattgtgatcggtgctggggaaaaagccttgaagctgtcatggtttaagaaaggcagtagcatcggaaagatgttcgaggcaaccgccagaggcgctaggcggatggccattctcggggatactgcatgggactttggatccatcggtggcgttttcacctctgtggggaaactggtccatcagatttttggaacagcgtacggcgtgcttttcagcggtgtatcatggacgatgaagatagggatcggcgtgctgttgacctggctcggactgaatagtcgatccactagcttatctatgacatgtattgctgttggcctggtcaccctatacctcggggtgatggtgcaggccgattcaggatgcgtcatcaactggaaaggccgcgaactgaagtgtggtagtgggatctttgttacaaatgaggtgcacacttggaccgaacaatataagttccaggcagacagcccgaaaagactttccgccgctattggaaaggcctgggaggagggcgtgtgcggtataaggtctgcaacgcggttggaaaacatcatgtggaaacagatttcgaacgagctgaatcatatcctcctggaaaacgacatgaagtttacagtagtcgtgggcgatgttgctgggattttagcccagggcaagaagatgatccgccctcaacccatggagtacaaatatagctggaagtcctggggcaaggcgaaaataatcggggccgacgtgcagaataccactttcattatcgatggaccaaacacccctgaatgtcccgacgatcagagagcttggaatatttgggaggtcgaggactacggctttggtatcttcacaactaacatatggctgaaacttagggattcatatacccaggtgtgcgaccaccgtttgatgagtgcagccattaaagattctaaggctgttcacgccgacatggggtactggatcgaaagcgagaaaaatgaaacatggaagctcgcacgggcgtccttcattgaggtgaagacgtgtatctggccaaaatcacataccctgtggagcaacggagtactagaatctgagatgataatccccaagatttatggcggtcctatctcccaacacaattaccgaccaggctactttactcagacagccgggccgtggcatctgggaaaactcgagctggatttcgacctttgcgaaggcaccactgtcgtggtggatgagcactgcgggaacagaggacccagtttgaggacaaccacggtcactggcaagattatccacgaatggtgttgccgcagctgtaccctgcctccattacggtttaaaggtgaggacgggtgctggtatggaatggagataagacccgttaaggaaaaggaggaaaatctcgtgaaatctatggtatccgctggctcaggtgaggtggacagtttcagcctgggccttctgtgtatttcgatcatgatcgaagaggtcatgaggtcccgctggtctcgaaagatgttgatgacagggaccctcgccgtgtttttcctgctaattatgggacagctgacttggaacgatctcatccggctgtgcattatggttggcgcaaatgctagcgaccgtatggggatgggaacaacctaccttgccttgatggcaacatttaaaatgagacctatgttcgccgtgggcctgttatttaggcgcctcacttcacgggaggtcctgcttctgaccataggtctaagtctcgtggcttccgttgaactgccaaactctttggaggaactgggggatggattagcgatgggcatcatgattctcaagctgcttacggacttccaaagccatcagctgtgggccacattgctctccctgacctttatcaaaactaccttctcactacactatgcatggaagacaatggctatggtgctgagcattgtcagtctttttcccctctgtctgtctactacctcccagaagacgacatggttgccggtactgttaggcagcctcgggtgcaaacctctgaccatgttccttatcgccgagaataagatatggggaagaaaatcgtggccactgaacgaaggtatcatggccgtgggcattgtttcaatcttgctctctagtctgctaaagaacgatgtgcccctggctgggcctcttattgcaggaggcatgctcatcgcctgttacgtcatatccggtagctctgcggacctgagcttggagaaagctgccgaggtgtcctgggaagaggaagcagagcattcaggggccagtcacaatattttagtagaagtgcaggatgacggaactatgaagatcaaagatgaggagagggacgatacactgaccatcctcctgaaggctactcttctggcagtcagcggcgtttatcccttgtctattccagccacactattcctgtggtacttttggcaaaagaaaaagcagcgatccggcgtgctctgggacaccccttcacccccagaagtggagcgcgcggtcctggatgacgggatatatcggatcatgcagagaggacttttaggtaggagtcaggtgggcgttggggtattccaagaaaacgtgtttcatacgatgtggcacgtcactcgtggagctgtgctgatgtaccagggcaaacgcctcgagccgagctgggcctccgttaagaaagacttgatttcttacggtgggggatggcggctgcagggctcgtggaataccggcgaggaagtgcaggtcatcgcagtggagcctgggaagaaccccaagaatgtacaaacagccccaggaaccttcaaaacaagcgaaggtgaggtcggcgctattgccctcgattttaagcccgggacttcaggatcccctatcgtgaacagagaaggcaaaatagttggtctgtatgggaatggagtggtcaccacgagtggcacatacgtgtctgcaatcgctcaggccaaggcgagccaggagggcccacttcccgagattgaagacgaggttttcaggaaacgaaacctgactatcatggatttgcaccctgggtccggaaagacccggcgctatctaccggccattgtgagagaagcaatcaagaggaaactgcggacactcatattagctccaacccgagtcgtggcctcagagatggctgaagcactgaagggtatgcccattagataccaaactaccgccgtaaaatctgagcatacaggcaaggagatcgtggaccttatgtgccacgccacgtttactatgcgcctgctcagccctgttagggtcccaaattataacatgatcattatggatgaagctcatttcaccgaccccagttccatcgcggcacgtgggtacataagcacacgggtgggaatgggcgaggccgctgccatttttatgaccgcaactcctccgggttctgtggaagccttcccccagtcaaatgctgtcatccaggatgaggaaagagacattccagagaggtcctggaacagtgggtatgagtggatcacagattttcctggaaaaaccgtatggttcgtgcccagcataaagtcgggcaatgacattgcgaactgtttgcgcaagaatggcaaacgagttatccagctgtctagaaagacgttcgatactgaataccagaagaccaagaacaacgactgggactacgtggtcaccaccgatatctccgagatgggggccaattttcgggcagacagggtgattgatccacgccgttgcctcaaacctgttatcctgaaggacggacccgaaagagtgattcttgctggtccaatgccggtcactgtggccagcgcagcccagcggaggggccgcatagggcgaaaccacaataaggagggagatcagtatatctacatgggccagcctctaaacaatgacgaggatcatgctcactggacagaagccaaaatgctgttggacaacattaatacccccgagggtatcatcccagcgttattcgaacccgagagagaaaagtcagcagccattgatggggagtatcggctgaggggcgaggctcgcaaaacatttgtagaactcatgagaaggggagacctgcctgtgtggcttagttacaaggttgcctctgagggcttccaatattccgatcggcgttggtgctttgacggggaacgcaacaatcaggtcctggaggaaaacatggatgtggagatatggactaaagagggagaacgaaagaaactcagaccaaggtggttggacgctcgggtgtacagcgaccccctggcactacgcgagttcaaggaatttgccgctggtagaaggtcagtcagtggcgatctgatcctcgagattgggaaacttcctcagcacctgacgcagcgggcccaaaatgcattagacaacttggttatgctgcataatagcgaacagggaggccgagcgtatagacacgccatggaggagctcccggataccatcgaaacactgatgcttctggctctcattgccgtgttgactggtggggtaaccctgttctttttatccggccgcggactaggcaaaacatctatcgggctgctctgtgtgatggcaagctccgtccttctgtggatggcttcagtggagccacattggatagccgcatctatcattttggagttctttctgatggttctcctgatccccgagcctgacaggcagcggacaccccaggataaccaacttgcctacgtggtcattggactcctgttcatgatcttgactgtagctgcgaatgagatgggtctgttagaaacgaccaagaaagacctaggcatagggcacgtggccgttgagaaccaccatcacgcagctatgctggatgtggacctccatccagccagtgcctggacactttacgcagtcgctactaccattatcacacctatgatgcgtcacaccattgaaaacactacagccaatatctcgctgacggcgatagctaaccaggccgcaatcttgatgggactggataagggctggcccattagcaaaatggacatcggtgtgccactcctggcccttgggtgctattcccaggtcaatcctttaaccctgactgctgcagtgctcatgttggttgcccattacgcgattatcggcccgggactgcaagctaaggccacaagagaggcacagaagaggaccgccgctggcataatgaaaaaccccaccgtggatgggattgtagccatcgacctagatccagtggtctatgacgcaaagtttgaaaaacagctgggacagatcatgctccttattctgtgtacatctcaaatcttgctgatgcgcactacgtgggctctctgcgagtcaataaccctggccacaggccctttaactaccctttgggagggtagccccgggaagttctggaatacaaccattgcggtttccatggccaacatcttccggggaagttacctggcaggcgctggtctcgccttttctctaatgaaaagcctgggcgggggacgaagaggcactggggcacagggagaaacgttgggcgagaagtggaagaggcagctgaatcagctctcaaaatccgagttcaacacatataagcgcagtggtattatggaggtggaccggagcgaagctaaagaggggcttaagagaggagagaccactaaacacgccgtctctcgtggcaccgccaagctgaggtggtttgtggaacggaatttggtaaagccagagggtaaagtgatcgatctgggctgtgggcgcggaggctggtcctactattgcgcggggctcaagaaagttacagaagtgaagggatacactaaaggcggtcctgggcacgaggaacccataccgatggctacctacggatggaacttagtcaagctgcattcaggcaaagacgtgttctttatcccacctgagaagtgtgatacacttctgtgcgacattggcgagagctcgcccaatccaacgatcgaagaggggcgaaccctaagagtcctcaagatggtggaaccctggctgaggggaaaccaattctgtattaaaatcttgaatccttatatgccgtctgttgtagagactctggagcagatgcagcggaagcacggtggcatgctcgtgcgcaacccccttagtagaaattccacacatgaaatgtactgggtcagctgcgggaccggaaacattgtgtcagcagttaatatgacttccaggatgctgttaaaccgatttacaatggcccaccggaaaccaacctatgagcgtgatgtggacctgggcgctggtacgagacacgtcgccgtggaacctgaggtagcaaacttggatatcatagggcagcgcattgaaaatatcaagcatgagcacaaatctacctggcattacgacgaggataacccctataagacatgggcctaccacggaagctatgaagtgaagcctagtggctccgctagctctatggttaatggcgtcgtgaaactcctgactaagccatgggacgtgatccccatggtcacccaaattgcgatgacagatactacccctttcgggcagcagagggtttttaaagagaaggtggacacacggaccccaaaagccaagagaggaactgcacaaataatggaagtaacggctaagtggctatggggtttcctttcacgcaacaaaaagcccaggatctgtacacgagaggaatttacccggaaagtgagaagtaatgccgcaattggcgccgtcttcgtggacgagaaccagtggaactccgctaaggaggccgttgaagatgagaggttttgggacctggtgcatcgcgaacgtgagctccacaaacaggggaagtgcgcgacttgcgtctacaacatgatgggaaagcgggagaaaaagctgggcgagttcggtaaagcaaaggggagcagagccatctggtacatgtggttgggagctaggttcctggagtttgaagccctcggcttcatgaatgaggatcactggttttctcgcgaaaactcgctttcaggcgtggagggggagggactgcataaattaggttatattctgcgagacatcagcaagataccgggcgggaatatgtacgcagatgacaccgctggatgggatacacggatcacggaagacgatttgcagaacgaggccaaaattaccgacatcatggaacctgagcacgctctcctggccaagtccattttcaagctaacttatcaaaataaagtagttagagtgcagaggccagcaaagaacggcacagtcatggatgtgatcagtcgcagagaccagcggggttctggacaggtgggaacctacggccttaatacttttacaaacatggaagcgcaactgataaggcagatggagagcgagggcattttctccccctcagaactcgagacccctaacctggccgggcgtgtcttggattggttagaaaaacatggagttgagcgactgaagcgcatggctatcagtggtgacgactgtgtggtaaaaccaatcgatgacagatttgccacagcactcactgctcttaatgatatgggcaaggtgcggaaggacattccccagtgggaaccgtctaaagggtggaacgattggcagcaagtccctttctgcagccaccactttcatcagctgataatgaaggacggaagggagatcgtggttccctgtcgcaatcaggatgagctagtgggcagagcccgggtctcccagggtgcagggtggtcactgagggaaaccgcctgcctcggaaaaagctatgcgcaaatgtggcagttgatgtacttccaccgacgtgacctgagacttgctgccaacgcaatttgttctgccgtgccagtagattgggttcctacgtcccgcaccacatggagtatccatgctcaccatcagtggatgactaccgaggacatgctgagcgtgtggaatcgggtctggattgaagagaacccctggatggaagataagacacacatctcgtcctggggcgacgtgccatatctcggcaaaagggaggaccaatggtgcgggtctttaataggactgactgccagagcaacctgggctacgaatatccaggttgccattaaccaggtgcgccggttgatcggtaatgagaactacctggattacatgacatcaatgaagaggtttaagaatgaaagcgaccccgagggcgcgctctggtga

SEQ ID NO: 13706 - RNA, 9879 nt, synthetic construct
  misc_feature 1..9879: note = derived and/or modified CDS sequence (opt3) from DENV-1__FJ410283__SS-prME
  source 1..9879: mol_type = other RNA
tccgtgaccatgctgctcatgcttatgcccacggccctggctttccacttgactacgagaggaggggaacctcatatgatcgtctccaagcaggaaagaggaaaatctttactgtttaagacctcagccggtgttaatatgtgcacgctgattgccatggacctcggcgagctgtgtgaagatactatgacctacaaatgcccacggattacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccggtagcttcaaactggagaaggaacttgccgagacgcagcacggaacagtcttggtgcagataaagtacgagggcaccgacgctccttgcaaaatcccattctcgactcaagatgaaaagggggttacacagaacggacgcctgattaccgcgaatcccatcgtgactgacaaagagaagcctgtaaacatagaagcagagccaccctttggcgagtcttatattgtcatcggtgccggggaaaaagctctcaagctgtcctggttcaagaaaggctcaagtatcggaaagatgtttgaggccaccgcaagaggcgccaggcggatggctattcttggggatacagcctgggacttcggaagcatcggtggcgtgtttacgtccgcagggaaactggttcatcagattttcggaaccgcgtacggcgtgttgttttctggtgtcagctggactatgaagatagggatcggcgtgctcctgacatggttaggactaaattcacgaagtacctccctaagcatgacatgtattgctgtaggcctcgtgactctgtaccttggggttatggtccaggccgattctggatgcgtgatcaactggaaaggccgcgaattgaagtgtggttcagggatcttcgtgaccaatgaggtccacacgtggacagaacaatataagtttcaggcagacagtccgaaaagactgagcgccgctattggaaaggcctgggaggagggcgtttgcggtataaggtccgcaacccggctcgaaaacatcatgtggaaacagatttctaacgagctgaatcatatcttactggaaaacgacatgaagttcactgtggtggtaggcgatgtcgctgggattcttgcccagggcaagaagatgatccgccctcaacccatggagtacaaatattcgtggaaaagctggggcaaggcgaagataatcggggccgacgtgcagaataccacatttattatcgatggaccaaacactcctgaatgtcccgacgatcagagagcttggaatatttgggaggttgaggactacggcttcggtatctttaccacaaacatatggttgaagctcagggattcctatacacaggtgtgcgaccaccgtctgatgtcagcagccattaaagatagtaaggctgtccacgccgacatggggtactggatcgaatctgagaaaaatgaaacctggaagctagcacgggcgagcttcattgaggtgaagacttgtatctggccaaaatcccatacactgtggtcaaacggagttctcgaaagcgagatgataatccccaagatttatggcggtcctatctctcaacacaattaccgaccaggctacttcacccagactgccgggccgtggcatctgggaaaacttgagttggattttgacctgtgcgaaggcacaaccgtggtagtcgatgagcactgcgggaacagaggaccctccttaaggacgactaccgtgacaggcaagattatccacgaatggtgttgccgcagttgtaccctccctccactgcggttcagaggtgaggacgggtgctggtatggaatggagataaggcccgtgaaagaaaaggaggaaaatcttgtcaagagcatggtttctgctggctccggtgaggtggactcatttagtctgggcttgctctgtattagcatcatgatcgaagaggtaatgcgctcgcgatggtcccggaaaatgctgatgactgggacactagccgtgttctttctgctcattatgggacagctgacctggaacgatcttatccgtttgtgcattatggtcggcgcaaatgcttctgacagaatggggatgggaacaacttacctggccttaatggcaaccttcaagatgaggcctatgtttgccgtgggcctcctgttccgccggcttacgagcagagaggttctgctactcacaataggtctgtcattggtggctagtgtcgaactgccaaactccttagaggaactcggggatggactggcgatgggcatcatgattcttaaactgttgaccgactttcaatctcatcagctctgggccactctgctaagcctgaccttcatcaagacaactttttcccttcactatgcatggaaaaccatggctatggtgctctcaattgttagcctgttccccttgtgtctgagtacgacatctcagaagaccacttggttaccggtgctcctgggctcccttgggtgcaagcctctgacaatgtttttgatcgccgagaataaaatatggggaaggcgaagctggccactcaacgaaggtatcatggccgtcggcattgtatcgatcctgctatcatctctgcttaagaacgatgtgcccctcgctgggcctctgattgcaggaggcatgttgatcgcctgttacgttataagtggttccagcgcggacttatctctggagaaagctgccgaggtgagctgggaagaggaagcagagcattccggggcctcacacaatattctcgtcgaagtgcaggatgacggaaccatgaagatcaaagatgaggagcgcgacgatactctgacaatccttctgaaggctaccttgctagcagtaagtggcgtgtatcccctgagcattccagccacactcttcgtctggtacttctggcagaagaagaagcagcggtctggcgttctgtgggacactccttcacccccagaagtggagagagcggtgcttgatgacgggatatataggatcatgcagcgtggattactgggtcgcagccaggtcggcgtgggggtttttcaagaaaacgtattccataccatgtggcacgtgacacggggagctgtcctcatgtaccagggcaaaagattggagccgagttgggccagcgtgaagaaagacctgatttcctacggtgggggatggaggctccagggctcttggaataccggcgaggaagttcaggtgatcgcagtcgagcctgggaagaaccccaaaaatgtgcaaacagccccaggaacttttaagacccccgaaggtgaggtaggcgctattgccctggatttcaagcctgggacgtcgggaagcccaatcgtcaaccgagaaggcaaaatagtgggtctttatgggaatggagttgtgacaacttcaggcacctacgtctccgcaatcgctcaggccaaggcgagtcaggagggccccctgcctgagattgaagacgaggtgtttcggaaacgcaacttgacaatcatggatctacacccggggtctggaaagaccagaaggtatctgccagccattgttcgggaagcaatcaaacgaaagctcagaactttaatactggctcccacccgcgtggtcgccagcgagatggctgaagcacttaagggtatgcctattaggtaccaaacaacggccgtgaaatccgagcatactggcaaggagatcgtagacctgatgtgccacgccaccttcacaatgcgtctcttgtcaccagtgcgggttcccaattataacatgatcattatggatgaagctcattttaccgacccttctagcatcgcggcaagagggtacataagtactagggtcggaatgggcgaggccgctgccattttcatgacagcaaccccgcccggttccgtggaagcctttccacagagcaatgctgtgatccaggatgaggaacgcgacattcctgagcgatcttggaactcagggtatgagtggatcacggatttccccggaaaaactgtctggtttgtaccatccataaagagtggcaatgacattgcgaactgtctgaggaaaaatggcaagcgggtgatccagctcagcaggaagacattcgataccgaataccagaaaaccaagaacaacgactgggactacgttgtgactacagatatctcggagatgggggccaatttccgcgcagaccgtgtcattgatcctagacggtgcctgaaacccgtgatccttaaggacggaccagaaagggttattctagctggtccgatgcctgtgaccgtcgcctctgcagcccagcgccgaggcagaatagggcggaaccacaataaagagggagatcagtatatctacatgggccagcccctgaacaatgacgaggatcatgctcactggacagaagccaagatgttgttagacaacattaatactccagagggtatcatccccgcgctgtttgaacctgagagggaaaagtccgcagccattgatggggagtatcgcctcagaggcgaggctaggaaaacgttcgtggaactgatgcggcgtggagaccttccagtatggctgagctacaaggtggcctcagagggctttcaatatagtgatcgccgatggtgcttcgacggggaaagaaacaatcaggttctcgaggaaaacatggatgtcgagatatggaccaaagagggagaaaggaagaaattgcggccccgctggctggacgctagaacatactctgaccctctagcactgagggagtttaaggagttcgccgctggtcggcgatccgtgagcggcgatctcatccttgagattgggaaactgccgcagcacttaactcagagagcccaaaatgcattggacaacctggtgatgctccataattcagaacagggaggccgcgcgtataggcacgccatggaggagctgccagataccatcgaaacacttatgctgctcgctttgattgccgtcctgaccggtggggttactttatttttcctaagtggccggggactgggcaagacgagcatcgggctcctttgtgtgatggcatcctctgtactgttgtggatggctagcgtggagccccattggatagccgcatccatcattctggaatttttcctcatggtcctgcttatccctgagcccgaccgtcagagaaccccacaggataaccaactcgcctacgtggttattggactgttgtttatgatcctgacagtggctgcgaatgagatgggtttactagaaactaccaagaaagacctgggcatagggcacgtcgccgtagagaaccaccatcacgcagctatgctcgatgtggaccttcatcctgcctcagcctggacactgtacgcagttgctaccactattatcacacccatgatgaggcacacgattgaaaacaccactgccaatatctctttgacagcgatagctaaccaggccgcaatcctgatgggactcgataagggctggccaattagtaaaatggacatcggtgtgcctctgcttgccttagggtgctattcgcaggtcaatccgctgaccctcaccgctgcagtgttgatgctggtcgcccattacgcgattatcggccccggactacaagctaaggccacacgcgaggcacagaaacggactgccgctggcataatgaagaacccaacggtggatgggattgttgccatcgacctggatcctgtggtatatgacgcaaagttcgaaaaacagctcggacagatcatgcttctgattttgtgtaccagccaaatcctgctcatgcgaacaacttgggctctgtgcgagtccataaccttagccacaggcccccttaccactctgtgggagggttctccagggaagttttggaatacgacaattgcggtgtcaatggccaacatcttcagaggaagctacctcgcaggcgctggtctagccttctccctgatgaaaagtttgggcgggggaaggcgcggcaccggggcacagggagaaactctgggcgagaagtggaaacggcagctcaatcagctttctaagagcgaatttaacacctataagagatcaggtattatggaggtcgaccgttccgaagctaaagaggggctgaagaggggagagacaactaaacacgccgttagtcggggcaccgccaagttgcgctggttcgtggaacgaaatctggtcaaacctgagggtaaggtgatcgatctcggctgtgggagaggaggctggagctactattgcgcggggttaaagaaagtaacagaagtgaagggatacacgaaaggcggtcccgggcacgaggaaccgataccaatggctacctacggatggaacctggttaaacttcattctggcaaagacgtgtttttcatccctcccgagaagtgtgatactctgctatgcgacattggcgagtcctcaccaaatcccacaatcgaagaggggaggaccctccgggtcctgaaaatggtggaaccttggttgcgcggaaaccaattttgtattaagatcctgaatccgtatatgcccagcgtcgtggagactctcgagcagatgcagagaaagcacggtggcatgcttgttaggaacccactgtcgcgaaattctacacatgaaatgtactgggtaagttgcgggaccggaaacattgtgtccgcagtcaatatgacgagccggatgttactgaaccgtttcaccatggcccacagaaaacctacatatgagcgcgatgtggacttgggcgctggtactaggcacgttgccgtggaacccgaggtcgcaaacctcgatatcatagggcagcggattgaaaatatcaagcatgagcacaaatcaacctggcattacgacgaggataacccttataagacatgggcctaccacggatcctatgaagtgaaaccatctggcagcgctagttccatggtaaatggcgtggttaagctgctaactaagccctgggacgtcatccctatggtgacccaaattgcgatgacagataccactccatttgggcagcagagagtgttcaaagagaaggtcgacacgcgcacacccaaagccaagaggggaaccgcacaaataatggaagttactgctaaatggctttggggttttctgagccgaaacaagaagccgcggatctgtaccagagaggagttcacaaggaaagtgcgctctaatgccgcaattggcgccgtatttgtggacgagaaccagtggaactcagctaaggaggccgtcgaagatgagcgtttctgggacctcgtgcatcgggaaagagagctgcacaaacaggggaagtgcgcgacgtgcgtttacaacatgatgggaaaaagggaaaagaagttgggcgagtttggtaaagcaaaggggagtcgcgccatctggtacatgtggctgggagctcgattcctcgagttcgaagcccttggctttatgaatgaggatcactggttctcccgggaaaacagcctgtctggcgtggagggggagggattacataaactgggttatattttgagagacatctcgaagatacctggcgggaatatgtacgcagatgacaccgctggatgggatactaggatcacagaagacgatctccagaacgaggcccgcattaccgacatcatggaaccagagcacgctctgctagccaaatcaatttttaaacttacttatcaaaataaagtcgtgagagtacagcggcccgcaaagaacggcacagttatggatgtgatcagcaggcgtgaccagcgaggttccgggcaggtcggaacctacggcctgaatacattcactaacatggaagcgcaactcatacgccagatggagagtgagggcatattttctcctagcgaactggagaccccaaacttggccgaaagagtgttagattggctggggaagtatggagtggagcggctcaaaaggatggctatctccggtgacgactgtgtcgttaagcccatcgatgaccgcttcgccacggcacttaccgctctgaatgatatgggcaaagtgagaaaggacattccgcagtgggaaccttcaaaagggtggaacgattggcagcaagtacccttttgcagtcatcacttccaccagctaataatgaaggacggacgggagatcgtggtcccatgtaggaatcaggatgagctggtgggccgagcccgtgtttctcagggtgcagggtggagcctcagagaaacagcctgcttgggaaagtcctacgcgcaaatgtggcagctgatgtattttcatcgccgggaccttaggctggctgccaacgcaatttgttcagccgtgcctgtcgattggatccccactagcagaaccacatggtctattcacgctcatcaccagtggatgactaccgaggacatgctctccgtgtggaatcgcgtatggatcgaagagaacccatggatggaagataaaacgcatataagtagctggggcgacgttccctacttaggcaagcgggaggaccaatggtgcgggtcgctgatcggattgacagccagggcaacctgggctactaatattcaggtggccatcaaccaggtccgaagactgattggtaatgagaactacctcgattatatgacatccatgaaacggttcaagaatgaatctgaccctgagggcgcgctttggtga

SEQ ID NO: 13707 - RNA, 9879 nt, synthetic construct
  misc_feature 1..9879: note = derived and/or modified CDS sequence (opt3) from DENV-1__FJ410284__SS-prME
  source 1..9879: mol_type = other RNA
agcgtgaccatgctgctcatgcttatgcccacagcactggctttccacttgactacgagaggaggggaacctcatatgatcgtaaccaagcaggaaaggggaaaatccttactgtttaagacatctgccggtgttaatatgtgcactctaattgccatggacctcggagaactgtgtgaagataccatgacatacaaatgcccacggataaccgaagcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaggacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaagcgcctaccagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactgggagcttcaaactggagaaggaagtggctgagacccagcacggtacggtccttgtgcagataaagtacgagggcacagacgcgccttgcaaaatcccattctcgacccaagatgaaaagggggttattcagaacggacgcttgatcactgcaaatcccatagtgacagacaaagagaagcctgtaaacattgaagccgagccaccctttggcgagtcttatatcgtcatcggtgtgggggaaaaagctctgaagctctcctggttcaagaaaggctcaagtattggaaagatgtttgaggccaccgcaagaggcgccaggcggatggctatcctgggggatactgcctgggacttcggaagcattggtggcgtttttacctccgtggggaaacttgtccatcagatattcggaacagcatacggcgtgctgttttctggtgtaagctggacgatgaagatcgggattggcgtgttgctcacctggctgggattaaattcacgaagtacttccctgagcatgacatgtatcgcggttggcctagtcaccctctacctgggggtgatggtgcaggctgattctggatgcgtcatcaactggaaaggccgcgaacttaagtgtggttcagggattttcgttacaaatgaggtgcacacttggaccgaacaatataagtttcaggccgacagtccgaaaagattgagcgcagccataggaaaggcttgggaggagggcgtgtgcggtatcaggtccgccacgcggctggaaaacattatgtggaaacagatctctaacgagctcaatcatattctgttagaaaacgacatgaagttcacagtagtcgtgggcgatgttgtggggatcctggcacagggcaaaaagatgatacgccctcaacccatggagcacaaatactcgtggaaaagctggggcaaggctaagatcattggggccgacgtccagaataccacttttatcattgatggaccaaacacccctgaatgtcccgacgatcagagagcgtggaatatctgggaggtggaggactatggcttcggtatatttacaactaacatttggcttaagttgagggattcctacacccaggcctgcgaccaccgtctcatgtcagctgcaatcaaagatagtaaggccgttcatgctgacatggggtattggattgaatctgagaaaaatgaaacatggaagctggcccgggcatccttcatcgaggtgaagacgtgtatatggccaaaatcccacaccctatggtcaaacggagtactggaaagcgagatggtcatccccaagatttacggcggtcctatctctcaacataattatcgaccaggctacttcactcagacagcggggccgtggcacctcggaaaactggagcttgattttgacttgtgcgaaggcaccactgtggtggtcgatgagcactgcgggaacagaggaccctccctgaggacaaccacggttactggcaagattatccatgaatggtgttgccgcagttgtaccttacctccactccggttcaaaggtgaggacgggtgctggtacggaatggagataagacccgtgaaggaaaaggaggaaaatctggtaaaaagcatggtgtctgccggctccggtgaggtcgactcatttagtcttggcctgttgtgtattagcatcatgatcgaagaggtgatgaggtcgcgctggtcccgaaagatgctcatgacagggaccctggctgttttcctactgctcattatgggacagctgacttggaacgatcttatccggttgtgcattatggtgggcgccaatgcatctgaccgtatggggatgggaacaacctatctggctttaatggccacatttaaaatgagacctatgttcgcagtcggcctcctgtttaggcgccttactagccgggaggtgctgctactcaccataggtctgtcattggttgccagtgtggaactgccaaactccttagaggaactcggggatggactggctatgggcatcatgattcttaagctgttgacggacttccaatctcaccagctctgggcgacactgctaagcctgacctttatcaaaactaccctttccctccattacgcctggaagacaatggcaatggtcctgtcaattgtcagcttgttccccctgtgtttaagtactacctctcagaagacgacatggctcccggtgctgcttggctccctggggtgcaaacctttgaccatgtttctcatcgctgagaataagatatggggaagaaaaagctggccactgaacgaaggtatcatggccgttggcgtggtctcgattctactgtcatctcttctcaagaacgatgtgcccctggccgggcctttgatcgctggaggcatgttaattgcatgttatgtaatcagtggttccagcgccgacctgtctctcgagaaagcggctgaggtgagctgggaagaggaagccgagcactccggggcatcacataatatactggtcgaagttcaggatgacggaactatgaagattaaagatgaggagaaggacgatacacttaccatcctgttgaaggccactctactggctgtgagtggcgtgtaccccctcagcatcccagcaacactgttcgtctggtatttttggcagaaaaagaaacagaggtctggcgtgctttgggacaccccttcacccccagaagttgagcgagccgtattagatgacgggatttaccgcataatgcagcggggactgctcggtagaagccaggtgggcgtcggggtgttccaagaaaacgttttccacacgatgtggcacgtgactaggggagcggtcttgatgtatcagggcaagcgtctggagccgagttgggctagcgtgaaaaaggacctcatctcctacggtgggggatggcgcctgcagggctcttggaataccggcgaggaagtacaggtcattgccgtggagcctgggaagaaccccaaaaatgttcaaacagcaccaggaacctttaagacacccgaaggtgaggtgggcgccatcgctcttgatttcaaacctgggacttcgggaagcccaattgtcaaccgggaaggcaagatcgtgggtctgtacgggaatggagttgtgaccacgtcaggcacatatgtctccgccatagcacaggctaaagccagtcaggagggccccttgcctgagatcgaagacgaggtgtttagaaagaggaacctaactattatggatctgcatccggggtctggaaagacccgacggtacctcccagcgatcgtacgcgaagccacaaaaagaaagttaaggaccctgattcttgcacccactcgggtggttgctagcgagatggccgaagctctgaaaggtatgcctatccgatatcaaaccacagcagtcaagtccgagcacacgggcaaagagatagtggacctcatgtgccatgccactttcaccatgagattgctgtcaccagtgcgcgtccccaattacaacatgattatcatggatgaagcccactttacagacccttctagcatcgctgcgagggggtatattagtacccgtgtaggaatgggcgaggcagccgctatcttcatgactgccacaccgcccggttccgtggaagcatttccacagagcaatgccgttatacaggatgaggaacgggacattcctgagagatcttggaactcagggtacgagtggatcaccgatttccccggaaagacggtgtggtttgtcccatccattaagagtggcaatgacatcgctaactgtctcaggaaaaatggcaagcgcgtgatacagctgagccgaaaaactttcgatacagaatatcaaaagaccaaaaacaacgactgggactacgttgtgaccactgatatttcggagatgggggcgaattttagagccgaccgggtcatcgatcctaggcgctgccttaagcccgtgatcctaaaggacggaccagaacgtgtaattctggcaggtccgatgcctgtgacagttgcttctgccgcacagagacggggcaggatcgggcgcaaccataataaagagggagatcagtacatttatatgggccagcccttgaacaatgacgaggatcacgcccactggaccgaagctaagatgttactggacaacataaatacaccagagggtatcattcccgccctcttcgaacctgagcgagaaaaatccgcggcaatcgatggggagtacagactgcggggcgaggccaggaagactttcgtcgaacttatgcgcagaggagacctgccagtgtggctcagctataaagtggcttcagagggctttcaatacagtgataggcggtggtgcttcgacggggaacgtaacaatcaggtcttggaggaaaacatggatgttgagatctggacgaaggagggagaacgcaaaaagctgcgacccagatggctagacgccaggacctattctgaccctctggctctccgggagtttaaggagttcgcagccggtcgcagatccgtgagcggcgatcttattctggagatagggaaattaccgcagcatttgacacagagggctcaaaatgccctggacaacctcgtaatgctgcacaattcagaacagggaggccgggcataccgacatgcgatggaggagcttccagatactatcgaaaccctgatgctcttggccctgattgctgtgttaacaggtggggtcaccctatttttcctgagtggcagaggactcggcaagactagcatcgggcttctgtgtgtgatggcctcctctgttttgctgtggatggcaagcgtggagccccactggattgctgcctccatcatactcgaatttttcctgatggtccttctcatccctgagcccgaccgccagaggacgccacaggataaccaactggcatatgtagtgattggattgctgtttatgatcttaaccgttgccgctaatgagatgggtctactggaaacaactaaaaaggacctcggcattgggcacgtggcggtcgagaaccatcaccatgccaccatgcttgatgtggacctgcaccctgcatcagcttggacattgtacgccgtcgccaccactatcataacacccatgatgcggcatacgattgaaaacaccactgcaaatatctctctgacagctattgccaaccaggcggctatcctcatgggactggataaaggctggccaataagtaagatggacatcggtgtgcctcttttagccctggggtgctactcgcaggttaatccgctcaccttgaccgcagccgtgctgatgctagtagctcactatgcaattatcggccccggactgcaagccaaggcgacacgtgaggctcagaaaagaactgccgcaggcattatgaagaacccaacggtggatgggatcgtcgccatagacctcgatcctgttgtgtacgacgctaaattcgaaaagcagcttggacagattatgctgttgatcctgtgtaccagccaaatcctcctgatgaggacaacttgggccttatgcgagtccattacccttgcaacaggccccctgaccactctctgggagggttctccagggaaattttggaatacgacaatcgctgtctcaatggccaacatattccgcggaagctatctagcgggcgccggtctggcattttccttgatgaagagtctgggcgggggacggcgaggcaccggggctcagggagaaactctcggcgagaagtggaaaagacagcttaatcagctgtctaagagcgagttcaacatttacaaaaggtcaggtatcatggaggtggaccgctccgaagccaaggaggggttgaaacggggagagaccacaagacacgcagtaagtcgtggcactgctaagctgaggtggttcgtggaacggaatctcgttaagcctgagggtaaagtgattgatttaggctgtgggcgcggaggctggagctattactgcgccgggctgaagaaagtcaccgaagtgaagggatatacaaaaggcggtcccgggcatgaggaaccgatcccaatggccacgtacggatggaaccttgtcaagctgcactctggcaaagacgtgtttttcacccctcccgagaagtgtgatactctactctgcgacataggcgagtcctcaccaaatcccacaatcgaagaggggcgaaccctgagagttttgaagatggtagaaccttggctgaggggaaaccaattttgtattaaaatcctcaatccgtacatgcccagcgtggtcgagactcttgagcagatgcagcggaagcatggtggcatgctggtgcgcaacccattatcgagaaattctacacacgaaatgtattgggttagttgcgggaccggaaacattgtgtccgcggtcaatatgacgagcaggatgctgttgaaccgattcaccatggctcaccggaaacctacatacgagcgtgatgtggacctcggcgcaggtactagacatgtagccgtggaacccgaggttgctaacctggatatcattgggcagcgcatcgaaaatataaagcacgagcataaatcaacctggcactatgacgaggataacccttacaagacatgggcctatcatggatcctacgaagtcaagccatctggcagcgcaagttccatggtgaatggcgtggtcaaactacttactaagccctgggacgttattcctatggtgacccaaatcgccatgacagataccactccatttgggcagcagagggtattcaaagagaaggtggacacgcggacacccaaagctaagagaggaaccgcgcaaatcatggaagtcactgcccgctggctgtggggttttctcagcaggaacaagaaaccgcgaatttgtacccgggaggagttcacaagaaaggtgaggtctaatgcagctataggcgccgtttttgtggacgagaaccagtggaactcagcaaaagaggccgtcgaagatgagcgcttctgggacctggtgcagaaggaacgtgagttgcacaaacaggggaagtgcgctacgtgcgtatataacatgatgggaaagcgggagaaaaagctgggcgagtttggtaaagccaaggggagtagagcgatctggtacatgtggctcggagcaaggttccttgagtttgaagccctgggcttcatgaatgaggatcactggttctcccgcgaaaacagcttatctggcgttgagggggagggactgcataaattgggttacattctccgagacatctcgaagattcctggcgggaatatgtatgctgatgacaccgccggatgggatactcggatcacagaagacgatctgcaaaacgaggcaaaaataaccgacatcatggaaccagagcacgctctacttgccacttcaatttttaagctgacataccagaataaggtggtcagagtgcagaggcccgctaaaaacggcaccgtgatggatgtcatcagccgcagagaccagcggggttccgggcaagttggaacatatggcctcaatactttcaccaacatggaagcccagctgattaggcagatggagagtgagggcatctttttgccttctgaattagagacgccaaacctggcagaacgtgtgctcgattggcttgagaagcatggggtagaacgactgaaacgcatggcgataagcggagacgactgtgtggtcaagcccattgatgacagattcgccaccgctctaacagccctgaatgatatgggtaaagtgcggaaggacatcccgcagtgggagccttccaagggctggaacgattggcaacaggttcccttttgctcacaccacttccatcagctcatcatgaaagacgggagggagattgtggtcccatgtcgcaatcaggatgaattggtgggcagagcacgggtaagtcaaggcgctggttggtctctgagggagactgcctgccttggaaagagctacgcacagatgtggcagctgatgtattttcaccgacgtgacctcagattagccgcgaacgctatatgttccgccgttcctgtggattgggtccccacctcacgcacaacttggagcatccatgcacaccatcaatggatgaccacggaagacatgctgtctgtgtggaatcgggtttggattgaggaaaacccatggatggaggataaaacacacgtgtccagttggggagacgtcccctacttgggcaagagggaggaccagtggtgcggcagcctgatcgggctcaccgccagagctacttgggcctcgaatattcaggtggcaatcaaccaggtacgccggcttataggaaatgaaaactatctggattacatgacatccatgaaaaggttcaagaatgagggtgaccctgaaggcgctctatggtga

SEQ ID NO: 13708 - RNA, 9879 nt, synthetic construct
  misc_feature 1..9879: note = derived and/or modified CDS sequence (opt3) from DENV-1__FJ410285__SS-prME
  source 1..9879: mol_type = other RNA
agcgtgaccatgctgctcatgcttatgcccacagccctggctttccacttgactacgcggggaggggaacctcatatgatcgtctccaagcaggaaagggggaaatctttactgtttaagacctcagccggtgttaacatgtgcacactaattgccatggacctcggcgaactgtgtgaagatactatgacctacaaatgcccacggataacagaaaccgaaccggacgatgtggactgttggtgcaatgcgactgatacatgggtaacctatgggacgtgtagtcaaactggagagcaccgccgagacaagcgtagcgtggctcttgccccacatgtcggcctgggtttggagaccagaacagaaacttggatgtcctctgagggggcatggaaacagatccagagggtggaaacctgggccctccggcaccctggattcacagttattgctctgtttctggcacatgtgatcggcacctcgattacgcagaagggcatcatattcatcctcttaatgctggtcactccatcaatggccatgcgctgcgtggggattggaagcagagattttgtagagggtcttagtggcgctacatgggttgacgtggtcttggagcacgggtcctgtgtgaccactatggccaaggataaacccacactggacatcgaactactcaagaccgaggtgacgaaccctgcggtcctgaggaaactttgcattgaagcaaagatctctaataccacaactgatagccggtgtccaacccaaggagaggccacactggttgaagaacaggacgctaacttcgtgtgccgccgaacttttgtagatagaggctggggtaatgggtgtggattgttcggcaaaggctccctcataacctgcgccaagtttaagtgcgtgacaaaactggaggggaagattgtccagcacgaaaacttaaaatactcagtgatcgttaccgtgcatactggagaccagcaccaagtcggtaatgagagtacggaacatggcacaaccgcaactattacaccccaagctcctaccaccgagatccagctgactgactatggggccctcagccttgattgttctccaaggacaggactggacttcaacgaaatggtgttgctaacgatgaaggagaaatcctggctggtacacaagcagtggtttctcgatctgccgcttccctggacctcaggcgcgagcacaagtcaagagacatggaatcggcaggacctgttggttaccttcaaaacagcccacgcaaagaagcaggaagtggtcgtgctcggttctcaagagggggctatgcatactgccctgaccggcgctacggaaatccagacctccggaacaactaccatttttgccggccacttaaaatgccgtctgaagatggataaactaacactcaaggggatgagctacgtcatgtgtactggatcgttcaaactggagaaggaagtggcagagacccagcatggtacggttcttgtgcagataaagtatgagggcacagacgccccttgcaaaatcccattctctacccaagatgaaaagggggtaactcagaacggacgcttgattacagctaatcccatcgtcaccgacaaagagaagcctgtgaacatagaagcggagccaccctttggcgagtcctacattatcatcggtgcaggggaaaaagccctgaagctctcatggttcaagaaaggcagtagcattggaaagatgtttgaggctactgccagaggcgcaaggcggatggccatcctgggggataccgcttgggacttcggatccattggtggcgtttttacatctgtggggaaacttgtccaccagatattcggaacggcctatggcgtgctgtttagcggtgtatcatggaccatgaagatcgggattggcgtgttgctcacttggctgggattaaatagtcgatccacaagcctgtctatgacctgtatcgcagttggcctagtcacactctacctgggggtgatggtgcaggcggattcaggatgcgtcatcaactggaaaggccgcgaacttaagtgtggtagtgggattttcgttactaatgaggtgcatacctggacggaacaatacaagtttcaggctgacagcccgaaaagattgtccgccgcaataggaaaggcctgggaggagggcgtgtgcggtatcaggtctgctacacggctggaaaacattatgtggaaacagatctcgaacgagctcaatcacattctgttagaaaacgacatgaagttcaccgtagtcgtgggcgatgttgccgggatcctggcacagggcaagaagatgatacgccctcaacccatggagtataaatacagctggaagtcctggggcaaggctaaaatcattggggccgacgtgcagaatactacctttatcattgatggaccaaacacacctgaatgtcccgacgatcagagagcgtggaatatctgggaggtcgaggactatggcttcggtatatttactaccaacatttggcttaagttgagggattcatacacacaggtgtgcgaccaccgtctcatgagtgccgctatcaaagattctaaggcagttcatgccgacatggggtattggattgaaagcgagaaaaatgaaacgtggaagctggctcgggcctccttcatcgaggtgaagacctgtatatggccaaaatcacacactctatggagcaacggagtactggaatctgagatgatcattcccaagatctacggcggtcctatttcccaacataattatcgaccaggctacttcacacagaccgcagggccgtggcacctcggaaaactggagcttgattttgacttgtgcgaaggcactacagtcgtggtggatgagcactgcgggaacagaggacccagtctgaggaccacgactgtcaccggcaagatcatacatgaatggtgttgccgcagctgtacattacctccactccggttcagaggtgaggacgggtgctggtacggaatggagattaggcccgttaaagaaaaggaggaaaatctggtgaagtctatggtatccgcgggccctggtgaggtggactcatttagtcttggcctgttgtgtatcagcatcatgattgaagaggtcatgcgctcgcgatggtcccggaaaatgctcatgaccgggactctggccgtgttctttctactgatcatgggacagctcacatggaacgatctgattcgtctttgcataatggttggcgctaatgcctctgacagaatggggatgggaaccacatatttggcactgatggctactttcaagatgaggccaatgtttgccgtgggcttactcttccgccggctgaccagcagagaggtccttctgctaacgatcggtctctcactggtggcaagtgttgaattgcccaactccctggaggaattaggggatggactcgccatgggcattatgatcctgaaacttctggctgactttcaatctcaccagttgtgggcgacactcctgagcctaaccttcattaagactaccttttccctgcattacgcctggaaaacaatggcaatggtgctttcaatcgtcagcctcttcccgctgtgtttgagtactacctctcagaagacgacatggctgcctgtattactcggctccctggggtgcaagccacttaccatgtttctgatagctgagaataaaatctggggaaggcgaagctggcccttgaacgaaggtattatggccgtgggcatcgtttcgattctcctgtcatctctactgaagaacgatgtgcctcttgccgggcccctcatcgctggaggcatgctgatagcatgttatgtcattagtggttccagcgccgacttgtctttagagaaagcggctgaggtgagctgggaagaggaagccgagcactccggggcatcacataatatcctggtagaagtgcaggatgacggaactatgaagatcaaagatgaggagcgcgacgatacactcaccattctgcttaaggccactctgttggctgtcagtggcgtttacccactaagcatacctgcaacactgttcgtgtggtatttctggcagaaaaagaagcagcggtctggcgtgctctgggacaccccctccccaccggaagtcgagagagccgtgctggatgacgggatctacaggattatgcagcgtggacttttaggtcgctcacaggttggcgtaggggtgtttcaagaaaacgtcttccacacgatgtggcacgtgactcggggagcggttctgatgtatcagggcaaaagactcgagcctagttgggctagcgtgaagaaagacttgatctcctacggtgggggatggaggctgcagggctcttggaataccggcgaggaagtccaggtgattgccgtagagcccgggaagaaccccaaaaatgtccaaacagcacccggaacctttaagacacctgaaggtgaggtgggcgccatcgctctcgatttcaagccagggacttcgggaagccccatagttaaccgagaaggcaaaatcgtgggtctgtacgggaatggagtcgtgaccacgtcaggcacatatgtttccgccattgcacaggctaaggccagtcaggagggccctcttccggagatcgaagacgaggtgtttcggaaacgcaacctgactattatggatttgcatccagggtctggaaagaccagaaggtacctacccgcgatcgtccgggaagccataaaacgaagactgcgcacactcattttagcacctaccagggtggtagctagcgagatggccgaagctctgaagggtatgccaatccgttatcaaactaccgcagtgaagtccgagcacacaggcaaagagatcgttgaccttatgtgccatgccacgttcactatgcggctgctctcacccgtcagagtgcctaattacaacatgattatcatggatgaagcccactttaccgacccgtctagcatagctgcgagggggtatattagtacacgcgtgggaatgggcgaggcagccgctatcttcatgaccgccactcccccaggttccgtcgaagcatttcctcagagcaatgccgtaattcaggatgaggaacgagacatccccgagagatcttggaactcagggtacgagtggataacagatttcccaggaaagaccgtgtggtttgttccttccattaaaagtggcaatgacatcgctaactgtttgcggaagaatggcaaaagggtgatccagctgagccgcaagacgttcgatactgaatatcaaaagactaaaaataacgactgggactacgtcgtgaccaccgatatttcggagatgggggcgaatttccgtgccgacagagttatcgatccccggaggtgcctcaagccagtgattctgaaagacggaccggaacgcgtcatacttgcaggtcctatgcccgtgactgtagcttctgccgcacagcgaagaggccggatcgggaggaaccataataaggagggagatcagtacatttatatgggccagccactaaacaatgacgaggatcacgcccactggacagaagctaaaatgctgttggacaacatcaatacccccgagggtatcattcctgccttatttgaaccagagcgcgaaaagtccgcggcaatagatggggagtacagactgaggggcgaggcccggaagacattcgtggaactcatgcgtcgcggagacctgcccgtttggcttagctataaagtcgcttcagagggctttcaatacagtgatcgaagatggtgcttcgacggggaaaggaacaatcaggtgctggaggaaaacatggatgtggagatctggactaaggagggagaacggaaaaagctccgccctagatggttggacgccaggacgtattctgacccgctggctctacgggagtttaaagagttcgcagccggtcgaagatccgtcagcggcgatctgattctcgagatcgggaaacttccacagcatctgacccagcgcgctcaaaatgccttagacaacttggttatgctgcacaattcagaacagggaggcagggcataccggcatgcgatggaggagctccccgatacaattgaaactctgatgcttctggccctcatcgctgtgttgaccggtggggtaacactgtttttcttaagtggccgtggactaggcaaaaccagcatagggctgctctgtgtgatggcctcctctgtccttctgtggatggcaagcgtggagcctcactggatcgctgcctccattatcttggaatttttcctgatggttctcctgattcccgagccagacagacagaggactcctcaggataaccaacttgcatatgtggtcatcggactcctgtttatgatattgacggtagccgctaatgagatgggtctgttagaaaccacaaagaaggacctaggcattgggcacgtggcggttgagaaccatcaccatgccgcaatgctggatgtggacctccaccccgcttcagcctggactctttacgccgtcgcaaccacaatcattaccccaatgatgcgccatactatcgaaaacacaacggctaatatatctctgaccgccatcgcgaaccaggctgccattttgatgggactggataaaggctggcctatcagtaagatggacattggtgtgccgctcctggcacttgggtgctactcgcaggtcaatcccttaactctgacagccgctgtgctcatgttggttgcacactatgccatcataggcccaggactgcaagcgaaagctacccgggaggcccagaagcgaaccgcagccggcattatgaaaaaccctacagtggatgggatcgtagctatcgacctagatcccgtggtctacgacgccaagttcgaaaagcagctgggacagattatgctccttatcctgtgtactagccaaatattgctgatgagaacgacctgggcactctgcgagtccattacactggctactggcccattaaccacactttgggagggttctcctgggaaattttggaataccactatcgccgtttcaatggcgaacattttcaggggaagctatctggccggcgcaggtctcgctttctccctaatgaagagtctgggcgggggacgccggggcacgggggcccagggagaaacattgggcgagaaatggaagagacagctgaatcagctctctaaaagcgaatttaacacctacaagcgttcaggtatcatggaggtggacaggtccgaagcaaaggaggggcttaaacggggagagactaccaagcacgctgtcagtcgcggcacagccaaactgcgatggttcgtggaaagaaatttggtaaagcccgagggtaaagtgatagatctgggctgtgggaggggaggctggagctattactgcgccgggctcaagaaggttactgaagtgaaaggatataccaagggcggtccggggcatgaggaaccaatccctatggcgacatacggatggaacttagtcaaactgcactctggcaaggacgtgtttttcattcccccagagaaatgtgatacgcttctgtgcgacatcggcgagtcctcacccaatcctaccattgaagaggggcggactctacgcgtcctcaagatggtggaaccgtggctgagaggaaaccaattttgtatcaaaattttgaatccctacatgccaagcgttgtagagacactggagcagatgcagaggaagcatggtggcatgctcgtgcgaaaccctctttcgagaaattctacccacgaaatgtattgggtcagttgcgggactggaaacatcgtgtccgctgttaatatgacaagccgtatgctgttaaacagattcaccatggcacaccgcaagcccacgtacgagagggatgtggacctgggcgccggtacccggcatgtcgctgtggaacctgaggtagccaacttggatataattgggcagagaatcgaaaatatcaaacacgagcataagtcaacatggcactatgacgaggataacccatacaaaacttgggcatatcatggatcctacgaagtgaagccctctggcagcgccagttccatggttaatggcgtcgtgaaactcctgaccaagccttgggacgtgattccaatggtcacacaaatagctatgactgataccacaccctttgggcagcagcgcgttttcaaggagaaagtggacaccaggactccgaaggcgaaacgaggaacggcccaaatcatggaagtaacagcaaagtggctatggggttttcttagccggaacaaaaagcctagaatttgtaccagggaggagttcactcgcaaggtgcgttctaatgctgccatcggcgcagtctttgtggacgagaaccagtggaactcagccaaagaggctgttgaagatgagcggttctgggacctggtgcacagagaaagggagctccacaagcaggggaaatgcgcaacctgcgtctataacatgatgggaaagcgcgagaaaaagctgggcgagtttggtaaggcgaaagggagtcgagcaatttggtacatgtggttgggagcccggttcctggagttcgaagctctcggctttatgaatgaggatcattggttctccagagaaaacagcctttctggcgtggagggggagggactgcacaagttaggttacatcctgagggacatatcgaaaatcccaggcgggaatatgtatgccgatgacacagcaggatgggatacgcgcattaccgaagacgatttgcagaacgaggctagaatcactgacattatggaacccgagcatgccctcctggctaagtcaatctttaaactaacataccaaaataaggtagttcgggtgcagaggcctgccaaaaacggcaccgtcatggatgtgataagccgtcgagaccagcgcggttccggacaggtgggaacttatggccttaatacattcaccaacatggaagcacaactgattagacagatggagagtgagggcatcttttctccaagcgaactcgagacacccaacctggcggaacgggtcttggattggttagagaagtacggggttgaaaggctgaagcgcatggccatctccggagacgactgtgtggtaaaaccgattgatgacagattcgctactgccctcaccgcacttaatgatatgggtaaggtgcggaaagacatacctcagtgggagccctcaaagggctggaacgattggcagcaagtcccattttgcagtcaccacttccatcagctgatcatgaaagacgggagggagattgtggttccttgtcgaaatcaggatgagctagtgggacgtgctagagtctctcagggcgccggttggagcctgcgcgagacggcatgcctcgggaagtcctatgcccaaatgtggcagttgatgtactttcaccggagggacctgagacttgcggctaacgccatctgttcagcagtgcccgtagattggattccaaccagccgcacaacttggtctatccatgcccaccatcagtggatgaccacagaagacatgctgtccgtttggaatcgggtgtggatagaggaaaacccctggatggaggataagactcacatcagtagctggggagacgtcccttatctcggcaaaagggaggaccaatggtgcggctcgttaattgggctgaccgctcgagccacgtgggcaacaaatatccaggtggctattaaccaggttagacggttgatcggaaatgaaaactacctggattacatgacctccatgaagaggttcaaaaatgagtctgacccagaaggtgccctctggtga

SEQ ID NO: 13709 - RNA, 9879 nt, synthetic construct
  misc_feature 1..9879: note = derived and/or modified CDS sequence (opt3) from DENV-1__FJ410286__SS-prME
  source 1..9879: mol_type = other RNA
agcgtgacaatgctgctcatgcttatgcccacagcactggctttccacttgactacgagaggaggggaacctcatatgatcgtctccaagcaggaaagaggaaaatctttactgtttaagacctcagccggtgttaacatgtgcacactgattgcaatggacctcggagaactgtgtgaagatactatgacctacaaatgcccacggataacagaggcggaaccggacgatgtggactgttggtgcaatgctaccgatacttgggtaacatatgggacctgtagtcagacgggagagcaccgccgagagaagcgtagcgtggcccttgcaccccatgtcggcctgggtttggaaactagaaccgagacatggatgtcctctgaaggggcctggaaacagatccagagggtggagacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagactttgtggagggtcttagtggcgcgacttgggtagatgttgtgttggaacacgggtcctgtgtcacaaccatggcaaaggacaaacccactctggatatcgagctgctcaagacagaagtgaccaaccctgccgtgctgaggaaactttgcattgaggctaagatctctaatacgaccacagacagccggtgtccaactcaaggagaagccaccctggtcgaggagcaggatgcaaacttcgtttgccgccgaacatttgtggacagaggctggggtaatgggtgtggattgttcggcaaaggctccctcctgacttgcgctaagtttaagtgcgtaaccaaattagaagggaagatagtgcagtacgagaacctgaaatattcagtcattgtgacagttcacaccggagatcagcatcaagtgggtaatgaaagtactgagcacggcacgacagccaccatcactccccaggcgcctaccacagaaattcagctcaccgactacggggcccttactctggactgtagcccaaggacaggattggatttcaacgagatggtcctactgacgatgaaggagaaatcttggctcgtgcataagcagtggtttctggaccttccgctgccctggacctccggcgcatcaactagccaagaaacatggaatcggcaggatttgctcgtaaccttcaaaacagctcacgccaagaagcaggaggttgtggtcctgggtagtcaagaaggggctatgcacactgccttaaccggcgcaacggagatccagacctctggaacaactaccatctttgccggccatctgaaatgccgtctaaagatggacaaactcacactgaaggggatgtcctatgtgatgtgtactggcagcttcaaacttgaaaaggaggtcgctgagacccagcacggtacggtgttggttcagattaagtacgaaggcacagatgcgccttgcaaaataccattctcgacccaagacgggaagggagtgactcagaacggccgcctgatcacagcaaatcccattgtaaccgataaagagaagcctgtcaacatcgaagccgagccaccctttggtgagtcttatatagtgattggggctggcgaaaaagccctcaagctgtcctggttcaagaaaggatcaagtatcggcaagatgtttgaggcaactgccagaggggctaggcggatggccatccttggagacaccgcatgggatttcggtagcattggcggggtttttacatccgtgggaaaactggtccatcagatcttcggcacggcgtacggtgtgttgttttctggggtaagctggaccatgaagattggcataggagtgctcctgacttggttaggcctaaattcacgaagtacatccctaagcatgacctgtatcgctgttgggctcgtcacactgtaccttggagtgatggtgcaggccgactctggctgcgtcattaactggaaaggtcgcgaattgaagtgtgggtcaggaatcttcgttactaatgaggtgcacacctggacggaacaatataagtttcaggcagatagtccgaaaagactgagcgccgctatcggcaaggcctgggaggagggtgtgtgcggcattaggtccgcaacacggctcgaaaacataatgtggaaacagatctctaacgagctgaatcatattttactggaaaacgacatgaagttcaccgtagtcgtgggggacgttgctggaatccttgtgcagggcaaaaagatgattcgccctcaacccatggagtacaaatattcgtggaaaagctgggggaaggccaaaatcataggagcggatgtccaaaattccacttttatcattgacggcccaaacacccctgaatgtcccgatgaccagagagcctggaatatctgggaggtggaggattacggtttcgggatttttacaactaacatctggttgaagctcagggactcatatacccaggtttgcgatcaccgtctgatgagtgctgcaataaaagactctaaggccgtgcacgctgatatgggatactggattgaaagcgagaaaaatgaaacatggaagctagcccgggcatccttcatcgaggtaaagacgtgtatttggccaaaatcacataccctgtggagcaacggcgtcctcgaatctgagatgatcatacccaagatccacggtggccctatttcccaacataattatcgaccagggtacttcactcagacagcgggaccgtggcacctgggcaaacttgagttggactttgatctgtgcgaagggaccactgtggtggtcgacgagcactgcggaaacagaggccccagtttaaggacaaccacggttactggtaagatcattcatgaatggtgttgccgcagctgtaccctccctccactgcggttcagaggggaggatggatgctggtacggcatggagatcaggcccgtgaaagaaaaggaggaaaatcttgtaaagtctatggtgtccgccggttcaggcgaggtcgacagttttagcctggggttgctctgtatatcgattatgatcgaagaggtgatgcgctcccgatggtctcggaaaatgctgatgacaggaaccctagctgttttctttctgctcatcatgggccagctgacttggaacgaccttattcgtttgtgcatcatggtgggggccaatgcaagcgatagaatgggaatgggcacaacctatctggctttaatggccacattcaagatgaggcctatgtttgcagtcggtctcctgttccgccggcttacttcaagagaggtgctgctactcaccattgggctgagtttggttgcctccgtggaactgccaaactctttagaggaactcggagacggcctggctatgggcataatgatccttaaactgttgacggattttcaaagctaccagctctgggcgacactgctatccctgaccttcattaagactaccttttcacttcactatgcctggaaaacaatggcaatggtcctcagcatcgtaagtctgttccccttgtgtctgtctactacctcccagaagacgacatggttaccggtgctcctggggagccttggatgcaagcctctgaccatgtttttgattgctgagaataaaatctggggtaggaagtcgtggccactcaacgaaggcataatggccgttgggatcgtgtcaattctgctatctagtctgcttaaaaacgacgtccccctcgccggacctctgatcgctggcggtatgttgattgcatgttacgtgatctccgggagctctgccgatttaagcctggagaaggcggctgaggtatcctgggaagaggaagccgagcattcaggagcaagtcacaatatactcgtggaagtccaggacgatggcactatgaaaattaaggacgaggagcgagatgacacactgaccatccttctgaaagccactttgctagctgttagcggcgtgtatcccctgtctatcccagcaacactcttcgtgtggcatttctggcaaaagaagaaacagcgctccggggtcctgtgggataccccttcacccccagaagtggagcgggccgttcttgacgatggaatttacagaataatgcagaggggtttactgggccgtagtcaggtaggggtgggagtctttcaagaaaacgtgttccacacgatgtggcacgttactcgcggcgcggtgctcatgtatcagggtaagcggttggagccgagctgggcttccgtcaaaaaggacctgatctcttacgggggaggctggagatttcagggctcgtggaataccggggaggaagtgcaggtaattgccgtcgagcctggcaagaatcccaagaatgtgcaaacagcaccaggtaccttcaagacacccgaaggcgaggttggggccatcgctctcgactttaaacctggaactagcggctcaccaattgtgaacagggaaggtaagatcgtcgggctgtacggaaatggcgtggttaccacgtccggcacatatgtgagtgccatagcacaggctaaagcctctcaggaggggccccttcctgagatcgaagatgaggtcttccgaaagcggaacctgactattatggacttgcatccgggaagcggtaaaacccgcagatacctaccagcgatcgtgagggaagccattaagcggaagctgcgaacactcatcttagcacccaccagagtagtggcttccgagatggccgaagctctgaaaggcatgcctatacgctatcaaactaccgcagttaagtcagagcacacagggaaagagattgtcgatcttatgtgccatgccacgtttactatgaggctgctctctccagtgcgtgtgcccaattacaacatgatcatcatggacgaagcccacttcaccgatcctagcagtattgctgcgcggggatatatctccacaagagtcggcatgggtgaggcagccgctatatttatgaccgccactccgcccgggagcatggaagcattcccacagtctaatgccgtaattcaggacgaggaaagggatatccctgagcgctcatggaactccggatacgagtggattacagactttcccggcaagaccgtgtggttcgttccaagtatcaaagctggcaatgatatagcgaactgtttgcgaaagaatgggaagagagtgattcagctgagccggaaaacgttcgacactgaatatcaaaagaccaagaacaacgattgggactacgtcgtgaccaccgacatctcggagatgggagccaattttagggcagatcgcgttatcgaccctcgtagatgcctcaagcccgtgattctgaaagatggtccagaacgggtcatccttgctggcccgatgcctgtgactgtagcctctgcagcccagaggcgcgggcgaattggaagaaaccataataaggagggcgaccagtacatatatatgggtcagcccctaaacaatgatgaggaccacgctcactggacagaagccaagatgctgttggataacatcaataccccagaggggattatccccgcgttattcgaacctgagcgggaaaaatccgcagccatcgacggcgagtacaggctgcgcggagaggctagaaagacatttgtggaactcatgaggcggggcgatctgccagtttggcttagctataaagtcgcctcagaggggttccaatacagtgaccgtcgctggtgctttgatggagaacgaaacaatcaggtgctggaggaaaacatggacgtggagatttggactaaggagggtgaaaggaaaaagctcaggccccggtggttggatgctcgcacgtattctgaccctctggcactaagagagttcaaagaatttgccgctggcaggcggtccgtcagcggggacctgatactcgagatcggaaaacttccgcagcatctgacccagcgagcccaaaatgcattagataacttggttatgctgcacaattcagaacagggcggtagagcgtaccgccatgccatggaggagctcccagacacaattgaaactctgatgcttctggctctcatcgccgtgttgaccgggggcgtaacactgttctttttaagtggaaagggcctagggaaaaccagcattggactgctctgtgtgatggcatcctctgtccttctgtggatggctagcgtggagccccactggatcgccgcatccataatcttggagttctttctgatggttctcctgattcctgagcccgataggcagcggactccacaggacaaccaacttgcctatgtggtcatcggtctcctgttcatgattttgacggtagctgcgaatgagatgggcctgttagaaaccacaaagaaagatctagggatcggacacgtggccgttgagaaccatcaccatgcagctatgctggacgtggatctccaccctgcctcagcctggactctttacgcagtcgctaccacaataattacccccatgatgcgtcatactatcgaaaacacaacggccaatatttctctgaccgcgatcgctaaccaggccgcaatattgatgggcctggacaagggttggccaatcagtaaaatggatattggggtgcctctcctggcccttggctgctactcgcaggtcaatccgttaactctgacagctgcagtgctcatgttggttgcccactatgcgatcattggacccggcctgcaagctaaggccaccagagaggcacagaagaggaccgccgctgggatcatgaaaaacccaacaatagacggaattgtggccatcgatctagaccctgtagtgtacgatgcaaagtttgaaaaacagctgggccagatcatgctccttattctgtgtactagccaaatcttgctgatgcgcacgacctgggctctctgcgagtccataacactggccactggtcccttaaccacactttgggaggggtctccaggaaagttctggaataccactattgcggtctcaatggccaacatcttccggggcagctatctggcaggagctggcctcgccttttccctaatgaaaagtctagggggtggccgaagagggacgggagcacagggcgaaacattgggtgagaagtggaagaggcagctgaatcagctctctaaaagcgagttcaacacctacaagcgctcagggattatggaagttgaccggtccgaagctaaagagggacttaagagaggcgagactaccaaacacgccgtgagtcgtggtacagccaagctgaggtggtttgtcgaacggaatttggtgaagcctgagggcaaagtaatcgacctggggtgtggacgcggcgggtggagctattactgcgcgggactcaagaaagtgactgaagttaagggctataccaaaggtgggcccggacatgaggaaccgataccaatggctacatacggctggaacttagtgaagctgcactctggcaaagatgtcttctttatccctcccgagaagtgtgacacgcttctgtgcgatattggggagtcctcaccaaatcccaccatcgaagagggacgaactctaagagtgctcaagatggtcgaaccttggctgaggggtaaccaattctgtattaaaatcttgaatccgtacatgcccagcgtggttgagacactggagcagatgcagcggaagcatggcgggatgctcgtacgcaacccactttcgagaaattctacccacgaaatgtattgggtgagttgcggaactggcaacattgtctccgcagtgaatatgacaagcaggatgctgttaaaccgatttaccatggcccaccggaaacctacgtacgagcgtgacgttgatctgggtgctgggaccagacatgtggccgtcgaacccgaggtggcaaacttggacatcataggacagcgcattgaaaatatcaagcacgagcataaatcaacatggcactatgatgaggacaacccttacaagacttgggcctatcatggctcctacgaagtaaagccatctggcagcgctagttccatggtgaatggggttgtcaaactcctgaccaagccctgggatgtgatccctatggtgacacaaattgcgatgactgacaccacaccattcggacagcagagggtctttaaagagaaggttgatacccggactcccaaagccaagagaggtacggcacaaataatggaagtgacagctcgctggctatggggcttccttagcaggaacaagaaaccgcgaatctgtacccgggaggaatttactagaaaggtaaggtctaatgccgcaattggggccgtgttcgtcgacgagaaccagtggaactcagctaaagaggccgtggaagacgatcgcttttgggacctggttcaccgtgagcgggaactccacaagcagggaaaatgcgcgacctgcgtgtataacatgatgggcaagagagagaagaaactgggtgagttcgggaaggcaaaaggaagtagggccatctggtacatgtggttgggcgctcgcttcctggagtttgaggccctcggcttcatgaatgaagatcattggttttcccgagagaacagcctttctggggtcgaaggagagggtctgcacaagttaggctacattctgcgggacatctcgaaaatacctgggggaaatatgtatgcagatgacacagctggctgggatacgagaatcaccgaggacgatttgcagaacgaagccaagattactgacatcatggagccagaacatgctctcctggccaaatcaattttcaagctaacataccaaaataaggtggtaagggttcagcgccccgccaaaaacggtaccgtgatggatgtcatcagcagacgggaccagagggggtccggacaggtgggcacttatggccttaatacatttaccaacatggaggcgcaactgatacgtcagatggaaagtgaggggattttcctccctaacgagctggaaacaccaaatttggccggacgagtgttagattggctggagaagtacggtgtcgaacgcctcaaaagaatggctatctctggcgacgactgtgttgtgaagcccatcgatgaccggtttgccactgcacttaccgctctgaacgatatggggaaagtaaggaaggacattccgcagtgggagcctagcaagggatggaatgattggcagcaagtgcccttctgctcccaccactttcatcagctaataatgaaagacggccgcgaaatcgtcgtgccatgtagaaaccaggatgagctggttggtcgggccagggtgtcacagggggcaggatggagtctccgagagacggcctgcttgggcaagtcttatgcgcaaatgtggcagctgatgtacttccaccgtagagaccttcgcctggctgccaatgcaatttgtagcgccgtccctgtggattgggtacccacctcccggacaacttggtcaatccatgctcaccatcagtggatgaccacagaagacatgctcagcgtttggaacagggtgtggattgaggaaaatccatggatggaggataaaactagaatctcttcctgggaagacgtcccctatttaggcaagcgcgaggaccaatggtgcgggagtctgataggattgaccgcccgggcaacgtgggctacaaacatccaggtggccattaatcaggttaggcgactgatcggtaacgagaattacagcgattacatgacctcgatgaaaagatttaagaacgaatccgagcctgaaggcgcgctctggtga

SEQ ID NO: 13710 - RNA, 9879 nt, synthetic construct
  misc_feature 1..9879: note = derived and/or modified CDS sequence (opt3) from DENV-1__FJ461339__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagttctgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagagcaggacgcaaactttgtttgccgccgaacattcgtggatagaggctggggtaatgggtgtggactgtttggcaaaggctccttgataacttgcgctaagttcaagtgcgtaaccaaactcgaggggaagattgtgcagtacgaaaacctgaaatattcagtcatcgtgacagttcacaccggagaccagcatcaagtgggtaatgagagtactgaacacggcacgacagccaccattactccccaggcgcctagcaccgagatccagttaacagactacggggccctgaccctcgattgttctccaaggactggacttgactttaacgaaatggtcctgttgacaatgaaggagaaatcctggctagtgcataagcagtggttcctggatctcccgctgccctggacgtcaggcgcaagcaccagtcaagagacttggaatcggcaggaccttctggtaacatttaaaaccgctcacgccaagaagcaggaagttgtggtcttgggttctcaagagggggctatgcacacagccctcactggcgcaaccgaaatccagacgtccggaaccacaactattttcgccggccatctgaaatgccgtttaaagatggataaactgaccctaaaggggatgagctatgtgatgtgtacaggatcgttcaaactcgagaaggaagtcgctgagactcagcacggtaccgtgctggttcagataaagtacgagggcacggacgcgccttgcaaaatcccattttctacacaagatgaaaagggggtgacccagaacggacgccttattactgcaaatcccatcgtaacagacaaagagaagcctgtcaacatagaagccgagccacccttcggcgagtcctatattgtgatcggtgctggggaaaaagccttgaagctgtcatggtttaagaaaggcagtagcatcggaaagatgttcgaggcaaccgccagaggcgctaggcggatggccattctcggggatactgcatgggactttggatccatcggtggcgttttcacctctgtggggaaactggtccatcagatttttggaacagcgtacggcgtgcttttcagcggtgtatcatggacgatgaagatagggatcggcgtgctgttgacctggctcggactgaatagtcgatccactagcttatctatgacatgtattgctgttggcctggtcaccctatacctcggggtgatggtgcaggccgattcaggatgcgtcatcaactggaaaggccgcgaactgaagtgtggtagtgggatctttgttacaaatgaggtgcacacttggaccgaacaatataagttccaggcagacagcccgaaaagactttccgccgctattggaaaggcctgggaggagggcgtgtgcggtataaggtctgcaacgcggttggaaaacatcatgtggaaacagatttcgaacgagctgaatcatatcctcctggaaaacgacatgaagttaacagtagtcgtgggcgatgttgctgggattctggcccagggaaaaaagatgatccgccctcaacccatggagtacaaatatagctggaagtcctggggcaaggcgaaaataatcggggccgacgtgcagaataccacttttattatcgatggaccaaacacccctgaatgtcccgacgatcagagagcttggaatatttgggaggtcgaggactacggcttcggtatctttacaactaacatatggcttaagttgagggattcacacacccaggtgtgcgaccaccgtctcatgagtgcagccattaaagattctaaggctgttcatgccgacatggggtattggatcgaaagcgagaaaaatgaaacatggaagctggcacgggcgtccttcattgaggtgaagacgtgtatctggccaaaatcacacaccctatggagcaacggagtactggaatctgagatgataatccccaagatttacggcggtcctatctcccaacataattatcgaccaggctacttcactcagacagccgggccgtggcacctcggaaaactggagcttgattttgacttgtgcgaaggcaccactgtcgtggtggatgagcactgcgggaacagaggacccagtctgaggacaaccacggtcactggcaagattatccatgaatggtgttgccgcagctgtaccttacctccactccggttcaaaggtgaggacgggtgctggtacggaatggagataagacccgttaaggaaaaggaggaaaatctggtgaaatctatggtatccgctggctcaggtgaggtggacagttttagccttggcctgttgtgtatttcgatcatgatcgaagaggtcatgaggtcccgctggtctcgaaagatgctcatgacagggaccctggccgtgttctttctactgattatgggacagctcacttggaacgatctgatccggctttgcattatggttggcgcaaatgctagcgaccgtatggggatgggaacaacctatttggccctgatggcaacattcaaaatgagacctatgtttgccgtgggcttactcttcaggcgcctgacttcacgggaggtccttctgctaaccataggtctcagtctggtggcttccgttgaattgccaaactctctggaggaattaggggatggactcgcgatgggcatcatgattctgaagcttctgacggactttcaaccccaccagttgtgggccacactcctgagcctaaccttcatcagaactaccttttccctgcattacgcatggaaaacaatggctatggtgctttcaattgtcagcctcttcccgctgtgtttgagtactacctctcagaagacgacatggctgcctgtattactcggctccctggggtgcaagccacttaccatgtttctgatcgccgagaataaaatatggggaaggaagagctggcccttgaacgaaggtatcatggccgtgggcattgtttcgatcctcctgtcatctctactgaaaaacgatgtgcctcttgctgggcccctcattgcaggaggcatgctgatcgcctgttatgtcataagtggttccagcgcggacttgtctttagagaaggctgccgaggtgagctgggaagaggaagcagagcactccggggcctcacataatattctggtagaagtgcaggatgacggaactatgaaaatcaaggatgaggagcgagacgatacactcaccatcctgcttaaagctactctgttggcagtcagtggcgtttacccactaagcattcctgccacactgttcgtgtggtatttctggcaaaagaagaaacagcgctctggcgtgctctgggacaccccctccccaccggaagtcgagcgggcggtgctggatgacgggatatacagaatcatgcagaggggacttttaggtcgttcacaggttggcgtaggggtgtttcaagaaaacgtcttccacacgatgtggcacgtgactcgcggagctgttctgatgtatcagggcaagcggctcgagcctagttgggccagcgtgaaaaaggacttgatttcctacggtgggggatggagactgcagggctcttggaataccggcgaggaagtccaggtgatcgcagtagagcccgggaaaaacccaaagaatgtccaaacagcccccggaacctttaagacatcggaaggtgaggtgggcgctattgccctcgatttcaaacctgggactagcggatcaccaatcgttaacagggaaggcaagatagtgggtctgtacgggaatggagtcgtgaccacgtccggcacatatgttagtgcaatcgctcaggccaaagcgtctcaggagggcccccttcctgagattgaagacgaggtgtttcgaaagcggaacctgactatcatggatttgcatccggggagcggaaaaacccgcagatacctaccagccattgtcagggaagcaatcaagcggcgactgagaacactcatattagctcccacccgcgtggtagcctccgagatggctgaagcactgaagggtatgcctattaggtatcaaactaccgccgtgaaatcagagcacacaggcaaggagatcgttgaccttatgtgccatgccacgttcactatgcgtctgctctctccagtccgggtgcccaattacaacatgatcattatggatgaagctcactttaccgaccctagcagtatcgcggcaagagggtatatatccacaagggtgggaatgggcgaggccgctgccattttcatgaccgcaactccgcccggtagcgtcgaagcctttccacagtctaatgctgtaatccaggatgaggaacgcgacattcctgagcgatcatggaactccgggtacgagtggatcacagatttccccggaaaaaccgtgtggtttgttccaagtataaagagcggcaatgacattgcgaactgtttgagaaaaaatggcaagcgggtgatccagctgtcgaggaagacgttcgatactgaatatcaaaaaacaaagaacaacgactgggactacgtcgtgaccaccgatatctctgagatgggggccaatttccgcgcagaccgtgttattgatcctagacggtgcctcaaacccgtgatcctgaaggacggaccagaaagggtcattcttgctggtccgatgcctgtgactgtagcctccgcagcccagcgccgaggcagaatagggcggaaccataataaagagggagatcagtacatctatatgggccagcccctaaacaatgacgaggatcacgctcactggacagaagccaagatgctgttggacaacattaataccccagagggtatcatccccgcgttatttgaacctgagagggaaaagagcgcagccattgatggggagtaccgcctgagaggcgaggctaggaaaacattcgtggaactcatgcggcgtggagacctgccagtttggctttcatataaggtcgccagtgagggctttcaatactctgatcgccgatggtgcttcgacggggaaagaaacaatcaggtgctggaggaaaacatggatgtggagatatggactaaagagggagaaaggaagaaactccggccccgctggttggacgctagaacgtattccgaccctctggcactaagggagtttaaggaattcgccgctggtcggcgaagcgtctcaggcgatctgatcctcgagattgggaaacttccgcagcatctgacccagagagcccaaaatgcattagacaacttggttatgctgcacaatagtgaacagggaggccgcgcgtacaggcatgccatggaggagctcccagatacaatcgaaactctgatgcttctggctctcattgccgtgttgaccggtggggtaacactgtttttcttaagcggccggggactaggcaagacctccatcgggctgctctgtgtgatagcatctagcgtccttctgtggatggcttccgtggagccccactggatcgccgcatcaattatcttggaatttttcctgatggttctcctgattcctgagcccgaccgtcagagaactccacaggataaccaacttgcctatgtggtcatcggactcctgtttatgatattgacggtagctgcgaatgagatgggtctgttagaaaccacaaagaaagacctaggcattgggcacgtggccgttgagaaccatcaccatgcagctatgctggatgtggacctccaccctgcctctgcctggactctttacgcagtcgctaccacaatcattacccccatgatgaggcatactatcgaaaacacaacggccaatataagtctgaccgcgatcgctaaccaggccgcaattttgatgggactggataagggctggccaatctcgaaaatggacattggtgtgcctctcctggcccttgggtgctacagccaggtcaatccgttaactctgacagctgcagtgctcatgttggttgcccactatgcgatcataggccccggactgcaagctaaggccacccgcgaggcacagaaacggaccgccgctggcattatgaagaacccaacagtggatgggatcgtagccatcgacctagatcctgtggtctacgacgcaaagttcgaaaaacagctgggacagattatgctccttatcctgtgtacttcccaaatattgctgatgcgaacgacctgggctctctgcgagtctattacactggccactggccccttaaccacactttgggagggttcaccagggaagttttggaataccactatcgcggttagcatggccaacattttcagaggatcctatctggcaggcgtgggtctcgctttcagtctaatgaaatctctgggcgggggaaggcgcggcacgggggcccagggagaaacattgggcgagaagtggaaacggcagctgaatcagctcagcaagtcagaatttaacacctacaagagatccggtatcatggaggtcgaccgtagtgaagcaaaagaggggcttaagaggggagagactaccaaacacgctgtgagccggggcacagccaagctgcgctggttcgtagaacgaaatttggtgaaacctgagggtaaggttatagatctgggctgtgggagaggaggctggtcttattactgcgccgggctcaagaaagtgactgaagtcaagggatataccaaaggcggtcccgggcatgaggaaccgatcccaatggcgacatacggatggaacttagtgaagctgcactccggcaaagacgtctttttcattcctcccgagaagtgtgatacgcttctgtgcgacatcggcgagtcaagcccaaatcccaccattgaagaggggaggactctacgggtgctcaaaatggttgaaccttggctgcgcggaaaccaattttgtatcaagattttgaatccgtacatgccctcggtagtggagacactggagcagatgcagagaaagcatggtggcatgctcgtcaggaacccactttctcgaaatagtacccacgaaatgtattgggtgtcctgcgggactggaaacatcgttagcgctgtgaatatgacatcacggatgctgttaaaccgtttcaccatggcacacagaaaacctacgtacgagcgcgatgtcgacctgggcgccggtaccaggcatgtggctgtagaacccgaggtggccaacttggatataattgggcagcggatcgaaaatatcaagcacgagcataaatccacatggcactatgacgaggataacccttacaagacttgggcatatcatggatcttacgaagttaaaccaagcggcagtgcctccagcatggtcaatggcgtggtgaagctcctgaccaagccctgggacgtcattcctatggttacacaaatagctatgactgataccacaccatttgggcagcagagagtgttcaaagagaaggtagacacccgcactcccaaagcgaagaggggaacggcccaaatcatggaagtgacagcaaaatggctatggggttttctttctcgaaacaagaagccgcggatttgtaccagagaggaattcactaggaaagtccgctcaaatgctgccatcggcgcagtgtttgttgacgagaaccagtggaatagtgccaaggaggctgtggaagatgagcgtttctgggacctggtccaccgggaaagagagctccacaaacaggggaagtgcgccacctgcgtgtataacatgatgggaaaaagggaaaagaagctgggcgagtttggtaaagcgaaggggtcccgcgcaatttggtacatgtggttgggagcccgattcctggagttcgaagctctcggctttatgaatgaggatcattggttcagccgggaaaactctctttcgggcgtagagggggagggactgcacaaattaggttacatcctgagagacatatcaaagatccctggcgggaatatgtatgccgatgacacagcaggatgggatacgaggattaccgaagacgatttgcagaacgaggctaaaatcactgacattatggaaccagagcatgccctcctggctaagagcatctttaaactaacataccaaaataaggttgtgcgcgtccagagacccgccaagaacggcaccgtgatggatgtgatatcccggagggaccagcgtggtagtgggcaggtcggaacttatggccttaatacattcaccaacatggaagcacaactgattcgacagatggagtctgagggcatctttagcccttccgaactcgagacatcaaacctggcggggcgcgttttggattggttagaaaaacacggagtggagagactgaagcggatggccatcagtggtgacgactgtgtagtgaaaccaattgatgacaggttcgctactgccctcaccgcacttaatgatatgggcaaggtccgcaaagacataccccagtgggaaccgtctaaggggtggaacgattggcagcaagtgcctttttgcagccaccatttccaccagctgatcatgaaggacggaagagagattgttgtgccctgtcggaatcaggatgagctagtcggcagggctcgagtgtcccagggtgccgggtggtcactgcgtgaaacggcatgcctcggaaaaagctacgcccaaatgtggcagttgatgtattttcatagacgcgacctgcggcttgcggctaacgccatctgttctgcagtaccagttgattgggtgcctacctccaggacaacttggagtattcacgcccatcaccagtggatgaccacagaggacatgctgagcgtctggaatagagtgtggatcgaagagaacccctggatggaagataagactcacgtttcgtcctggggcgacgtgccatacctcggcaaacgcgaggaccaatggtgcgggtctttaataggactgaccgctcgggccacgtgggcaacaaatatccaggtcgctattaaccaggtgaggcgattgctgggtaatgagaactatctcgattacatgacctcaatgaagagattcaaaaatgaaagcgaccccgagggcgccctttggtga

SEQ ID NO: 13711 - RNA, 9879 nt, synthetic construct
  misc_feature 1..9879: note = derived and/or modified CDS sequence (opt3) from DENV-1__FJ882515__SS-prME
  source 1..9879: mol_type = other RNA
agcgtgaccatgctgctcatgcttatgcccaccgccctggctttccacttgactacgagaggaggggaacctcatatgatcgtcaccaagcaggaaaggggaaaatccttactgtttaagacatctgccggtgttaatatgtgcactttaattgccatggacctcggcgagctgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactgggagcttcaaactggagaaggaagtggctgagacccagcacggtacggtccttgtgcagataaagtacgagggcacagacgcgccttgcaaaatcccattctcgacccaagatgaaaagggggttactcagaacggacgcttgattacagcaaatcccatcgtgaccgacaaagagaagcctgtaaacatagaagccgagccaccctttggcgagtcttatattgtcatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtgtttacatccattgggaaacttgttcatcagatattcggaacggcgtacggcgtgctgttttctggtgtcagctggaccatgaagatcgggattggcgtgttgctcacttggctgggattaaattcacgaagtacatccctgagcatgacctgtatcgctgtaggcctagtgacactctacctgggggttatggtccaggccgattctggatgcgtgatcaactggaaaggccgcgaacttaagtgtggttcagggattttcgtgactaatgaggtccacacctggacggaacaatataagtttcaggcagacagtccgaaaagattgagcgccgctataggaaaggcctgggaggagggcgtttgcggtatcaggtccgcaacacggctggaaaacattatgtggaaacagatctctaacgagctcaatcatattctgttagaaaacgacatgaagttcaccgtggtggtaggcgatgtcgtggggatcctggctcagggcaagaagatgatacgccctcaacccatggagcacaaatactcgtggaaaagctggggcaaggccaaaatcattggggcggacgttcagaatactacctttatcattgatggaccaaacacacctgaatgtcccgacgatcagagagcctggaatatctgggaggtggaggactatggcttcggtatatttactaccaacatttggcttaagatgagggattcctacacacaggtctgcgaccaccgtttgatgtcagctgcaatcaaagatagtaaggccgtgcatgctgacatggggtattggattgaatctgagaaaaatgaaacgtggaagctcgcccgggcatccttcatcgaggttaagacctgtatatggccaaaatcccacactctgtggtcaaacggagtgctagaaagcgagatgatcattcccaagatctacggcggtcctatttctcaacataattatcgaccaggctacttcacacagaccgcggggccgtggcacctgggaaaactcgagctggattttgacctttgcgaaggcactacagtagtcgtggatgagcactgcgggaacagaggaccctccttgaggaccacgactgtgaccggcaagatcatacatgaatggtgttgccgcagttgtacactgcctccattacggttcaaaggtgaggacgggtgctggtacggaatggagattagacccgtcaaggaaaaggaggaaaatctcgttaaaagcatggtgtctgccggctccggtgaggtagactcatttagtctgggccttctgtgtatcagcatcatgattgaagaggtgatgaggtcgcgctggtcccgaaagatgttgatgaccgggactctcgctgtcttcctgctactgatcatgggacagctcacatggaacgatctgattcggctttgcataatggtgggcgccaatgcatctgaccgtatggggatgggaaccacatatttggctctgatggccacttttaaaatgagacctatgttcgcagttggcttactctttaggcgcctgaccagccgggaggtgcttctgctaacgatcggtctctcactggtcgccagtgtggaattgccaaactccctggaggaattaggggatggactcgctatgggcattatgatcctgaaacttctgacagacttccaatctcaccagttgtgggcgaccctcctgagcctaacttttattaaaaccacactgtcccttcattacgcctggaagactatggcaatggttctctcaatcgtgagcctgatacccttgtgtctgagtaccacgtctcagaagacaacctggttaccggtcctcctgggctcccttgggtgcaaacctctgactatgttcttgatcgctgagaataagatttggggaagaaaaagctggccactcaacgaaggtatcatggccgtaggcgtggtttcgattctgctatcatctctgcttaagaacgatgtgcccctcgccgggcctctgatcgctggaggcatgttgatagcatgttatgtcattagtggttccagcgccgacttatctctggagaaagcggctgaggtgagctgggaagaggaagccgagcactccggggcatcacataatatcctcgtagaagtgcaggatgacggaacaatgaagatcaaagatgaggagagggacgataccctgactattcttctgaaggccacattgctagctgtcagtggcgtttaccccctgagcataccagcaaccctctttgtgtggtatttctggcaaaagaaaaagcagcgatctggcgtgctgtgggacacgccttcacccccagaagtcgagcgcgccgtgcttgatgacgggatctaccggattatgcagagaggattactgggtaggagccaggttggcgtaggggtgtttcaagaaaacgtcttccacactatgtggcacgtgacccgtggagcggttctcatgtatcagggcaaacgcttggagccgagttgggctagcgtgaagaaagacctgatctcctacggtgggggatggcggctccagggctcttggaatacaggcgaggaagtccaggtgattgccgtagagcctgggaagaaccccaagaatgtccaaaccgcaccaggaacattcaaaactcccgaaggtgaggtgggcgccatcgctctggattttaagcctgggacctcgggaagcccaatagttaacagagaaggcaaaatcgtgggtctttacgggaatggagtcgtgacgacatcaggcacttatgtttccgccattgcacaggctaaggccagtcaggagggccccctgcctgagatcgaagacgaggtgttcaggaaacgaaacttgaccattatggatctacatccggggtctggaaagacacggcgctacctgccagcgatcgtcagagaagccataaagaggaaactccggaccttaattctggcacccactcgagtggtagctagcgagatggccgaagctcttaagggtatgcctatcagatatcaaaccacagcagtgaaatccgagcacacgggcaaggagatcgttgacctgatgtgccatgccacttttaccatgcgcctcttgtcaccagtcagggtgcccaattacaacatgattatcatggatgaagcccacttcacagacccttctagcatagctgcgcgtgggtatattagtacccgggtgggaatgggcgaggcagccgctatctttatgactgccacaccgcccggttccgtcgaagcattcccacagagcaatgccgtaattcaggatgaggaaagagacatccctgagaggtcttggaactcagggtacgagtggataaccgattttcccggaaaaacggtgtggttcgttccatccattaagagtggcaatgacatcgctaactgtctgcgcaagaatggcaaacgagtgatccagctcagcagaaagacttttgatacagaatatcagaagaccaagaacaacgactgggactacgtcgtgaccactgatatttcggagatgggggcgaatttccgggccgacagggttatcgatcctcgccgttgcctgaaacccgtgattcttaaggacggaccagaaagagtcatactagcaggtccgatgcctgtgacagtagcttctgccgcacagcggaggggccgcatcgggcgaaaccataataaggagggagatcagtacatttatatgggccagcccctgaacaatgacgaggatcacgcccactggaccgaagctaaaatgttgttagacaacatcaatacaccagagggtatcattcccgccctgtttgaacctgagagagaaaagtccgcggcaatagatggggagtaccggctcaggggcgaggcccgcaaaactttcgtggaactgatgagaaggggagaccttccagtttggctgagctataaggtcgcttcagagggcttccaatacagtgatcggcgttggtgctttgacggggaacgcaacaatcaggtgctcgaggaaaacatggatgtggagatctggacgaaagagggagaacgaaagaaattgagacccaggtggctggacgcccggacctattctgaccctctagctctgcgcgagttcaaggaatttgcagccggtagaaggtccgtcagcggcgatctcattcttgagatcgggaagctgccgcagcatttaacacagcgggctcaaaatgccttggacaacctggttatgctccacaattcagaacagggaggccgagcatacagacatgcgatggaggagctgccagatactattgaaacccttatgctgctcgccttgatcgctgtgctgacaggtggggtaaccttattctttctaagtggccgcggactgggcaaaactagcatagggctcctttgtgtgatggcctcctctgtcctgttgtggatggcaagcgtggagccccactggatcgctgcctccattatcctggagttctttctcatggttctgcttattcctgagcccgacaggcagcggacgccacaggataaccaactcgcatatgtggtcatcggactgttgttcatgatactgaccgtagccgctaatgagatgggtttactagaaacaactaagaaagacctgggcattgggcacgtggcggttgagaaccatcaccatgccaccatgctcgatgtggaccttcaccctgcatcagcttggacactgtacgccgtcgccaccactatcattacacccatgatgcgtcatacgatcgaaaacaccactgcaaatatatctttgacagctatcgccaaccaggcggctattctgatgggactcgataagggctggccaatcagtaaaatggacattggtgtgcctctgcttgccttagggtgctactcgcaggtcaatccgctgaccctcaccgcagccgtgttgatgctggttgctcactatgcaatcataggccccggactacaagccaaggcgacaagagaggctcagaagaggactgccgcaggcattatgaaaaacccaacggtggatgggatcgtagccatcgacctggatcctgtggtctacgacgctaagtttgaaaaacagctcggacagattatgcttctgatcttgtgtaccagccaaatactgctcatgcgcacaacttgggccctgtgcgagtccattaccttagcaacaggcccccttaccactctgtgggagggttctccagggaagttctggaatacgacaatcgctgtttcaatggccaacatttttcggggaagctatctcgcgggcgccggtctagcattctccctgatgaaaagtttgggcgggggacgaagaggcaccggggctcagggagaaactctgggcgagaagtggaagaggcagctcaatcagctttctaaaagcgaatttaacatctacaagcgctcaggtataatggaggtggaccggtccgaagccaaagaggggctgaagagaggagagaccacacgtcacgcagtcagtaggggcactgctaaattgcggtggttcgtggaacgcaatctggtaaagcctgagggtaaggtgatcgatctcggctgtgggcgaggaggctggagctattactgcgccgggctaaagaaggttaccgaagtgaaaggatatacaaagggcggtcccgggcatgaggaaccgattccaatggccacgtacggatggaacctggtcaaacttcactctggcaaggacgtgttctttacccctcccgagaaatgtgatactctgctatgcgacatcggcgagtcctcaccaaatcccacaattgaagaggggagaaccctcagggtcctgaagatggtggaaccttggttgcggggaaaccaattctgtatcaagattctgaatccgtacatgcccagcgttgtagagactctcgagcagatgcagcgcaaacatggtggcatgcttgtgagaaacccactgtcgagaaattctacacacgaaatgtattgggtcagttgcgggaccggaaacatcgtgtccgcggttaatatgacgagccgaatgttactgaaccggtttaccatggctcaccgtaagcctacatacgagaaagatgtggacttgggcgcaggtactagacatgtcgccgtggaacccgaggtagctaacctcgatataattgggcagcgcatcgaaaatatcaagcacgagcataaatcaacctggcactatgacgaggataacccttacaagacatgggcctatcatggatcctacgaagtgaagccatctggcagcgcaagttccatggttaatggcgtcgtgaaactgctaactaagccctgggacgtgattcctatggtcacccaaatagccatgacagataccactccattcgggcagcagagggtttttaaagagaaggtggacacgcggacacccaaagctaagagaggaaccgtacaaatcatggaagtgactgcgcgctggctttggggtttcctgagcaggaacaagaaaccgcgaatttgtacccgggaggaatttacaagaaaggtcaggtctaatgccgcaatcggcgctgtgttcgttgacgagaaccagtggaactcagccaaagaggcagtggaagatgagcgcttttgggacctcgtccagaaggaacgtgagctgcacaaacaggggaagtgcgccacgtgcgtgtataacatgatgggaaagcgggagaaaaagttgggcgagttcggtaaagctaaggggagtagagccatttggtacatgtggctgggagcgaggtttctcgagttcgaagcacttggctttatgaatgaggatcactggttctcccgcgaaaacagcctgtctggcgtagagggggagggattacataaactgggttacatcttgcgagacatatcgaagatccctggcgggaatatgtatgccgatgacaccgctggatgggatactcggattacagaagacgatctccaaaacgaggccaaaatcaccgacattatggaaccagagcacgcactgctagctacttcaatcttcaaacttacataccagaataaggttgtgagagtccagaggcccgccaaaaacggcaccgtgatggatgtgataagccgcagagaccagcggggttccgggcaagtcggaacatatggcctgaatacttttaccaacatggaagctcagctcattaggcagatggagagtgagggcatcttcctgccttctgaattggagacgccaaacttagccgaacgtgttctggattggctcgagaagtacggggtggaacgacttaaacgcatggcaatcagcggagacgactgtgtagtgaagcccattgatgacagatttgcgaccgccctgacagctctaaatgatatgggtaaagtccggaaggacataccgcagtgggagccttccaagggctggaacgattggccccaagtgccacattgctcacaccacttccatcagctgatcatgaaagacgggagggagattgttgtgccttgtcgcaatcaggatgaactcgtcggaagggcacgggtgagtcagggcgcaggttggtctttgagggagactgcttgcctgggaaagagctatgcccaaatgtggcagcttatgtactttcaccgacgtgacctgagactcgcagccaacgcgatctgttccgctgtacccgttgattgggtgccaacctcacgcacaacttggagcattcatgcccaccatcagtggatgaccacggaagacatgttatctgtctggaatcgggtgtggatcgaggaaaacccctggatggaggataaaacacacgtttccagttggggagacgtgccttatctgggcaagagggaggaccaatggtgcggcagcttgatagggctgaccgcaagagccacttgggcttcgaatatccaggtcgccattaaccaggtgcgccggctcatcggaaatgaaaactaccttgattacatgacatccatgaaaaggttcaagaatgaggacgatccagaaggtgcactgtggtga

SEQ ID NO: 13712 - RNA, 9879 nt, synthetic construct
  misc_feature 1..9879: note = derived and/or modified CDS sequence (opt3) from DENV-1__FJ882517__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagttctgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagagcaggacgcaaactttgtttgccgccgaacattcgtggatagaggctggggtaatgggtgtggactgtttggcaaaggctccttgataacttgcgctaagttcaagtgcgtaaccaaactcgaggggaagacagtgcagtacgaaaacctgaaatattcagtcattgtgaccgttcacactggagaccagcatcaagtgggtaatgagagtacggaacacggcacaaccgccactatcaccccccaggcgcctagcacagagattcagttaaccgactacggggccctgactctcgattgttctccaaggacaggacttgactttaacgaaatggtcctgttgacgatgaaggagaaatcctggctagtgcataagcagtggttcctggatctcccgctgccctggacctcaggcgcaagcactagtcaagagacatggaatcggaaagaccttctggtaacctttaagacagctcacgccaagaaacaggaagttgtggtcttgggttctcaggagggggctatgcacactgccctcaccggcgcaacggaaatccaaacctccggaacaactaccatcttcgccggccatctgaagtgccgtttaaaaatggataagctgacactaaaagggatgagctatgtgatgtgtactggatcgttcaagctcgagaaggaagtcgctgagacccagcacggtacggtgctggttcagattaaatacgagggcacagacgcgccttgcaagataccattttctacccaggatgaaaaaggggtgactcaaaacggacgccttatcacagcaaatcccattgtaaccgacaaggagaaacctgtcaacatcgaagccgagccacccttcggcgagtcctatatagtgattggtgctggggaagaggccttgaagctgtcatggtttaagaaaggcagtagcatcggaaagatgttcgaagcaactgccagaggcgctaggcggatggccatcctcggggataccgcatgggactttggatccattggtggcgttttcacatctgtggggaaactggtccatcagatctttggaacggcgtacggcgtgcttttcagcggtgtatcatggaccatgaagattgggataggcgtgctgttgacttggctcggactgaatagtcgatccacaagcttatctatgacctgtatcgctgttggcctggtcacactatacctcggggtgatggtgcaggccgattcaggatgcgtcattaactggaaaggccgcgagctgaagtgtggtagtgggatctttgttactaatgaagtgcacacctggacggagcagtataagttccaagcagacagcccgaaaagactttccgccgctatcggaaaggcctgggaggaaggcgtgtgcggtattaggtctgcaacacggttggagaacataatgtggaaacagatctcgaacgaactgaatcatattctcctggagaacgacatgaagtttaccgtagtcgtgggcgatgttgctgggatcttagcccagggaaaaaagatgattcgccctcagcccatggaatacaaatatagctggaagtcctggggcaaggcgaaaatcataggggccgacgtgcaaaatactaccttcatcattgatggaccaaacacacctgagtgtcccgacgatcagagagcttggaatatctgggaggtcgaagactacggctttggtattttcactaccaacatctggctgaagcttagggattcatatacacaggtgtgcgaccaccgtttgatgagtgcagccataaaagattctaaggctgttcacgccgacatggggtactggattgagagcgaaaaaaatgagacgtggaagctcgcacgggcgtccttcatcgaagtgaagacctgtatttggccaaaatcacatactctgtggagcaacggagtactagagtctgagatgatcatacccaagatctatggcggtcctatttcccagcacaattaccgaccaggctactttacacaaaccgccgggccgtggcatctgggaaaactcgaactggatttcgacctttgcgagggcactacagtcgtggtggatgaacactgcgggaacagaggacccagtttgaggaccacgactgtcaccggcaagatcattcacgagtggtgttgccgcagctgtacactgcctccattacggtttaaaggtgaggacgggtgctggtatggaatggaaatcagacccgttaaggagaaggaagagaatctcgtgaaatctatggtatccgctggctcaggtgaagtggacagtttcagcctgggccttctgtgtatatcgattatgatcgaggaggtcatgaggtcccgctggtctcgaaagatgttgatgaccgggactctcgccgtgtttttcctgctaatcatgggacagctgacatggaacgatctcattcggctgtgcatcatggttggcgcaaatgctagcgaccgtatggggatgggaaccacataccttgccttgatggtgacttttaaaatgagacctatgttcgcagtcggcctgttatttaggcgcctcacctcacgggaagtgctgcttctgacgattggtctaagtctcgttgcctccgtggagctgccaaactctttggaagagctgggggatggattagctatgggcataatgatcctcaagctgcttacagacttccagagccatcaactgtgggcgaccttgctctccctgacttttattaaaaccacattctcactacactatgcctggaagactatggcaatggtcctgagcatcgtaagtctttttcccctctgtctgtctaccacgtcccagaagacaacctggttgccggtgctgttaggcagcctcgggtgcaaacctctgactatgttccttattgctgaaaataagatctggggaagaaaatcgtggccactgaacgagggtataatggccgttggcatcgtgtcaattttgctctctagtctgctaaagaacgatgtccccctggccgggcctcttatcgctggaggcatgctcattgcatgttacgtgatctccggtagctctgccgacctgagcttggagaaagcggctgaagtatcctgggaggaagaggccgaacattcaggggcaagtcacaatatattagtggaggtccaggatgacggaacaatgaagattaaagatgaggaaagggacgataccctgactatcctcctgaaggccacacttctggctgttagcggcgtgtatcccttgtctatcccagcaaccctattcgtgtggtacttttggcagaagaaaaagcaacgatccggcgtcctgtgggacacgccttcacccccagaggtggaacgcgccgttctcgatgacgggatttatcggataatgcagagaggactgcttggtaggagtcaggtaggcgtgggggtcttccaggagaacgtgtttcatactatgtggcacgttacccgtggagcggtgttaatgtaccaaggcaaacgcctggagccgagctgggcttccgtcaagaaagacctcatctcttacggtgggggatggcggttgcagggctcgtggaatacaggcgaagaggtgcaggtaattgccgtcgaacctgggaagaaccccaagaatgtgcagaccgcaccaggaacattcaaaactagcgagggtgaagttggcgccatcgctctggattttaagcccgggacctcaggatcccctattgtgaacagagagggcaaaatcgtcggtctctatgggaatggagtggttacgacaagtggcacttacgtgtctgccatagcacaagctaaggccagccaggagggcccactgcccgaaatcgaggacgaagtcttcaggaaacgaaaccttaccattatggatctgcaccctgggtccggaaagacacggcgctatttgccggcgatcgtgagagaggccattaagaggaaactacggaccctgatcctcgcaccaactcgagtagtggcttcagaaatggccgaggctttaaagggtatgcccataagataccagaccacagcagttaaatctgagcatacgggcaaggaaattgtcgacctgatgtgccacgccacttttaccatgcgccttctgagccctgtgagggtgccaaattataacatgatcatcatggatgaggcccatttcacagaccccagttccattgctgcgcgtgggtacatcagcacccgggtcggaatgggcgaagcagccgctatatttatgactgccacacctccgggttctgtagaggcattcccccaatcaaatgccgtgattcaggatgaagagagagacatcccagagaggtcctggaacagtgggtatgaatggattaccgattttcctggaaaaacggtttggttcgtgcccagcatcaagtcgggcaatgacatagctaactgtctccgcaagaatggcaaacgagtcattcagttgtctagaaagactttcgatacagagtaccagaaaaccaagaacaacgactgggactacgtggttaccactgatatctccgaaatgggggcgaattttcgggccgacagggtgatcgatccacgccgttgcctgaaacctgtcattctcaaggacggacccgagagagtgatcctggcaggtccaatgccggtaacagtggctagcgccgcacaacggaggggccgcattgggcgaaaccacaataaggagggagatcagtatatatacatgggccagcctcttaacaatgacgaagatcatgcccactggaccgaggctaaaatgctactggacaacatcaatacacccgaaggtattatcccagccttgttcgagcccgaaagagagaagtcagcggcaatcgatggggagtatcggttaaggggcgaagcccgcaaaacttttgttgagctgatgagaaggggagacctccctgtctggctgagttacaaggtggcttctgaaggcttccagtattccgatcggcgttggtgctttgacggggagcgcaacaatcaagtgcttgaagagaacatggatgtcgagatttggacgaaagaaggagagcgaaagaaactgagaccaaggtggctcgacgcccggacctacagcgaccccttggctctgcgcgaattcaaggagtttgcagccggtagaaggtcagttagtggcgatctaatactggaaatcgggaagctccctcagcaccttacacagcgggctcagaatgccctggacaacttagtgatgttgcataatagcgagcaaggaggccgagcatatagacacgcgatggaggaactgccggatactattgagaccctcatgctgcttgccctgatcgctgtactcacaggtggggtgaccttgttctttctgtccggccgcggattaggcaaaacttctattgggctactgtgtgtcatggccagctccgtgctcctttggatggcatcagttgaaccacattggatcgctgcctctataatcctggagttctttttgatggtgctgctcattcccgagcctgacaggcagcggacgccccaggataaccagctggcatacgtcgtaatcggacttctcttcatgattctgaccgtggccgctaatgaaatgggtttgctggagacaactaagaaagacttaggcatcgggcacgttgcggtggaaaaccaccatcacgccgcaatgctagatgtcgacctgcatccagctagtgcctggaccctctacgccgtggcaacaaccataattactcctatgatgcgtcacacaatcgagaacacgaccgctaatatttcgcttactgccatcgcgaaccaagctgccatactgatgggattggataagggctggcccatcagcaaaatggacattggtgtcccactgctcgcactggggtgctattcccaggtgaatcctcttacattaaccgccgctgttctgatgctcgtggcacattacgccatcattggcccgggattgcaggcgaaggctaccagagaagcccaaaagaggacagcagccggcatcatgaaaaaccccactgtagatgggatagtggctattgacctggatccagtcgtttatgacacgaagtttgagaaacagctaggacagatcatgctgctcatcctttgtacctctcagattctgttgatgcgcacaacttgggccctgtgcgagtcaatcaccctcgcaacaggccctctgaccactttatgggaaggtagccccgggaagttctggaatacgacaatagctgtgtccatggccaacattttccggggaagttaccttgcgggcgccggtctggcattttctctcatgaaaagcctaggcgggggacgaagaggcaccggggctcaaggagagactctgggcgaaaagtggaagaggcagttgaatcagctgtcaaaatccgagttcaacacctataagcgcagtggtatcatggaagtcgaccggagcgaggccaaagaggggctcaagagaggagaaacaactaaacacgcagtgtctcgtggcaccgctaagcttaggtggtttgtagagcggaatctggtgaagccagaaggtaaagttattgatttgggctgtgggcgcggaggctggtcctactattgcgccgggctgaagaaagtgacagaggtcaagggatacacgaaaggcggtcctgggcacgaagagcccatcccgatggccacctacggatggaacctcgtgaagttacattcaggcaaagacgtcttctttataccacctgagaagtgtgatactctgctttgcgacatcggcgaaagctcgcccaatccaacaattgaggaagggcgaaccctgagagtgctaaagatggttgagccctggctcaggggaaaccagttctgtatcaaaattctgaatccttatatgccgtctgtagtggagactttggaacaaatgcagcggaagcacggtggcatgctggtccgcaaccccctcagtagaaattccacacatgagatgtactgggtgagctgcgggaccggaaacatcgtttcagcggtgaatatgacgtccaggatgcttctgaaccgatttaccatggctcaccggaaaccaacatatgaacgtgatgtcgacttaggcgcaggtactagacacgtggccgtagagcctgaagtggctaacctggatattatcgggcagcgcatagagaatattaagcatgagcacaaatctacctggcattacgacgaagataacccctataagacatgggcctaccacggaagctatgaggttaagcctagtggctccgcaagctctatggtcaatggcgtggtgaaattgctcactaagccatgggacgtcatccccatggttacccagatcgccatgacagataccactcctttcgggcaacagagggtgtttaaagaaaaggtagacacgcggacaccaaaagctaagagaggaaccgcgcagattatggaggtgactgccaagtggctgtggggtttcctatcacgcaacaaaaagcccaggatatgtacccgagaagagtttacacggaaagtcagaagtaatgcagctatcggcgccgtgttcgttgacgagaaccaatggaattccgcaaaggaagccgtggaggatgaaaggttttgggaccttgtccatcgcgagcgtgaactgcacaaacaggggaagtgcgctacgtgcgtgtacaacatgatgggaaagcgggagaaaaagctcggcgagttcggtaaagccaaggggagcagagcgatttggtacatgtggctgggagcaaggttcttggaatttgaggccctgggcttcatgaatgaagatcactggttttctcgcgagaactcgctctcaggcgtagagggggaaggacttcataaactgggttatatcttacgagacattagcaagatcccgggcgggaatatgtacgctgatgacaccgccggatgggatactcggataacagaggacgatctgcagaacgaagcaaaaatcaccgacattatggagcctgaacacgctttgctcgccaagtccatcttcaagctgacttatcagaataaagttgtgagagtccaaaggccagctaagaacggcacagtgatggatgtgattagtcgcagagaccagcggggttctgggcaggtcggaacctacggcctaaatacatttactaacatggaggcccagcttatcaggcaaatggagagcgaaggcatattctccccctcagagctggaaacccctaacctcgcagggcgtgttctggattggttggagaaacatggagtggaacgattaaagcgcatggcgattagtggtgacgactgtgtagtgaaaccaatcgatgacagatttgccacggctctgaccgccctcaatgatatgggcaaggtccggaaggacatcccccagtgggagccgtctaaagggtggaacgattggcagcaggtgcctttctgcagccaccactttcatcaacttattatgaaggacggaagggagatagttgtgccctgtcgcaatcaggatgaactggtcggcagagcacgggtgtcccagggtgctgggtggtcactaagggagacagcctgcctgggaaaaagctatgcacagatgtggcaactcatgtacttccaccgacgtgacttgagactggccgcgaacgctatctgttctgccgtaccagttgattgggtgcctacttcccgcaccacatggagtattcatgcacaccatcagtggatgactaccgaagacatgcttagcgtctggaatcgggtgtggatcgaggaaaacccctggatggaggataagacgcacatttcgtcctggggcgacgttccatatctgggcaaaagggaggaccagtggtgcgggtctctcatcggattaacagccagagctacctgggccactaatatacaagtggcaatcaaccaggtccgccggctgattggtaatgaaaactacttggattacatgacatcaatgaagaggtttaagaatgagagcgaccccgaaggcgctctgtggtga

SEQ ID NO: 13713 - RNA, 9879 nt, synthetic construct
  misc_feature 1..9879: note = derived and/or modified CDS sequence (opt3) from DENV-1__JQ287661__SS-prME
  source 1..9879: mol_type = other RNA
agcgtgaccatgctgctcatgcttatgcccaccgccctggctttccacttgactacgagaggaggggagcctcatatgatcgtcaccaagcaggaaaggggaaaatccttactgtttaagacatctgccggtgttaatatgtgcactttaattgccatggacctcggcgagctgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggatcgttcaaactggagaaggaagtggctgagacccagcacggtacggtccttgtgcagataaagtacgagggcacagacgcgccttgcaaaatcccattctcgacccaagatgaaaagggggttactcagaacggacgcttgattacagcaaatcccatcgtgaccgacaaagagaagcctgtaaacatagaagccgagccaccctttggcgagtcttatattgtcatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtgtttacatccattgggaaacttgttcatcagatattcggaacggcgtacggcgtgctgttttctggtgtcagctggaccatgaagatcgggattggcgtgttgctcacttggctgggattaaattcacgaagtacatccctgagcatgacctgtatcgctgtaggcctagtgacactctacctgggggttatggtccaggccgattctggatgcgtgatcaactggaaaggccgcgaacttaagtgtggttcagggattttcgtgactaatgaggtccacacctggacggaacaatataagtttcaggcagacagtccgaaaagattgagcgccgctataggaaaggcctgggaggagggcgtttgcggtatcaggtccgcaacacggctggaaaacgtgatgtggaaacagatttctaacgagctcaatcatatcctgttagaaaacgacatgaagttcaccgtggtagtcggcgatgtggttgggattctggctcagggcaagaagatgatccgccctcaacccatggagcacaaatactcgtggaaaagctggggcaaggccaaaataatcggggcggacgtgcagaatactacctttattatcgatggaccaaacacacctgaatgtcccgacgatcagagagcctggaatatttgggaggtcgaggactatggcttcggtatctttactaccaacatatggcttaagatgagggattcctacacacaggtgtgcgaccaccgtttgatgtcagctgcaattaaagatagtaaggccgttcatgctgacatggggtattggatcgaatctgagaaaaatgaaacgtggaagctcgcccgggcatccttcattgaggtgaagacctgtatctggccaaaatcccacactctgtggtcaaacggagtactagaaagcgagatgataatccccaagatttacggcggtcctatctctcaacataattatcgaccaggctacttcacacagaccgcggggccgtggcacctgggaaaactcgagctggattttgacctttgcgaaggcactacagtcgtggtggatgagcactgcgggaacagaggaccctccttgaggaccacgactgtcaccggcaagattatccatgaatggtgttgccgcagttgtacactgcctccattacggttcaaaggtgaggacgggtgctggtacggaatggagataagacccgttaaggaaaaggaggaaaatctcgtgaaaagcatggtatctgccggctccggtgaggtggactcatttagtctgggccttctgtgtattagcatcatgatcgaagaggtcatgaggtcgcgctggtcccgaaagatgttgatgaccgggactctcgctgtgttcctgctactgattatgggacagctcacatggaacgatctgatccggctttgcattatggttggcgccaatgcatctgaccgtatggggatgggaaccacatatttggctctgatggccacttttaaaatgagacctatgttcgcagtgggcttactctttaggcgcctgaccagccgggaggtccttctgctaacgataggtctctcactggtggccagtgttgaattgccaaactccctggaggaattaggggatggactcgctatgggcatcatgattctgaaacttctgacagacttccaatctcaccagttgtgggcgaccctcctgagcctaacttttatcaaaaccacactgtcccttcattacgcctggaagactatggcaatggtgctctcaattgtcagcctgatccccttgtgtctgagtaccacgtctcagaagacaacctggttaccggtactcctgggctcccttgggtgcaaacctctgactatgttcttgatagctgagaataagatctggggaagaaaaagctggccactcaacgaaggtattatggccgtgggcgttgtgtcgatcctgctatcatctctgcttaagaacgatgtccccctcgccgggcctctgattgctggaggcatgttgatcgcatgttatgtgataagtggttccagcgccgacttatctctggagaaagcggctgaggtaagctgggaagaggaagccgagcactccggggcatcacataatattctcgtggaagtccaggatgacggaacaatgaagatcaaagatgaggagagggacgataccctgactatccttctgaaggccacattgctagctgttagtggcgtgtaccccctgagcattccagcaaccctctttgtgtggtatttctggcaaaagaaaaagcagcgatctggcgtcctgtgggacacgccttcacccccagaagtggagcgcgccgttcttgatgacgggatataccggatcatgcagagaggattactgggtaggagccaggtaggcgtgggggtctttcaagaaaacgtgttccacactatgtggcacgttacccgtggagcggtgctcatgtatcagggcaaacgcttggagccgagttgggctagcgtcaagaaagacctgatttcctacggtgggggatggcggctccagggctcttggaatacaggcgaggaagtgcaggtaatcgccgtcgagcctgggaagaaccccaagaatgtgcaaaccgcaccaggaacattcaaaactcccgaaggtgaggttggcgccattgctctggattttaagcctgggacctcgggaagcccaatcgtgaacagagaaggcaaaatagtcggtctttacgggaatggagtggttacgacatcaggcacttatgtgtccgccatcgcacaggctaaggccagtcaggagggccccctgcctgagattgaagacgaggtcttcaggaaacgaaacttgaccatcatggatctacatccggggtctggaaagacacggcgctacctgccagcgattgtgagagaagccatcaagaggaaactccggaccttaatactggcacccactcgagtagtggctagcgagatggccgaagctcttaagggtatgcctattagatatcaaaccacagcagttaaatccgagcacacgggcaaggagatcgtcgacctgatgtgccatgccacttttaccatgcgcctcttgtcaccagtgagggtgcccaattacaacatgatcattatggatgaagcccacttcacagacccttctagcatcgctgcgcgtgggtatataagtacccgggtcggaatgggcgaggcagccgctatttttatgactgccacaccgcccggttccgtagaagcattcccacagagcaatgccgtgatccaggatgaggaaagagacattcctgagaggtcttggaactcagggtacgagtggatcaccgattttcccggaaaaacggtttggttcgtgccatccataaagagtggcaatgacattgctaactgtctgcgcaagaatggcaaacgagtcatccagctcagcagaaagacttttgatacagaatatcagaagaccaagaacaacgactgggactacgtggttaccactgatatctcggagatgggggcgaatttccgggccgacagggtgattgatcctcgccgttgcctgaaacccgtcatccttaaggacggaccagaaagagtgattctagcaggtccgatgcctgtaacagtggcttctgccgcacagcggaggggccgcatagggcgaaaccataataaggagggagatcagtacatctatatgggccagcccctgaacaatgacgaggatcacgcccactggaccgaagctaaaatgttgttagacaacattaatacaccagagggtatcatccccgccctgtttgaacctgagagagaaaagtccgcggcaattgatggggagtaccggctcaggggcgaggcccgcaaaactttcgttgaactgatgagaaggggagaccttccagtctggctgagctataaggtggcttcagagggcttccaatacagtgatcggcgttggtgctttgacggggaacgcaacaatcaggtgctcgaggaaaacatggatgtcgagatatggacgaaagagggagaacgaaagaaattgagacccaggtggctggacgcccggacctattctgaccctctagctctgcgcgagttcaaggaatttgcagccggtagaaggtccgttagcggcgatctcatccttgagattgggaagctgccgcagcatttaacacagcgggctcaaaatgccttggacaacctggtgatgctccacaattcagaacagggaggccgagcatacagacatgcgatggaggagctgccagatactatcgaaacccttatgctgctcgccttgattgctgtactgacaggtggggtgaccttattctttctaagtggccgcggactgggcaaaactagcatcgggctcctttgtgtcatggcctcctctgtgctgttgtggatggcaagcgttgagccccactggatagctgcctccatcattctggagttctttctcatggtgctgcttatccctgagcccgacaggcagcggacgccacaggataaccaactcgcatatgtcgtaattggactgttgttcatgatcctgaccgtggccgctaatgagatgggtttactagaaacaactaagaaagacctgggcatagggcacgttgcggtggagaaccatcaccatgccaccatgctcgatgtcgaccttcaccctgcatcagcttggacactgtacgccgtggccaccactattatcacacccatgatgcgtcatacgattgaaaacaccactgcaaatatctctttgacagctatagccaaccaggcggctatcctgatgggactcgataagggctggccaattagtaaaatggacatcggtgtccctctgcttgccttagggtgctacagccaggtgaatccgctgaccctcaccgcagccgttttgatgctggtggctcactatgcaattatcggccccggactacaagccaaggcgacaagagaggctcagaagaggactgccgcaggcataatgaaaaacccaacggtagatgggattgtggccatcgacctggatcctgtcgtttacgacgctaagtttgaaaaacagctcggacagatcatgcttctgattttgtgtaccagccaaatcctgctcatgcgcacaacttgggccctgtgcgagtccataaccttagcaacaggcccccttaccactctgtgggagggttctccagggaagttctggaatacgacaattgctgtgtcaatggccaacatctttcggggaagctatctcgcgggcgccggtctagcattctccctgatgaaaagtttgggcgggggacgaagaggcaccggggctcagggagaaactctgggcgagaagtggaagaggcagctcaatcagctttctaaaagcgaatttaacatttacaagcgctcaggtatcatggaggtcgaccggtccgaagccaaagaggggctgaagagaggagagaccacacgtcacgcagtgagtaggggcactgctaaattgcggtggttcgtagaacgcaatctggtgaagcctgagggtaaggttatagatctcggctgtgggcgaggaggctggagctattactgcgccgggctaaagaaggtgaccgaagtcaaaggatatacaaagggcggtcccgggcatgaggaaccgatcccaatggccacgtacggatggaacctggtgaaacttcactctggcaaggacgtcttctttacccctcccgagaaatgtgatactctgctatgcgacattggcgagtcctcaccaaatcccacaatcgaagaggggagaaccctcagggtgctgaagatggttgaaccttggttgcggggaaaccaattctgtattaagatcctgaatccgtacatgcccagcgtagtggagactctcgagcagatgcagcgcaaacatggtggcatgcttgtcagaaacccactgtcgagaaattctacacacgaaatgtattgggtgagttgcgggaccggaaacattgtttccgcggtgaatatgacgagccgaatgttactgaaccggtttaccatggctcaccgtaagcctacatacgagaaagatgtcgacttgggcgcaggtactagacatgtggccgtagaacccgaggtggctaacctcgatatcatagggcagcgcattgaaaatatcaagcacgagcataaatcaacctggcactatgacgaggataacccttacaagacatgggcctatcatggatcctacgaagttaagccatctggcagcgcaagttccatggtcaatggcgtggtgaaactgctaactaagccctgggacgtcatccctatggttacccaaattgccatgacagataccactccattcgggcagcagagggtgtttaaagagaaggtagacacgcggacacccaaagctaagagaggaaccgtgcaaataatggaagtcactgcgcgctggctttggggtttcctgagcaggaacaagaaaccgcgaatctgtacccgggaggaatttacaagaaaggtgaggtctaatgccgcaattggcgctgttttcgtggacgagaaccagtggaactcagccaaagaggcagtcgaagatgagcgcttttgggacctcgtgaagaaagaacgtgagctgcacaagcaggggaagtgcgccacgtgcgtatataacatgatgggaaaacgggaaaagaaattgggcgagttcggtaaggctaaagggagtagagccatctggtacatgtggctgggagcgaggtttctcgagttcgaagcacttggctttatgaatgaggatcactggttctcccgcgaaaacagcctgtctggcgttgagggggagggattacataagctgggttacattttgcgagacatctcgaaaatacctggcgggaatatgtatgccgatgacaccgctggatgggatactcggatcacagaagacgatctccagaacgaggccaagattaccgacatcatggaaccagagcacgcactgctagctacttcaattttcaaacttacataccaaaataaagtggtcagagtgcagaggcccgccaagaacggcaccgtgatggatgtcatcagccgcagagaccagcggggttccgggcaggttggaacatatggcctgaatacttttaccaacatggaagctcaactcataaggcagatggagagtgagggcattttcctgccttctgaattggagacgccaaacttagccgaacgtgtgctggattggctcgagaaatacggggtagaacgacttaagcgcatggcaatcagcggagacgactgtgtggtcaaacccatcgatgacagatttgcgaccgccctgacagctctaaatgatatgggtaaggtgcggaaggacattccgcagtgggagccttccaaaggctggaacgattggcagcaagttcccttctgctcacatcactttcaccagctgataatgaaggacgggagggagatcgtggtcccatgtcgcaatcaggatgaactcgtgggaagggcacgggtaagtcagggcgcaggttggtctttgagggagactgcttgcctggggaaaagctatgcccaaatgtggcagcttatgtacttccatcgacgtgacctgagactcgcagccaacgcgatttgttccgctgttcctgtggattgggtccccacctcacgcacaacttggagcatccacgcccatcaccagtggatgaccacggaagacatgttatctgtgtggaatcgggtttggattgaggaaaacccatggatggaggataagacacatgtgtccagttggggagacgtcccctatctgggcaaaagggaggaccaatggtgcggcagcttgatcgggctgaccgcaagagccacttgggcttcgaatatacaggtggccatcaaccaggtacgccggctcattggaaatgaaaactaccttgattacatgacatccatgaagaggtttaagaatgagggtgaccctgaaggcgcactgtggtga

SEQ ID NO: 13714 - RNA, 9879 nt, synthetic construct
  misc_feature 1..9879: note = derived and/or modified CDS sequence (opt3) from DENV-1__FJ882518__SS-prME
  source 1..9879: mol_type = other RNA
agcgtgaccatgctgctcatgcttatgcccaccgcactggctttccacttgactacgagaggaggggagcctcatatgatcgtcaccaagcaggaaaggggaaaatccttactgtttaagacatctgccggtgttaacatgtgcactctaattgccatggacctcggagagctgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaggaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggcagcttcaaactggagaaggaagtggctgagacccagcacggtacggtccttgtgcagataaagtacgagggcacagacgcgccttgcaaaatcccattctcgacccaagatgaaaagggggttactcagaacggacgcttgattacagcaaatcccatcgtgaccgacaaagagaagcctgtaaacatagaagccgagccaccctttggcgagtcttatattgtcatcggtgctggggaaaaagccctgaagctctcctggttcaagaaaggctcaagtatcggaaagatgtttgaggcaactgccagaggcgctaggcggatggccattctgggggataccgcatgggacttcggaagcgtgggtggcgtttttacatccgtggggaaacttgtccatcagatcttcggaacggcgtacggcgtgctgttttctggtgtaagctggaccatgaagattgggataggcgtgttgctcacttggctgggattaaattcacgaagtacatccctgagcatgacctgtatcgctgttggcctagtcacactctacctgggggtgatggtgcaggccgattctggatgcgtcattaactggaaaggccgcgaacttaagtgtggttcagggatcttcgttactaatgaggtgcacacctggacggaacaatataagtttcaggcagacagtccgaaaagattgagcgccgctatcggaaaggcctgggaggagggcgtgtgcggtattaggtccgcaacacggctggaaaacataatgtggaaacagatctctaacgagctcaatcatattctgttagaaaacgacatgaagttcaccgtagtcgtgggcgatgttgtggggatcctggctcagggcaaaaagatgattcgccctcaacccatggagcacaaatactcgtggaaaagctggggcaaggccaagatcataggggcggacgtccagaatactacctttatcattgatggaccatccacacctgaatgtcccgacgatcagagagcctggaacatctgggaggtggaggactatggcttcggtatttttactaccaatatctggcttaagttgagggattcatacacacaggtttgcgaccaccgtctcatgagtgctgcaataaaagattctaaggccgtgcatgctgacatggggtattggattgaaagcgagaaaaacgaaacgtggaagctggcccgggcatccttcatcgaggtaaagacctgtatttggccaaaatcacacactctatggagcaatggagtcctggaatctgagatgatcatacccaagatctacggcggtcctatttcccaacataactatcgaccaggctacttcacacagaccgcggggccgtggcacctcggaaaactggagcttgattttgacttgtgcgaaggcactacagtggtggtcgatgagcactgcgggaatagaggacccagtctgaggaccacgactgttaccggcaagatcattcatgaatggtgttgccgcagctgtacattacctccactccggttcaaaggtgaggacgggtgctggtacggaatggagatcagacccgtgaaggaaaaggaggaaaacctggtaaaatctatggtgtccgccggctcaggtgaggtcgacagttttagccttggcctgttgtgtatatcgattatgatcgaagaggtgatgaggtcccgctggtctcgaaagatgctcatgaccgggactctggctgttttcctactgctcatcatgggacagctgacatggaatgatcttattcggttgtgcatcatggtgggcgccaacgcaagcgaccgtatggggatgggaaccacatatctggctttaatggccacttttaaaatgagacctatgttcgcagtcggcctcctgtttaggcgccttacctcacgggaggtgctgctactcacgattggtctgagtttggttgcctccgtggaactgccaaattctttagaggaactcggggatggactggctatgggcataatgatccttaagctgttgacagacttccaaagccaccagctctgggcgaccctgctatccctgacttttattaaaaccacactttcactccattacgcctggaagactatggcaatggtcctgagcatcgctagtttgttccccctgtgtttatctaccacgtcccagaagacaacctggctcccggtactgcttggcagcctggggtgcaaacctttgactatgtttctcattacagagaccaagatctggggaagaaaatcgtggccactgaacgaaggtataatggccgtgggcgttgtgtcaatcctactgtctagtcttctcaagaatgatgtccccctggccgggcctttgattgctggaggcatgttaatcgcatgttatgtgatttccggtagctctgccgacctgagcctcgagaaagcggctgaggtatcctgggaagaggaagccgagcactcaggggcaagtcataacatcctggtggtcgttcaggatgacggaactatgaagataaaagatgaagagagggacgatacacttaccattctgttgaaggccacgctactggctgtgagcggcgtgtaccccctctctatcccagcaactctgttcgtctggtatttttggcaaaagaaaaagcagcgatccggcgtgctttgggacaccccttcacccccagaggttgaacgcgccgtattagatgacgggatctaccggattatgcagagaggactgctcggtaggagtcaggtgggcgtcggggtgttccaagagaacgttttccacacaatgtggcacgtgacccgtggagcggtcttgatgtatcagggcaaacgcctggaaccgagctgggcttccgtgaagaaagacctcatatcttacggtgggggatggcggctgcagggctcgtggaatacaggcgaggaggtacaggtcatcgccgtggaacctgggaagaaccccaagaatgttcaaactgcaccaggaacctttaaaacgcccgagggtgaagtgggcgccattgctcttgatttcaagcctgggacaagcggatcaccaatcgtcaacagagagggcaaaattgtgggtctgtacgggaatggagttgtgactacctccggcacatatgtcagtgccatcgcacaggctaaggcctctcaggaaggccccttgcctgagatagaggacgaagtgtttaggaaacgaaacctaaccatcatggatctgcatccggggagcggaaagactcggcgctacctcccagcgattgtaagagaggccatcaagaggaaattacggaccctgattcttgcacccacacgagtggttgcttccgaaatggccgaggctctgaagggtatgcctatcagatatcaaacgactgcagtcaaatcagaacacaccggcaaggagatagtggacctcatgtgccatgccacattcaccatgcgcttgctgtctccagtgagggtccccaattacaacatgattatcatggatgaggcccactttactgaccctagcagtatcgctgcgcgtgggtatatttccacacgggtaggaatgggcgaagcagccgctatcttcatgaccgccacgccgcccggtagcgtggaggcatttccacagtctaatgccgttatacaggatgaagagagagacattcctgaaaggtcatggaactccgggtacgagtggatcactgatttccccggaaaaacagtgtggtttgtcccaagtattaagagcggcaatgacatcgctaactgtctccgcaagaatggcaaacgagtgatacagctgtcgagaaagaccttcgataccgagtatcagaaaactaagaacaatgactgggactacgttgtgacaaccgatatttctgaaatgggggcgaactttcgggccgacagggtcatcgatcctcgccgttgccttaaacccgtgatcctaaaggacggaccagagagagtaattctggcaggtccgatgcctgtgacagttgcttccgccgcacagcggaggggccgcatcgggcgaaaccataataaggaaggagatcagtacatttatatgggccagcccttgaacaatgacgaggatcacgcccactggactgaggctaaaatgttactggacaacataaatacgccagaaggtatcattcccgccctcttcgagcctgaaagagaaaagagcgcggcaatcgatggggaataccggctgaggggcgaggcccgcaaaaccttcgtcgagcttatgagaaggggagacctgccagtgtggctctcatataaggtggctagtgaaggctttcaatactctgatcggcgttggtgcttcgacggggagcgcaacaatcaggtcttggaagagaacatggatgttgaaatctggacaaaagagggagagcgaaagaaactgagacccaggtggctagacgcccggacttattccgaccctctggctctccgcgaatttaaggagttcgcagccggtagaaggagcgtgtcaggcgatcttattctggaaatagggaagttaccgcagcatttgacccagcgggctcaaaatgccctggacaacctcgtaatgctgcacaatagtgagcagggaggccgagcatacagacatgcgatggaggaacttccagatacaatcgagaccctgatgctcttggccctgattgctgtgttaactggtggggtcacgctatttttcctgagcggccgcggactcggcaaaacctccatcgggcttctgtgtgtgatggcctctagcgttttgctgtggatggcatccgtggaaccccactggattgctgcctcaatcatactcgagtttttcctgatggtccttctcatccctgaacccgacaggcagcggacaccacaggataaccaactggcatatgtagtgattggattgctgtttatgatcttaactgttgccgctaatgagatgggtctactggagaccacaaagaaagacctcggcattgggcacgtggcggtcgaaaaccatcaccatgccaccatgcttgatgtggacctgcaccctgcatctgcttggactttgtacgccgtcgccacaacgatcataacccccatgatgcgtcatactattgagaatacaaccgcaaacatcagtctgaccgctattgccaaccaggcggctatcctcatgggactggataagggctggccaatatcgaaaatggacatcggtgtgcctcttttagccctggggtgctacagccaggttaatccgctcacattgactgcagccgtgctgatgctagtagctcactatgcaattatcggccccggactgcaagccaaggcgacgagagaagctcagaagaggaccgccgcaggcattatgaaaaacccaacagtggatgggatcgtcgccatagacctcgatcctgttgtgtacgacgctaagttcgagaaacagcttggacagattatgctgttgatcctgtgtacttcccaaatcctcctgatgcgcaccacatgggccttatgcgaatctattacccttgcaactggccccctgacgacactctgggagggttcaccagggaagttttggaataccactatcgctgtcagcatggccaacatattccggggatcctatctagcgggcgccggtctggcatttagtttgatgaaatctctgggcgggggacgaagaggcaccggggctcagggagagacactcggcgaaaagtggaagaggcagcttaatcagctgagcaaatcagagttcaacatttacaagcgctccggtatcatggaagtggaccggagtgaggccaaagaagggttgaagagaggagagactacccgtcacgcagtaagcaggggcacagctaaactgcggtggttcgtggagcgcaatctcgttaagcctgaaggtaaggtgattgatttaggctgtgggcgaggaggctggtcttattactgcgccgggctgaaaaaggtcacggaggtgaaaggatataccaagggcggtcccgggcatgaggagccgatcccaatggccacttacggatggaaccttgtcaaactgcactccggcaaggacgtgtttttcacacctcccgaaaaatgtgataccctactctgcgacataggcgagtcaagcccaaatcccactatcgaggaagggagaacactgagggttttgaagatggtagagccttggctgcggggaaaccaattttgtattaagatcctcaatccgtacatgccctcggtggtcgaaacccttgagcagatgcagcgcaaacatggtggcatgctggtgagaaacccattatctaggaatagtacgcacgagatgtattgggtttcctgcgggaccggaaacattgtgagcgcggtcaatatgacatcacgaatgctgttgaaccggttcactatggctcaccgtaagcctacctacgaaagagatgtggacctcggcgcaggtacacgccatgtagccgtggagcccgaagttgctaatctggatatcattgggcagaggatcgagaacataaaacacgaacataagtccacttggcactatgacgaggataacccttacaaaacctgggcctatcatggatcttacgaggtcaagccaagcggcagtgcatccagcatggtgaatggcgtggtcaagctacttacaaaaccctgggacgttattcctatggtgacccaaatcgccatgactgatacgacaccatttgggcagcagcgggtattcaaggaaaaagtggacaccagaactcccaaggctaaacgcggaaccgcgcaaatcatggaggtcacagccaggtggctgtggggttttctctctcgaaacaagaagccgcggatttgtacgagagaagagttcaccaggaaagtgcgctcaaatgcagctataggcgccgtttttgtggacgaaaaccagtggaatagtgcaaaggaggccgtcgaggatgaacgtttctgggacctggtgcagaaagagcgggaattgcacaagcaggggaaatgcgctacttgcgtatataacatgatgggaaagagagagaagaaactgggcgaatttggtaaggccaaagggtccagggcgatctggtacatgtggctcggagcacgcttccttgagtttgaggccctgggcttcatgaatgaagatcactggttcagccgagagaactctttatcgggcgttgaaggggagggactgcataagttgggttacattctccgggacatctcaaaaattcctggcgggaatatgtatgctgatgacacagccggatgggataccagaatcactgaggacgatctgcaaaacgaagcaaagataacagacatcatggagccagaacacgctctacttgccaccagcatttttaaactgacataccagaataaggtggtcagggtgcagcgccccgctaagaacggcactgtgatggatgtcatctccagacgggaccagaggggtagtgggcaagttggaacctatggcctcaatacgttcaccaacatggaggcccagctgattcgtcagatggaatctgagggcatctttttgcctagcgagttagaaacaccaaatctggcagagcgagtgctcgattggcttgaaaaatacggggtagagcgcctgaagagaatggcgatatccggagacgactgtgtggtcaaacccattgatgaccggttcgccactgctctaaccgccctgaacgatatgggtaaggtgaggaaagacatcccgcagtgggaaccttcaaagggctggaacgattggcaacaggttcccttttgcagtcatcacttccaccagctcatcatgaaggacgggcgcgagattgtggtcccatgtagaaatcaggatgagttggtgggacgggcaagggtatctcaaggcgctggttggagcctgcgagaaacagcctgccttgggaaatcctatgcacagatgtggcagctgatgtactttcatcgtagagacctccgcttagccgcgaacgctatatgttcagccgttcctgtggattgggtccccactagccggaccacgtggtctatccacgcacatcaccaatggatgacaaccgaggacatgctgtccgtgtggaatagggtttggattgaagagaacccatggatggaagataagactcatgtgagtagctggggagacgtcccctatttgggcaaaagagaggaccagtggtgcggctcgctgatcgggctcacagcccgcgctacctgggcctccaatattcaggtggcaatcaaccaggtacggaggcttataggaaatgagaactacctggattacatgacttctatgaagcgattcaaaaatgaaggtgaccctgagggcgctctatggtga

SEQ ID NO: 13715 - RNA, 9879 nt, synthetic construct
  misc_feature 1..9879: note = derived and/or modified CDS sequence (opt3) from DENV-1__FJ882519__SS-prME
  source 1..9879: mol_type = other RNA
agcgtgacaatgctgctaatgcttatgcccacagcactggctttccacttgactacgcgaggcggggaacctcatatgatcgtctccaagcaggaaagggggaaatctttactgtttaagacatcagccggtgttaacatgtgcacactaattgccatggacctcggcgagttctgtgaagatactatgacctacaaatgcccacggataacagaagcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagggatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaagacgcaaactttgtttgccgccgaacattcgtggatagaggctggggtaatgggtgtggactgtttggcaaaggctccttgataacttgcgctaagttcaagtgcgtaaccaaactcgaggggaagattgtgcagtacgaaaacctgaaatattcagtcatcgtgacagttcacaccggagaccagcatcaagtgggtaatgagagtactgaacacggcacgacagccaccattactccccaggcgcctagcaccgagatccagttaacagactacggggccctgaccctcgattgttctccaaggactggacttgactttaacgaaatggtcctgttgacaatgaaggagaaatcctggctagtgcataagcagtggttcctggatctcccgctgccctggacgtcaggcgcaagcaccagtcaagagacttggaatcggaaagaccttctggtaacatttaagaccgctcacgccaagaaacaggaagttgtggtcttgggttctcaggagggggctatgcacacagccctcactggcgcaaccgaaatccaaacgtccggaaccacaactattttcgccggccatctgaagtgccgtttaaaaatggataagctgaccctaaaagggatgagctatgtgatgtgtacaggatcgttcaagctcgagaaggaagtcgctgagactcagcacggtaccgtgctggttcagataaaatacgagggcacggacgcgccttgcaagatcccattttctacacaggatgaaaaaggggtgacccaaaacggacgccttattactgcaaatcccatcgtaacagacaaggagaaacctgtcaacatagaagccgagccacccttcggcgagtcctatattgtgatcggtgctggggaaaaggccttgaagctgtcatggtttaaaaagggcagtagcatcggaaaaatgttcgaggcaaccgccagaggcgctaggcggatggccattctcggggatactgcatgggactttggatccatcggtggcgttttcacctctgtggggaagctggtccatcagatttttggaacagcgtacggcgtgcttttcagcggtgtatcatggacgatgaaaatagggatcggcgtgctgttgacctggctcggactgaatagtcgatccactagcttatctatgacatgtattgctgttggcctggtcaccctatacctcggggtgatggtgcaggccgattcaggatgcgtcatcaactggaagggccgcgaactgaagtgtggtagtgggatctttgttacaaatgaggtgcacacttggaccgaacagtataaattccaagcagacagcccgaagagactttccgccgctattggaaaagcctgggaggagggcgtgtgcggtataaggtctgcaacgcggttggaaaacatcatgtggaagcagatttcgaacgagctgaatcatatcctcctggaaaacgacatgaaatttacagtagtcgtgggcgatgttgctgggattttagcccagggaaagaaaatgatccgccctcagcccatggagtacaagtatagctggaagtcctggggcaaagcgaagataatcggggccgacgtgcaaaataccactttcattatcgatggaccaaacacccctgaatgtcccgacgatcagagagcttggaatatttgggaggtcgaggactacggctttggtatcttcacaactaacatatggctgaaacttagggattcatatacccaggtgtgcgaccaccgtttgatgagtgcagccattaaggattctaaagctgttcacgccgacatggggtactggatcgaaagcgagaagaatgaaacatggaagctcgcacgggcgtccttcattgaggtgaaaacgtgtatctggccaaagtcacataccctgtggagcaacggagtactagaatctgagatgataatccccaaaatttatggcggtcctatctcccagcacaattaccgaccaggctactttactcaaacagccgggccgtggcatctgggaaagctcgagctggatttcgacctttgcgaaggcaccactgtcgtggtggatgagcactgcgggaacagaggacccagtttgaggacaaccacggtcactggcaaaattatccacgaatggtgttgccgcagctgtaccctgcctccattacggtttaagggtgaggacgggtgctggtatggaatggagataagacccgttaaggaaaaagaggaaaatctcgtgaagtctatggtatccgctggctcaggtgaggtggacagtttcagcctgggccttctgtgtatttcgatcatgatcgaagaggtcatgaggtcccgctggtctcgaaaaatgttgatgacagggaccctcgccgtgtttttcctgctaattatgggacagctgacttggaacgatctcatccggctgtgcattatggttggcgcaaatgctagcgaccgtatggggatgggaacaacctaccttgccttgatggcaacatttaagatgagacctatgttcgccgtgggcctgttatttaggcgcctcacttcacgggaggtcctgcttctgaccataggtctaagtctcgtggcttccgttgaactgccaaactctttggaggaactgggggatggattagcgatgggcatcatgattctcaaactgcttacggacttccagagccatcaactgtgggccacattgctctccctgacctttatcaagactaccttctcactacactatgcatggaagacaatggctatggtgctgagcattgtcagtctttttcccctctgtctgtctactacctcccagaaaacgacatggttgccggtactgttaggcagcctcgggtgcaagcctctgaccatgttccttatcgccgagaataaaatatggggaagaaagtcgtggccactgaacgaaggtatcatggccgtgggcattgtttcaatcttgctctctagtctgctcaagaatgatgtgcccctggctgggcctcttattgcaggaggcatgctcatcgcctgttacgtcatatccggtagctctgcggacctgagcttggagaaggctgccgaggtgtcctgggaagaggaagcagagcattcaggggccagtcacaatattttagtagaagtgcaggatgacggaactatgaaaatcaaggatgaggagagggacgatacactgaccatcctcctgaaggctactcttctggcagtcagcggcgtttatcccttgtctattccagccacactattcgtgtggtacttttggcagaaaaagaaacaacgatccggcgtgctgtgggacaccccttcacccccagaagtcgagcgcgcggtgctcgatgacgggatatatcggatcatgcagagaggactgcttggtaggagtcaggttggcgtaggggtgttccaggaaaacgtctttcatacgatgtggcacgtgactcgtggagctgttttaatgtaccaaggcaagcgcctggagccgagctgggcctccgtgaaaaaggacctcatttcttacggtgggggatggcggttgcagggctcgtggaataccggcgaggaagtccaggtgatcgcagtagagcctgggaagaaccccaaaaatgtccagacagccccaggaaccttcaagacaagcgaaggtgaggtgggcgctattgccctggattttaaacccgggacttcaggatcccctatcgttaacagagaaggcaagatagtgggtctctatgggaatggagtcgtgaccacgagtggcacatacgtttctgcaatcgctcaagccaaagcgagccaggagggcccactgcccgagattgaagacgaggtgttcaggaagcgaaaccttactatcatggatctgcaccctgggtccggaaagacccggcgctatttgccggccattgtcagagaagcaatcaaaaggaagctacggacactgatactcgctccaacccgagtggtagcctcagagatggctgaagcattaaaaggtatgcccattagataccagactaccgccgtgaagtctgagcatacaggcaaagagatcgttgacctgatgtgccacgccacgtttactatgcgccttctgagccctgtcagggtgccaaattataacatgatcattatggatgaagctcatttcaccgaccccagttccatcgcggcacgtgggtacataagcacacgggtgggaatgggcgaggccgctgccatttttatgaccgcaactcctccgggttctgtcgaagccttcccccaatcaaatgctgtaatccaggatgaggaaagagacattccagagaggtcctggaacagtgggtatgagtggatcacagattttcctggaaagaccgtgtggttcgttcccagcataaagtcgggcaatgacattgcgaactgtctccgcaaaaatggcaagcgagtgatccagttgtctagaaaaacgttcgatactgaataccagaagaccaagaacaacgactgggactacgtcgtgaccaccgatatctccgagatgggggccaattttcgggcagacagggttattgatccacgccgttgcctgaagcctgtgatcctcaaggacggacccgaaagagtcattctggctggtccaatgccggtgactgtagccagcgcagcccaacggaggggccgcatagggcgaaaccacaataaagagggagatcagtatatctacatgggccagcctcttaacaatgacgaggatcatgctcactggacagaagccaagatgctactggacaacattaatacccccgagggtatcatcccagcgttgttcgaacccgagagagaaaaatcagcagccattgatggggagtatcggttaaggggcgaggctcgcaagacatttgtggaactgatgagaaggggagacctccctgtttggctgagttacaaagtcgcctctgagggcttccagtattccgatcggcgttggtgctttgacggggaacgcaacaatcaagtgcttgaggaaaacatggatgtggagatatggactaaggagggagaaaggaaaaagctgagaccaagatggctcgacgctcggacgtacagcgaccccttggcactgcgcgagttcaaggaatttgccgctggtagaaggtcagtcagtggcgatctaatcctggagattgggaaactccctcagcaccttacccagcgggcccagaatgcactggacaacttagttatgttgcataatagcgaacaaggaggccgagcgtatagacacgccatggaggagctgccggatacaatcgaaactctcatgctgcttgctctgattgccgtgctcaccggtggggtaacattgttctttctgtccggccgcggattaggcaagacctctatcgggctactgtgtgtgatggcaagctccgtcctcctttggatggcttcagtggagccacattggatagccgcatctatcattctggagttctttttgatggttctgctcatccccgagcctgacaggcagcggactccccaggataaccagctggcctacgtggtcattggacttctcttcatgatcctgacggtagctgcgaatgagatgggtttgctggaaaccaccaaaaaggacttaggcatagggcacgtggccgttgagaaccaccatcacgcagctatgctagatgtggacctgcatccagccagtgcctggactctctacgcagtcgctaccacaattatcacccctatgatgcgtcacactattgaaaacacaacggccaatatctcgcttaccgcgatagctaaccaagccgcaatcctgatgggattggataaaggctggcccattagcaagatggacatcggtgtgccactgctcgccctggggtgctattcccaggtcaatcctcttactttaacagctgcagtgctgatgctcgttgcccattacgcgattatcggcccgggattgcaggctaaggccaccagagaggcacagaaaaggaccgccgctggcataatgaagaaccccacagtggatgggattgtagccatcgacctggatccagtggtctatgacgcaaaatttgaaaagcagctaggacagatcatgctgctcattctttgtacttctcagatcctgttgatgcgcacgacctgggctctgtgcgagtcaataacactcgccactggccctctgaccacattatgggagggtagccccgggaaattctggaataccactattgcggtttccatggccaacatcttccggggaagttaccttgcaggcgctggtctggccttttctctcatgaaaagcctaggcgggggacgaagaggcacgggggcacaaggagaaacactgggcgagaagtggaaaaggcagttgaatcagctgtcaaagtccgagttcaacacctataaacgcagtggtattatggaggtggaccggagcgaagctaaggaggggctcaaaagaggagagactaccaagcacgccgtctctcgtggcacagccaaacttaggtggtttgtggaacggaatctggtaaaaccagagggtaaggtgatcgatttgggctgtgggcgcggaggctggtcctactattgcgcggggctgaaaaaggttactgaagtgaaaggatacaccaagggcggtcctgggcacgaggaacccataccgatggctacatacggatggaacctcgtcaaattacattcaggcaaggacgtgttctttatcccacctgagaagtgtgatacgctgctttgcgacattggcgagagctcgcccaatccaaccatcgaagaggggcgaactctgagagtcctaaaaatggtggaaccctggctcaggggaaaccagttctgtattaagatcctgaatccttatatgccgtctgttgtagagacattggagcaaatgcagcggcgccacggtggcatgctggtgagaaaccccctcagtagaaattccacccatgaaatgtactgggtcagctgcgggactggaaacattgtgtcagcagttaatatgacatcccgaatgcttctgaaccggtttaccatggcccaccgtaaaccaacgtatgagagagatgtggacttaggcgctggtacccgccacgtcgccgtggaacctgaggtagcaaacctggatatcatagggcagaggattgaaaatatcaagcatgagcacaaatctacatggcattacgacgaggataacccctataagacttgggcctaccacggaagctatgaagtgaagcctagtggctccgctagctctatggttaatggcgtcgtgaaattgctcaccaagccatgggacgtgatccccatggtcacacagattgcgatgactgataccacacctttcgggcaacagcgggtttttaaagagaaggtggacaccagaactccaaaagccaagcgcggaacggcacagataatggaagtaacagctaagtggctgtggggtttcctatcaaggaacaaaaagccccgaatctgtacccgggaggaatttactagaaaagtgaggagtaatgccgcaattggcgccgtcttcgtggacgagaaccaatggaactccgctaaggaggccgttgaagatgagcgcttttgggaccttgtgcatcgtgaacgggagctgcacaaacaggggaagtgcgcgacctgcgtctacaacatgatgggaaagagagagaaaaagctcggcgagttcggtaaagcaaaggggagcagggccatctggtacatgtggctgggagctcgcttcttggagtttgaagccctgggcttcatgaatgaggatcactggttttctcgagaaaactcgctctcaggcgtggagggggagggacttcataaactgggttatattttacgggacatcagcaagataccgggcgggaatatgtacgcagatgacacagctggatgggatacgagaatcaccgaagacgatctgcagaacgaggccaaaattactgacatcatggaacctgagcacgctttgctcgccaagtccattttcaagctgacatatcagaataaagtagttagggtgcaacgcccagcaaagaacggcaccgtcatggatgtgatcagtagacgggaccagaggggttctggacaggtgggaacttacggcctaaatacatttaccaacatggaagcgcagcttatacgtcaaatggagagcgagggcattttctccccctcagaactggagacacctaacctcgccgggcgagtcctggattggttggaaaaacatggagttgagcgcttaaagagaatggctatcagtggtgacgactgtgtggtaaaaccaatcgatgaccggtttgccactgcactgaccgctctcaatgatatgggcaaggtgaggaaggacattccccagtgggaaccgtctaaagggtggaacgattggcagcaggtccctttctgcagccaccactttcatcaacttataatgaaggacggacgcgagatcgtggttccctgtagaaatcaggatgagctggtgggccgggccagggtctcccagggtgcagggtggtcactacgagaaacggcctgcctgggaaaaagctatgcgcagatgtggcaactcatgtacttccaccgtagagacttgcgcctggctgccaacgcaatttgttctgccgtgccagtagattgggttcctacctcccggacaacttggagtatccatgctcaccatcagtggatgaccacagaggacatgcttagcgtgtggaatagggtctggattgaagagaacccctggatggaagataagactcacatctcgtcctggggcgacgtgccatatctgggcaaaagagaggaccagtggtgcgggtctctcataggattaaccgcccgcgcaacgtgggctacaaatatccaagttgccattaaccaggtgcggaggctgatcggtaatgagaactacttggattacatgacctcaatgaagcgatttaagaatgaaagcgaccccgagggcgcgctgtggtga

SEQ ID NO: 13716 - RNA, 9879 nt, synthetic construct
  misc_feature 1..9879: note = derived and/or modified CDS sequence (opt3) from DENV-1__FJ882520__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagctgtgtgaagatactatgacctacaaatgcccacggataacagaggtggaaccggacgatgtagactgttggtgcaataccactgatacatgggtgacctatgggacgtgtagtcaaactggagagcaccgccgagacaagcgtagcgtcgcgcttgctccccatgtgggcctgggtttggagaccagagccgaaacatggatgtcctctgagggggcatggaaacagatccagaaggttgaaacttgggccctcaggcaccctggattcaccgtgattgctctgtttctggcacatgccatcggcacatcgattacccagaagggcatcatattcatcctcttaatgctggtcacgccatcaatggctatgcggtgcgtggggattggaagccgcgattttgtagagggtcttagtggcgccacttgggttgacgtggtcttggagcacgggtcctgtgtgacaaccatggcgaaagataagcccactctggacatcgaactactcaaaacagaggtgaccaaccctgcagtcctgagaaagctttgcattgaagccaaaatctctaatacgaccacagatagcaggtgtccaactcaaggagaggctaccctggttgaagagcaggacgccaacttcgtgtgccggcgcacatttgtagatcgaggctggggtaatgggtgtggattgttcggcaagggctccctcataacttgcgcaaagtttaaatgcgtgaccaagctggaggggaaaattgtccagtacgaaaacttaaagtattcagtgatcgttacagtgcacaccggagaccagcatcaagtcggtaatgagagtactgaacacggcacgacagctaccattactccccaggcccctaccagcgagatccagctgacagactacggggcgctcacccttgattgttctccaagaactggactggacttcaacgaaatggtgttgctaacaatgaaagagaagtcctggctggtacataaacagtggtttctcgatctgccgcttccctggacgtcaggcgccagcaccagtcaagagacttggaataggcaggacctgttggttacattcaagaccgcacacgctaagaaacaggaagtggtcgtgctcggttctcaagagggggccatgcacacagctctgactggcgccaccgaaatccagacgtccggaaccacaactatttttgcaggccatttaaagtgccggctgaaaatggataagctaaccctcaaagggatgagctatgtcatgtgtacaggatcgttcaagctggagaaggaagtggccgagactcagcacggtaccgttcttgtgcagataaaatacgagggcacggacgctccttgcaagatcccattctctacacaagatgaaaaaggggtaacccagaacggacgtttgattactgcgaatcccatcgtcacagacaaggagaaacctgtgaacatagaagcagagccaccctttggcgagtcctatattgttatcggtgccggggaaaaggctctgaagctctcatggttcaaaaagggcagtagcatcggaaaaatgtttgaggccaccgcacgcggcgccagaaggatggctattctgggggatactgcctgggacttcggatccatcggtggcgtgtttacctctgtcgggaagcttgtgcatcagattttcggaacagcatacggcgtactgtttagcggtgtgtcatggacgatgaaaatagggatcggcgttttgctcacctggctgggattaaatagtcggtccactagcctgtctatgacatgtattgcggtcggcctagtgaccctctacctgggggtgatggtccaggctgattcaggatgcgttatcaactggaagggccgagaacttaagtgtggtagtgggatcttcgtgacaaatgaggtgcacacttggaccgaacaatataaatttcaggccgacagcccgaagcgcttgtccgcagccattggaaaagcttgggaggagggcgtatgcggtataagatctgccacgaggctggaaaacatcatgtggcggcagatttcgaacgagctcaatcatatcctgttagaaaacgacatgaagttcacagtcgtggttggcgatgtggtcgggattctggcacagggaaaaaagatgatccgccctcaacccatggagcacaaatacagctggaagtcctggggcaaggctaaaataatcggggccgacgtgcagaataccacttttattatcgatggaccaaacacccctgaatgtcccgacgatcagagagcgtggaatatttgggaggttgaggactatggcttcggtatctttacaactaacatatggcttaagttgagggattcatacacccaggtgtgcgaccaccgtctcatgagtgccgctattaaagattctaaggcagtacatgccgacatggggtattggatcgaaagcgagaaaaatgaaacatggaagctggctcgggcctccttcattgaggtcaagacgtgtatctggccaaaatcacacaccctatggagcaacggagtgctggaatctgagatgataatccccaagatttacggcggtcctatctcccaacataattatcgaccaggctacttcactcagacagcagggccgtggcacctcggaaaactggagcttgattttgacttgtgcgaaggcaccactgtggtcgttgatgagcactgcgggaacagaggacccagtctgaggacaaccacggtgactggcaagattatccatgaatggtgttgccgcagctgtaccttacctccactccggttcaaaggtgaggacgggtgctggtacggaatggagataagacccgtaaaggaaaaggaggaaaatctggtgaaatctatggtctccgcgggctcaggtgaggtggacagttttagccttggcctgttgtgtatttcgatcatgatcgaagaggttatgaggtcccgctggtctcgaaagatgctcatgacagggaccctggccgtgttctttctactgattatgggacagctcacttggaacgatctgatccggagctgcattatggtcggcgctaatgcctcagaccgtatggggatgggaacaacctatcttgcattgatggctacattcaaaatgagacctatgtttgccgtgggcctgttattcaggcgcctcactagtcgggaggttctgcttctgaccataggtctatccctcgtggcatctgtcgaactgccaaacagcttggaggaactgggggatggattagccatgggcatcatgattctcaagctgcttacggactttcaatcctaccagctgtgggctacattgctctcactgaccttcatcaaaactacctttagcctacactatgcgtggaagacaatggccatggtactgagtattgtgtctcttctccccctgtgtttgtccactaccagccagaagacgacatggctgccggttttactcggctcgctggggtgcaaacctcttaccatgttcctgatcgcagagaataagatatggggaagaaaatcatggccattgaacgaaggtatcatggctgtgggcattgtctctatcctcctgagttccctactgaagaacgatgtgccccttgccgggcctctcattgccggaggcatgctgatcgcttgttacgtaataagcggttctagcgcagacttgtccttagagaaagccgcggaggtgtcatgggaagaggaagctgagcatagtggggccagccacaatattctggtcgaagttcaggatgacggaactatgaagatcaaagatgaggagagggacgatacactcaccatcctgcttaaggcaactctgttggccgtgtctggcgtgtatcccctatccattccagctacactgtttgtctggtacttctggcaaaagaaaaagcagcgatcaggcgtgctctgggacacccctagtcccccagaagttgagcgcgcagtactggatgacgggatatatcggatcatgcagagaggacttttaggtaggagccaggtgggcgtcggggtgttccaagaaaacgtttttcatacgatgtggcacgtgactcgtggagccgtcctgatgtaccagggcaaacgcctcgagccgtcctgggcgtctgtgaagaaagacttgatttcgtacggtgggggatggcggctgcagggcagctggaataccggcgaggaagtacaggtcatcgctgtggagcctgggaagaaccccaagaatgttcaaacagccccaggaaccttcaaaacacccgaaggtgaggtgggcgcaattgccctcgattttaagcctgggacttcaggatccccaatcgtcaacagagaaggcaaaatagtgggtctgtatgggaatggagttgtgaccacgagtggcacatacgtctctgctatcgcccaggcaaaggctagccaggagggcccccttcctgagattgaagacgaggtgttcaggaaacgaaacctgactatcatggatttgcacccggggtccggaaagacccggcgctatctaccagccattgtaagagaagcgatcaagaggaaactgcggacactcatattagcccccacccgagtggttgcatcagagatggctgaagccctgaagggtatgcctattagataccaaactaccgctgtcaaatctgagcatacaggccgcgagatcgtggaccttatgtgccacgcaacgtttactatgaggctgctcagcccagtgcgtgtccccaattataacatgatcattatggatgaagcccatttcaccgaccctagttccatcgccgctcgggggtacataagcacaagagtaggaatgggcgaggcggcagccatttttatgaccgctactccgcccggttctgtggaagccttcccacagtcaaatgcagttatccaggatgaggaaagggacattcctgagcgctcctggaacagtgggtatgagtggatcacagattttcccggaaagaccgtgtggttcgtcccaagcataaaatcgggcaatgacattgccaactgtttgcgaaagaatggcaagagagtgatccagctgtctcggaaaacgtttgatactgaataccaaaagacaaaaaacaacgactgggactacgttgtgaccaccgatatctccgagatgggggctaatttcagggcggaccgcgtcattgatcctcgtagatgcctcaagcccgtgatcctgaaagacggaccagaacgggtaattcttgccggtccgatgcctgtgactgttgcaagcgctgcccagaggcgcggccgaatagggagaaaccacaataaggagggagatcagtatatctacatgggccagcccctaaacaatgacgaggatcatgcacactggacagaagccaagatgctgttggacaacattaataccccagagggtatcatccccgctttattcgaacctgagcgggaaaaatcagccgcgattgatggggagtataggctgcgcggcgaggcaagaaagacatttgtcgaactcatgaggcggggagacctgccagtgtggcttagttacaaagtggcctctgagggcttccaatattccgatcgtcgctggtgctttgacggggaacgaaacaatcaggtcctggaggaaaacatggatgttgagatatggactaaggagggagaaagaaaaaagctcaggccccggtggttggacgctcgcacgtacagcgaccctctggccctaagagagttcaaagaatttgctgcaggtaggcggtcagtgagtggcgatctgatcctcgagattgggaagcttccgcagcacctgacccagcgagcccaaaatgctttagacaacttggtaatgctgcataatagcgaacagggaggcagagcctatcgccacgcaatggaggagctcccagatacaatcgaaactctgatgcttctggcgctcattgccgtgttgaccggtggggtcacactgttctttttatccggcaggggactaggcaagacctctatcgggctgctctgtgtgatggctagctccgcccttctgtggatggcatcagttgagccccattggatagctgcctctatcattttggaattctttctgatggtgctcctgatccctgagcccgaccggcagcgtactccacaggataaccaacttgcatacgtcgtaattggactcctgttcatgatcttgacggtggccgctaatgagatgggtctgttagaaaccacaaaaaaggacctaggcatagggcacgttgcggtggagaaccaccatcacgccactatgctggatgtcgacctccatcctgcaagtgcttggaccctttacgccgtggccacaaccattatcactcccatgatgagacacacaattgaaaacacgaccgcaaatatctcgctgactgctatagccaaccaggcggctatcttgatgggactggataaaggctggccaattagcaagatggacatcggtgtccctctcctggcccttgggtgctattcccaggtgaatccgttaacactgaccgcagccgttctcatgttggtggctcattacgcaattatcggccccggactgcaagccaaagcgaccagggaggctcagaagcgcacagccgcaggcataatgaagaacccaactgtagatgggattgtggccatcgacctagatcctgtcgtttatgacgctaaatttgaaaagcagctgggacagatcatgctccttattctgtgtacgtctcaaatcttgctgatgcggaccacatgggccctctgcgagtcaataactctggcaaccggccccttaacaaccctttgggagggtagcccagggaaattctggaatactacgattgctgtgtccatggccaacatctttcgaggaagttacctggcgggcgccggtctcgcattctctctaatgaagagcctgggcgggggaagaaggggcacaggggctcagggagaaaccttgggcgagaaatggaagcgccagctgaatcagctctcaaagtccgaattcaacacttataaacggagtggtattatggaggtcgacagaagcgaagccaaggaggggcttcgtaggggagagaccacaaaacacgcagtgtctcggggcactgctaagctgcgctggtttgtagaacgaaatttggtgaaacctgagggtaaggttatcgatctgggctgtgggagaggaggctggtcctactattgcgccgggctcaagaaagtgaccgaagtcaagggatacacaaaaggcggtcccgggcacgaggaaccgataccaatggccacgtacggatggaacttagtgaagctgcattcaggcaaagacgtcttctttatccctcccgagaagtgtgatacccttctgtgcgacattggcgagagctcgccaaatcccactatcgaagaggggaggacactacgggtgctcaaaatggttgaaccttggctgcgcggaaaccaattctgtattaagatcttgaatccgtatatgccctctgtagtggagaccctggagcagatgcagagaaagcacggtggcatgctcgtcaggaacccacttagtcgaaattccactcatgaaatgtactgggtgagctgcgggacaggaaacattgtttcagcggtgaatatgacctcccggatgctgttaaaccgttttacgatggctcacagaaaacctacctatgagcgcgatgtcgacctgggcgcaggtacaaggcacgtggccgtagaacccgaggtggctaacttggatatcatagggcagcggattgaaaatatcaagcatgagcacaaatctacttggcattacgacgaggataacccttataagacctgggcctaccacggaagctatgaagttaaaccaagtggctccgcaagctctatggtcaatggcgtggtgaagctcctgacaaagccctgggacgtcatccctatggttactcaaattgccatgaccgatacaaccccattcgggcagcagagagtgtttaaagagaaggtagacactcgcacgcccaaagctaagaggggaacagcgcaaataatggaagtgaccgcccgatggctatggggtttcctttcacggaacaaaaagccgagaatctgtactagggaggaatttacccgcaaggtccgtagtaatgcagctattggcgccgtgttcgttgacgagaaccagtggaattccgcaaaagaggccgtggaagatgagcggttttgggacctggtccatagagaaagggagctccacaagcaggggaaatgcgctacatgcgtgtacaacatgatgggaaagcgcgaaaaaaagctgggcgagttcggtaaggccaaagggagccgagcgatctggtacatgtggttgggagcacggtttctggagttcgaagccctcggcttcatgaatgaggatcactggttttctagagaaaactcgctttcaggcgtagagggggagggactgcataagttaggttatattctgagggacatcagcaaaatacctggcgggaatatgtacgctgatgacacggccggatgggatacccgcatcactgaagacgatttgcagaacgaggcaaagattacagacatcatggaaccagagcacgctctcctggccacctccattttcaaactaacttatcaaaataaggttgtgagagtccagcggcccgctaggaacggcacagtgatggatgtgatcagtcgtcgagaccagcgcggttctgggcaggtcggaacctacggccttaatacatttactaacatggaagcccaactgataagacagatggagagcgagggcattttctccccttcagaactcgagaccccaaacctggcagaacgggttttggattggttagagaaacatggggtggaaaggctgaagcgcatggcgatcagtggagacgactgtgtagtgaagcccatcgatgacagatttgccacggctctctctgcccttaatgatatgggtaaagtccggaaggacattccgcagtgggagcctagcaaaggctggaacgattggcagcaagtgcccttctgctcccaccactttcatcagctgataatgaaggacgggagggagatcgttgtgccatgtcgaaatcaggatgaactagtcggacgtgcaagagtgtcacagggcgctggttggagcctgcgcgagaccgcctgcctcgggaaatcttatgcacaaatgtggcagttgatgtacttccaccggagggacctgagacttgccgcgaacgctatttgttccgccgtacctgttgattgggtgcccacaagtcgcactacctggagcatccatgcacaccatcagtggatgacaactgaagacatgctgtcggtctggaatcgggtgtggattgaggaaaacccatggatggaggataagacccacatctcctcttggggagacgttccctatctcggcaagagggaggaccaatggtgcggctcattaatagggctgacggcccgagctacatgggccaccaatatccaggtggcaattaaccaggtcagacggttgatcggaaatgaaaactacctggattacatgactagcatgaaaaggtttaagaatgagagtgaccctgaaggtgctctctggtga

SEQ ID NO: 13717 - RNA, 9879 nt, synthetic construct
  misc_feature 1..9879: note = derived and/or modified CDS sequence (opt3) from DENV-1__FJ882523__SS-prME
  source 1..9879: mol_type = other RNA
agcgtgaccatgctgctcatgcttatgcccaccgcactggctttccacttgactacgcgaggcggggagcctcatatgatcgtcaccaagcaggaaaggggaaaatccttactgtttaagacatctgccggtgttaatatgtgcactctaattgccatggacctcggcgagctgtgtgaagataccatgacatacaaatgcccacggataaccgaggcggaaccggacgatgtggactgttggtgcaatgctactgatacatgggtgacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagggattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaggaacaggacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggatcgttcaaactggagaaggaagtggctgagacccagcacggtacggtccttgtgcagataaagtacgagggcacagacgcgccttgcaaaatcccattctcgacccaagatgaaaagggggttactcagaacggacgcttgattacagcaaatcccatcgtgaccgacgaggaaaaacctgtaaacatagaggccgagccaccctttggcgaatcttatattgtcatcggtgctggggagaaggccctgaaactctcctggttcaagaagggctcaagtatcggaaaaatgtttgaagcaactgccagaggcgctaggcggatggccattctgggggataccgcatgggacttcggaagcatcggtggcgtgtttacatccgttgggaaacttgtgcatcagattttcggaacggcgtacggcgtcctgttttctggtgtgagctggaccatgaaaatagggatcggcgtattgctcacttggctgggattaaattcacgaagtacatccctgagcatgacctgtattgctgtgggcctagttacactctacctgggggtcatggtgcaggccgattctggatgcgtgatcaactggaagggccgcgagcttaaatgtggttcagggatcttcgtcactaatgaagttcacacctggacggagcaatataagtttcaggcagacagtccgaagagattgagcgccgctattggaaaagcctgggaggaaggcgtgtgcggtataaggtccgcaacacggctggagaacatcatgtggaagcagatttctaacgaactcaatcatatcctgttagagaacgacatgaaattcaccgtggtagtcggcgatgtggttgggattctggctcagggaaagaaaatgatccgccctcaacccatggaacacaagtactcgtggaaaagctggggcaaggccaagataatcggggcggacgtgcagaatactacctttattatcgatggaccaaacacacctgagtgtcccgacgatcagagagcctggaatatttgggaggtcgaagactatggcttcggtatctttactaccaacatatggcttaaattgagggattcctacacacaggtgtgcgaccaccgtctcatgtcagctgcaattaaggatagtaaagccgttcatgctgacatggggtattggatcgagtctgaaaagaatgagacgtggaaactggcccgggcatccttcattgaagtgaagacctgtatctggccaaagtcccacactctatggtcaaacggagtactggagagcgagatgataatccccaaaatttacggcggtcctatctctcaacataattatcgaccaggctacttcacacagaccgcggggccgtggcacctcggaaagctggaacttgattttgacttgtgcgagggcactacagtcgtggtggatgaacactgcgggaacagaggaccctccctgaggaccacgactgtcaccggcaaaattatccatgagtggtgttgccgcagttgtacattacctccactccggttcaagggtgaggacgggtgctggtacggaatggaaataagacccgttaaagagaaggaagagaatctggtaaagagcatggtatctgccggctccggtgaagtggactcatttagtcttggcctgttgtgtattagcatcatgatcgaggaggtcatgaggtcgcgctggtcccgaaaaatgctcatgaccgggactctggctgtgttcctactgctcattatgggacagctgacatggaacgatcttatccggttgtgcattatggttggcgccaatgcatctgaccgtatggggatgggaaccacatatctggctttaatggccacttttaagatgagacctatgttcgcagtgggcctcctgtttaggcgccttaccagccgggaagtcctgctactcacgataggtctgtcattggtggccagtgttgagctgccaaactccttagaggaactcggggatggactggctatgggcatcatgattcttaaactgttgacagacttccaatctcaccagctctgggcgaccctgctaagcctgacttttatcaagaccacactttccctccattacgcctggaaaactatggcaatggtgctgtcaattgtcagcttgttccccctgtgtttaagtaccacgtctcagaagacaacctggctcccggtactgcttggctccctggggtgcaagcctttgactatgtttctcatcgctgaaaataaaatatggggaagaaagagctggccactgaacgagggtatcatggccgtgggcgttgtgtcgattctactgtcatctcttctcaaaaacgatgtccccctggccgggcctttgatcgctggaggcatgttaattgcatgttatgtgatcagtggttccagcgccgacctgtctctcgagaaggcggctgaagtaagctgggaggaagaggccgaacactccggggcatcacataatatactggtggaggtccaggatgacggaacaatgaaaattaaggatgaggaaagggacgatacccttactatcctgttgaaagccacactactggctgttagtggcgtgtaccccctcagcatcccagcaaccctgttcgtgtggtatttttggcaaaagaagaaacagcgatctggcgtcctttgggacacgccttcacccccagaggtggaacgcgccgttttagatgacgggatttaccggataatgcagagaggactgctcggtaggagccaggtaggcgtgggggtcttccaagagaacgtgttccacactatgtggcacgttacccgtggagcggtgttgatgtatcagggcaagcgcctggagccgagttgggctagcgtcaaaaaggacctcatctcctacggtgggggatggcggctgcagggctcttggaatacaggcgaagaggtgcaggtaattgccgtcgaacctgggaaaaaccccaagaatgtgcaaaccgcaccaggaacatttaagactcccgagggtgaagttggcgccatcgctcttgatttcaaacctgggacctcgggaagcccaattgtgaacagagagggcaagatcgtcggtctgtacgggaatggagtggttacgacatcaggcacttatgtgtccgccatagcacaggctaaagccagtcaggagggccccttgcctgaaatcgaggacgaagtctttaggaagcgaaacctaaccattatggatctgcatccggggtctggaaaaacacggcgctacctcccagcgatcgtgagagaggccattaagaggaagttacggaccctgatccttgcacccactcgagtagtggctagcgaaatggccgaggctctgaaaggtatgcctataagatatcaaaccacagcagttaagtccgagcacacgggcaaagaaattgtcgacctcatgtgccatgccactttcaccatgcgcttgctgtcaccagtgagggtgcccaattacaacatgatcatcatggatgaggcccactttacagacccttctagcattgctgcgcgtgggtatatcagtacccgggtcggaatgggcgaagcagccgctatattcatgactgccacaccgcccggttccgtagaggcatttccacagagcaatgccgtgattcaggatgaagagagagacatccctgagaggtcttggaactcagggtacgaatggattaccgatttccccggaaagacggtttggtttgtgccatccatcaaaagtggcaatgacatagctaactgtctccgcaagaatggcaagcgagtcattcagctgagcagaaaaactttcgatacagagtatcaaaagaccaaaaacaacgactgggactacgtggttaccactgatatctcggaaatgggggcgaattttcgggccgacagggtgatcgatcctcgccgttgccttaagcccgtcattctaaaagacggaccagagagagtgatcctggcaggtccgatgcctgtaacagtggcttctgccgcacagcggaggggccgcattgggcgaaaccataataaggagggagatcagtacatatatatgggccagcccttgaacaatgacgaagatcacgcccactggaccgaggctaagatgttactggacaacatcaatacaccagaaggtattatccccgccctcttcgagcctgaaagagagaaatccgcggcaatcgatggggagtaccggctgaggggcgaagcccgcaagactttcgttgagcttatgagaaggggagacctgccagtctggctcagctataaagtggcttcagaaggctttcaatacagtgatcggcgttggtgcttcgacggggagcgcaacaatcaggtgttggaagagaacatggatgtcgagatttggacgaaggaaggagagagaaagaagctgagacccaggtggctagacgcccggacctattctgaccctctggctctccgcgaatttaaagagttcgcagccggtagaaggtccgttagcggcgatcttatactggaaatcgggaagttaccgcagcatttgacacagcgggctcaaaatgccctggacaacctcgtgatgctgcacaattcagagcagggaggccgagcatacagacatgcgatggaggaacttccagatactattgagaccctgatgctcttggccctgatcgctgtattaacaggtggggtgaccctatttttcctgagtggccgcggactcggcaagactagcattgggcttctgtgtgtcatggcctcctctgtgttgctgtggatggcaagcgttgaaccccactggatcgctgcctccataatcctcgagtttttcctgatggtgcttctcattcctgagcccgacaggcagcggacgccacaggataaccaactggcatatgtcgtaatcggattgctgtttatgattttaaccgtggccgctaatgaaatgggtctactggagacaactaaaaaggacctcggcatcgggcacgttgcggtggaaaaccatcaccatgccaccatgcttgatgtcgacctgcaccctgcatcagcttggacattgtacgccgtggccaccactataattacacccatgatgcgtcatacgatcgagaacaccactgcaaatatttctctgacagctatcgccaaccaggcggctatactcatgggactggataaaggctggccaatcagtaagatggacattggtgtccctcttttagccctggggtgctacagccaggtgaatccgctcaccttgaccgcagccgttctgatgctagtggctcactatgcaatcattggccccggactgcaagccaaagcgacaagagaagctcagaagaggactgccgcaggcatcatgaagaacccaacggtagatgggatagtggccattgacctcgatcctgtcgtttacgacgctaaattcgagaagcagcttggacagatcatgctgttgatcctgtgtaccagccaaattctcctgatgcgcacaacttgggccttatgcgagtccatcacccttgcaacaggccccctgaccactctctgggaaggttctccagggaaattttggaatacgacaatagctgtgtcaatggccaacattttccggggaagctatctagcgggcgccggtctggcattttccttgatgaagagtctgggcgggggacgaagaggcaccggggctcagggagagactctcggcgaaaaatggaagaggcagcttaatcagctgtctaagagcgagttcaacatctacaaacgctcaggtattatggaagtcgaccggtccgaggccaaggaggggttgaaaagaggagaaaccacacgtcacgcagtgagtaggggcactgctaagctgcggtggttcgtagagcgcaatctcgtgaaacctgaaggtaaggttatcgatttaggctgtgggcgaggaggctggagctattactgcgccgggctgaagaaagtgaccgaggtcaagggatatacaaaaggcggtcccgggcatgaggaaccgataccaatggccacgtacggatggaaccttgtgaagctgcactctggcaaagacgtctttttcacccctcccgagaagtgtgatactctactctgcgacatcggcgaatcctcaccaaatcccacaattgaggaagggagaaccctgagggtgttgaaaatggttgagccttggctgcggggaaaccaattttgtatcaagattctcaatccgtacatgcccagcgtagtggagactcttgaacagatgcagcgcaagcatggtggcatgctggtcagaaacccattatcgagaaattctacacacgagatgtattgggtgagttgcgggaccggaaacatcgtttccgcggtgaatatgacgagccgaatgctgttgaaccggttcaccatggctcaccgtaaacctacatacgaaagagatgtcgacctcggcgcaggtactcgccatgtggccgtagagcccgaagtggctaacctggatattatcgggcagaggatagagaatattaagcacgagcataaatcaacctggcactatgacgaagataacccttacaagacatgggcctatcatggatcctacgaggttaaaccatctggcagcgcaagttccatggtcaatggcgtggtgaagctacttactaagccctgggacgtcatccctatggttacccaaatcgccatgacagataccactccatttgggcagcagcgggtgttcaaagaaaaggtagacacgagaacacccaaagctaagcgcggaaccgcgcaaattatggaggtgactgccaggtggctgtggggttttctcagccgaaacaaaaagccgcggatatgtaccagagaagagttcacaaggaaggtccgctctaatgcagctatcggcgccgtgtttgttgacgagaaccagtggaactcagcaaaagaagccgtggaggatgaacgtttctgggacctggtccagaaggagcgggaattgcacaaacaggggaagtgcgctacgtgcgtgtataacatgatgggaaaaagagagaagaagctgggcgagtttggtaaagccaaggggagtagggcgatttggtacatgtggctcggagcacgcttccttgaatttgaggccctgggcttcatgaatgaagatcactggttctcccgagagaacagcttatctggcgtagagggggaaggactgcataaattgggttacatcctccgggacatttcgaagatccctggcgggaatatgtatgctgatgacaccgccggatgggatactagaataacagaggacgatctgcaaaacgaagcaaaaatcaccgacattatggagccagaacacgctctacttgccacttcaatctttaagctgacataccagaataaagttgtgagggtccagcgccccgctaagaacggcaccgtgatggatgtgattagcagacgggaccagaggggttccgggcaagtcggaacatatggcctcaatactttcaccaacatggaggcccagctgatccgtcagatggagagtgaaggcatattttctcctagcgagttggaaattccaaacttagcagagcgagttctggattggctcgaaaagtacggggtggagcgccttaaaagaatggcgatctccggagacgactgtgtagtgaagcccatcgatgaccggttcgccacggctctgaccgccctaaatgatatgggtaaagtcaggaaggacgtgccgcagtgggagccttcaaaaggctggaacgattggcaacaggttcccttttgcagtcatcacttccaccagctgattatgaaggacgggcgcgaaatagtggtcccatgtagaaatcaggatgagctcgtgggacgggcaagggtatctcaaggcgctggttggagcttgcgagaaacagcctgcctggggaagtcctatgcacagatgtggcagcttatgtactttcatcgtagagacctgcgcctcgccgcgaacgctatctgttcagccgttcctgtggattgggtccccactagccggaccacatggtctattcacgcacatcaccaatggatgactaccgaggacatgttatccgtgtggaatagggtttggatcgaagagaacccatggatggaggataaaacgcatgtgagtagctggggagacgtcccctatctgggcaagagagaagaccagtggtgcggctcgttgattgggctgacagcccgcgctacctgggcctccaatatccaggtggcaataaaccaggtacggaggctcatcggaaatgagaactaccttgattacatgacttctatgaaacgattcaagaatgaaggtgaccctgagggcgctctgtggtga

SEQ ID NO: 13718 - RNA, 9879 nt, synthetic construct
  misc_feature 1..9879: note = derived and/or modified CDS sequence (opt3) from DENV-1__FJ882524__SS-prME
  source 1..9879: mol_type = other RNA
agcgtgaccatgctgctcatgcttatgcccaccgcactggctttccacttgactacgaggggaggggagcctcatatgatcgtcaccaagcaggaaaggggaaaatccttactgtttaagacatctgccggtgttaatatgtgcactctaattgccatggacctcggcgagctgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaactacgtctgccgccgaactttcgttgatagaggctggggtaatgggtgtggattgtttggcaaaggcagcctcataacctgcgctaagttcaagtgcgtgacaaaactggaggggaagattgtacagtatgaaaacttaaaatactccgtgatcgtcaccgtgcacactggagaccagcatcaagttggtaatgagtcaacggaacacggcacaaccgccactattacaccccaggcgcctacaagtgagatccagctgaccgactatggggccctcactcttgattgtagcccaaggacaggactggactttaacgaaatggtgttgctaacgatgaaggagaaatcttggctggtccataagcagtggttcctcgatctgccgcttccctggacctccggcgcatcaactagccaagagacatggaatcggcaggacctgttggtgacctttaaaacagctcacgccaagaagcaggaagtagttgtgctcggtagtcaagagggggctatgcacactgccctgaccggcgcaacggaaatccagacctctggaacaactaccattttcgccggccatttaaaatgccgtctgaagatggataaactaacactcaaggggatgtcctacgtcatgtgtactggatcgtttaaactggagaaggaagtggctgagacccagcacggtacggtccttgtgcagataaagtatgagggcacagacgcgccttgcaaaatcccattctcgacccaagatgaaaagggggttactcagaacggacgcttgattacagcaaatcccatcgtgaccgacaaagagaagcctgtaaacatagaagccgagccacccttcggcgagtcttacattgtcatcggtgctggggaaaaagccctgaagctctcctggtttaagaaaggctcaagtatcggaaagatgttcgaggcaactgccagaggcgctaggcggatggccattctgggggataccgcatgggactttggaagcatcggtggcgtgttcacatccgttgggaaacttgtgcatcagatttttggaacggcgtacggcgtcctgttctctggtgtgagctggaccatgaagatagggatcggcgtattgctcacttggctgggattaaattcacgaagtacatccctgagcatgacctgtattgctgtgggcctagttacactctatctgggggtcatggtgcaggccgattctggatgcgtgatcaactggaaaggccgcgaacttaagtgtggttcagggatctttgtcactaatgaggttcacacctggacggaacaatacaagttccaggcagacagtccgaaaagattgagcgccgctattggaaaggcctgggaggagggcgtgtgcggtataaggtccgcaacacggctggaaaacatcatgtggaaacagatttctaacgagctcaatcatatcctgttagaaaacgacatgaagtttaccgtggtagtcggcgatgtggttgggattctggctcagggcaaaaagatgatccgccctcaacccatggagcacaaatattcgtggaaaagctggggcaaggccaagataatcggggcggacgtgcagaatactaccttcattatcgatggaccaaacacacctgaatgtcccgacgatcagagagcctggaatatttgggaggtcgaggactacggctttggtatcttcactaccaacatatggcttaagttgagggattcctatacacaggtgtgcgaccaccgtctcatgtcagctgcaattaaagatagtaaggccgttcatgctgacatggggtactggatcgaatctgagaaaaatgaaacgtggaagctggcccgggcatcctttattgaggtgaagacctgtatctggccaaaatcccacactctatggtcaaacggagtactggaaagcgagatgataatccccaagatttatggcggtcctatctctcaacataattaccgaccaggctacttcacacagaccgcggggccgtggcacctcggaaaactggagcttgatttcgacttgtgcgaaggcactacagtcgtggtggatgagcactgcgggaacagaggaccctccctgaggaccacgactgtcaccggcaagattatccatgaatggtgttgccgcagttgtacattacctccactccggtttaaaggtgaggacgggtgctggtatggaatggagataagacccgttaaggaaaaggaggaaaatctggtgaaaagcatggtatctgccggctccggtgaggtggactcattcagtcttggcctgttgtgtattagcatcatgatcgaagaggtcatgaggtcgcgctggtcccgaaagatgctcatgaccgggactctggctgtgtttctactgctcattatgggacagctgacatggaacgatcttatccggttgtgcattatggttggcgccaatgcatctgaccgtatggggatgggaaccacatacctggctttaatggccactttcaaaatgagacctatgtttgcagtgggcctcctgttcaggcgccttaccagccgggaggtcctgctactcacgataggtctgtcattggtggccagtgttgaactgccaaactccttagaggaactcggggatggactggctatgggcatcatgattcttaagctgttgacagactttcaatctcaccagctctgggcgaccctgctaagcctgactttcatcaaaaccacactttccctccattatgcctggaagactatggcaatggtgctgtcaattgtcagcttgtttcccctgtgtttaagtaccacgtctcagaagacaacctggctcccggtactgcttggctccctggggtgcaaacctttgactatgttcctcatcgctgagaataagatatggggaagaaaaagctggccactgaacgaaggtatcatggccgtgggcgttgtgtcgattctactgtcatctcttctcaagaacgatgtccccctggccgggcctttgatcgctggaggcatgttaattgcatgttacgtgatcagtggttccagcgccgacctgtctctcgagaaagcggctgaggtaagctgggaagaggaagccgagcactccggggcatcacataatatactggtggaagtccaggatgacggaacaatgaagattaaagatgaggagagggacgatacccttactatcctgttgaaggccacactactggctgttagtggcgtgtatcccctcagcatcccagcaaccctgtttgtgtggtacttctggcaaaagaaaaagcagcgatctggcgtcctttgggacacgccttcacccccagaagtggagcgcgccgttttagatgacgggatttatcggataatgcagagaggactgctcggtaggagccaggtaggcgtgggggtctttcaagaaaacgtgttccacactatgtggcacgttacccgtggagcggtgttgatgtaccagggcaaacgcctggagccgagttgggctagcgtcaagaaagacctcatctcctacggtgggggatggcggctgcagggctcttggaatacaggcgaggaagtgcaggtaattgccgtcgagcctgggaagaaccccaagaatgtgcaaaccgcaccaggaacattcaaaactcccgaaggtgaggttggcgccatcgctcttgattttaagcctgggacctcgggaagcccaattgtgaacagagaaggcaaaatcgtcggtctgtatgggaatggagtggttacgacatcaggcacttacgtgtccgccatagcacaggctaaggccagtcaggagggccccttgcctgagatcgaagacgaggtcttcaggaaacgaaacctaaccattatggatctgcatccggggtctggaaagacacggcgctatctcccagcgatcgtgagagaagccattaagaggaaattacggaccctgatccttgcacccactcgagtagtggctagcgagatggccgaagctctgaagggtatgcctataagataccaaaccacagcagttaaatccgagcacacgggcaaggagattgtcgacctcatgtgccatgccacttttaccatgcgcttgctgtcaccagtgagggtgcccaattataacatgatcatcatggatgaagcccacttcacagacccttctagcattgctgcgcgtgggtacatcagtacccgggtcggaatgggcgaggcagccgctatatttatgactgccacaccgcccggttccgtagaagcattcccacagagcaatgccgtgattcaggatgaggaaagagacatccctgagaggtcttggaactcagggtatgagtggattaccgattttcccggaaaaacggtttggttcgtgccatccatcaagagtggcaatgacatagctaactgtctccgcaagaatggcaaacgagtcattcagctgagcagaaagacttttgatacagaataccagaaaaccaagaacaacgactgggactacgtggttaccactgatatctcggagatgggggcgaatttccgggccgacagggtgatcgatcctcgccgttgccttaaacccgtcattctaaaggacggaccagaaagagtgatcctggcaggtccgatgcctgtaacagtggcttctgccgcacagcggaggggccgcattgggcgaaaccataataaggagggagatcagtatatatacatgggccagcccttgaacaatgacgaggatcacgcccactggaccgaagctaaaatgttactggacaacatcaatacaccagagggtattatccccgccctctttgaacctgagagagaaaagtccgcggcaatcgatggggagtatcggctgaggggcgaggcccgcaaaactttcgttgaacttatgagaaggggagacctgccagtctggctcagctacaaggtggcttcagagggcttccaatatagtgatcggcgttggtgctttgacggggaacgcaacaatcaggtgttggaggaaaacatggatgtcgagatttggacgaaagagggagaacgaaagaaactgagacccaggtggctagacgcccggacctactctgaccctctggctctccgcgagttcaaggaatttgcagccggtagaaggtccgttagcggcgatcttatactggagatcgggaagttaccgcagcatttgacacagcgggctcaaaatgccctggacaacctcgtgatgctgcacaattcagaacagggaggccgagcatatagacatgcgatggaggagcttccagatactattgaaaccctgatgctcttggccctgatcgctgtattaacaggtggggtgaccctattctttctgagtggccgcggactcggcaaaactagcattgggcttctgtgtgtcacggcctcctctgtgttgctgtggatggcaagcgttgagccccactggatcgctgcctccataatcctcgagttctttctgatggtgcttctcattcctgagcccgacaggcagcggaccccacaggataaccaactggcatacgtcgtaatcggattgctgttcatgattttaacagtggccgctaatgagatgggtctactggaaactaccaagaaagacctcggcatcgggcacgttgcggtggagaaccatcaccatgccacaatgcttgatgtcgacctgcaccctgcatcagcttggaccttgtacgccgtggccactacaataattacgcccatgatgcgtcataccatcgaaaacactacagcaaatatttctctgaccgctatcgccaaccaggcggctatactcatgggactggataagggctggccaatcagtaaaatggacattggtgtccctcttttagccctggggtgctatagccaggtgaatccgctcaccttgacagcagccgttctgatgctagtggctcactacgcaatcattggccccggactgcaagccaaggcgactagagaggctcagaagaggacggccgcaggcatcatgaaaaacccaaccgtagatgggatagtggccattgacctcgatcctgtcgtttatgacgctaagtttgaaaaacagcttggacagatcatgctgttgatcctgtgtacaagccaaattctcctgatgcgcactacctgggccttatgcgagtccatcacacttgcaaccggccccctgactacgctctgggagggttctccagggaagttctggaatacaaccatagctgtgtcaatggccaacatttttcggggaagctacctagcgggcgccggtctggcattctccttgatgaaaagtctgggcgggggacgaagaggcactggggctcagggagaaaccctcggcgagaagtggaagaggcagcttaatcagctgtctaaaagcgaatttaacatctataagcgctcaggtattatggaggtcgaccggtccgaagccaaagaggggttgaagagaggagagacaactcgtcacgcagtgagtaggggcaccgctaaactgcggtggttcgtagaacgcaatctcgtgaagcctgagggtaaggttatcgatttaggctgtgggcgaggaggctggagctactattgcgccgggctgaaaaaggtgacagaagtcaaaggatacacgaagggcggtcccgggcatgaggaaccgataccaatggccacctacggatggaaccttgtgaaactgcactctggcaaggacgtcttctttactcctcccgagaaatgtgatacactactctgcgacatcggcgagtcctcaccaaatcccaccattgaagaggggagaactctgagggtgttgaagatggttgaaccttggctgcggggaaaccaattctgtatcaagattctcaatccgtatatgcccagcgtagtggagacacttgagcagatgcagcgcaaacatggtggcatgctggtcagaaacccattatcgagaaattctacccacgaaatgtactgggtgagttgcgggacgggaaacatcgtttccgcggtgaatatgaccagccgaatgctgttgaaccggtttacaatggctcaccgtaagcctacttatgagagagatgtcgacctcggcgcaggtacccgccatgtggccgtagaacccgaggtggctaacctggatattatcgggcagaggatagaaaatattaaacacgagcataagtcaacatggcactacgacgaggataacccttataaaacttgggcctaccatggatcctatgaagttaagccatctggcagcgcaagttccatggtcaatggcgtggtgaagctacttaccaaaccctgggacgtcatccctatggttacacaaatcgccatgaccgatactacgccattcgggcagcagcgggtgtttaaggagaaagtagacacaagaacccccaaggctaaacgcggaactgcgcaaattatggaagtgaccgccaggtggctgtggggtttcctcagccgaaacaagaagccgcggatatgtacaagagaggaatttacgaggaaagtccgctctaatgcagctatcggcgccgtgttcgttgacgagaaccagtggaactcagcaaaggaggccgtggaagatgagcgtttttgggacctggtccagaaagaacgggagttgcacaagcaggggaaatgcgctacctgcgtgtacaacatgatgggaaagagagaaaagaaactgggcgagttcggtaaggccaaagggagtagggcgatttggtacatgtggctcggagcacgctttcttgagttcgaagccctgggctttatgaatgaggatcactggttctcccgagaaaacagcttatctggcgtagagggggagggactgcataagttgggttatatcctccgggacatttcgaaaatccctggcgggaatatgtacgctgatgacactgccggatgggatacaagaataaccgaagacgatctgcaaaacgaggcaaagatcactgacattatggaaccagagcacgctctacttgccacatcaatcttcaaactgacctatcagaataaggttgtgagggtccagcgccccgctaagaacggcacagtgatggatgtgattagcagacgggaccagaggggttccgggcaagtcggaacttacggcctcaatacctttacgaacatggaagcccagctgatccgtcagatggagagtgagggcatattctctcctagcgaattggagattccaaacttagcagaacgagttctggattggctcgagaaatatggggtggaacgccttaagagaatggcgatctccggagacgactgtgtagtgaaacccatcgatgaccggtttgccaccgctctgacagccctaaatgatatgggtaaggtcaggaaagacgtgccgcagtgggagccttcaaagggctggaacgattggcaacaggttcccttctgcagtcatcactttcaccagctgattatgaaggacgggcgcgagatagtggtcccatgtagaaatcaggatgaactcgtgggacgggcaagggtatctcaaggcgctggttggagcttgcgagagactgcctgcctggggaaatcctacgcacagatgtggcagcttatgtatttccatcgtagagacctgcgcctcgccgcgaacgctatctgttcagccgttcctgtggattgggtccccaccagccggacaacttggtctattcacgcacatcaccaatggatgaccacggaagacatgttatccgtgtggaatagggtttggatcgaggaaaacccatggatggaggataagacacatgtgagtagctggggagacgtcccctacctgggcaaaagagaggaccagtggtgcggctcgttgattgggctgaccgcccgcgctacttgggcctccaatatccaggtggcaataaaccaggtacggaggctcatcggaaatgaaaactaccttgattatatgacatctatgaagcgatttaaaaatgagggtgaccctgaaggcgctctgtggtga

SEQ ID NO: 13719 - RNA, 9879 nt, synthetic construct
  misc_feature 1..9879: note = derived and/or modified CDS sequence (opt3) from DENV-1__FJ882525__SS-prME
  source 1..9879: mol_type = other RNA
agcgtgaccatgctgctaatgcttatgcccacagcactggctttccacttgactacgcggggaggggaacctcatatgatcgtctccaagcaggaaaggggaaaatctttactgtttaagacctcagccggtgttaacatgtgcaccctagtggcaatggacctcggcgagttctgtgaagatactatgacctacaaatgcccacggattacagaagcggaaccggacgatgtagactgttggtgcaatgctaccgatacttgggtgacatatgggacctgtagtcagacgggagagcaccgccgagacaagcgtagcgtcgccctggcaccccatgtgggccttggtctggagactagaaccgaaacatggatgtcctctgagggggcctggaaacagatacagagggttgaaacttgggctttgcggcaccctggatttaccgtgatcgcactcttcctggcccatgctattggcacatcgatcacccagaagggcattatctttatactgctcatgttagtcacgccatcaatggccatgcgctgcgtggggatcggaagcagagatttcgttgagggtctgagtggcgcgacttgggttgacgtggtccttgagcacgggtcctgtgtgacaaccatggcaaaggataaacccactttggacattgaactgctaaagacagaggtgaccaaccctgccgtcctcaggaaactgtgcatcgaagctaagatttctaatacgaccacagatagccggtgtccaactcaaggagaggccacccttgttgaagaacaggacgcaaactttgtgtgccgccgaacattcgtagatagaggctggggtaatgggtgtggactgtttggcaaaggctccttgatcacttgcgctaagttcaagtgcgtgaccaaactcgaggggaagacagtccagtacgaaaacctgaaatattcagtgatagttaccgtgcacactggagaccagcatcaagtcggtaatgagagtacggaacacggcacaaccgccactattacaccccaggcgcctagcacagagatccagttaaccgactacggggccctgactctcgattgttctccaaggacaggacttgactttaacgaaatggtgctgttgacgatgaaggagaaatcctggctagtacataagcagtggttcctggatctcccgctgccctggacctcaggcgcaagcacaagtcaagagacatggaatcggaaagaccttctggttacctttaagacagctcacgccaagaaacaggaagtggtcgtgttgggttctcaggagggggctatgcacactgccctcaccggcgcaacggaaattcaaacctccggaacaactaccatcttcgccggccatctgaagtgccgtttaaaaatggataagctgacactaaaagggatgagctatgtcatgtgtactggatcgttcaagctcgagaaggaagtggctgagacccagcacggtacggttctggtgcagatccgctacgagggcacagacgcgccttgcaaaattccattttctacccaggatgaaaagggggtaactcaaaacggaagacttataacagcaaatcccatcgtcaccgacaaagagaagcctgtgaacattgaagccgagccacccttcggcgagtcctatatcgttataggtgctggggaaaaagccttgaagctgtcatggtttaagaaaggcagtagcattggaaagatgttcgaggcaactgccaggggcgctcggcgaatggccatcctcggggataccgcatgggactttggatccatcggtggcgtgttcacatctgtcgggaaactggtgcatcagatttttggaacggcgtacggcgtacttttcagcggtgtgtcatggaccatgaagatcgggattggcgttctgttgacttggctcggactgaatagtcgctccactagcttatctatgacctgtatagctgtcggcctggtgacactatacctcggggtgatggtccaggccgattcaggatgcgttatcaactggaaaggcagagaactgaagtgtggtagtgggatttttgtgactaatgaggtgcacacctggacggaacagtataagttccaagcagacagcccgaaaaggctttccgccgctatcggaaaggcctgggaggagggcgtatgcggtatccggtctgcaacacgcttggaaaacattatgtggaaacagatatcgaacgagctgaatcatatcctcctggaaaacgacatgaagtttaccgtcgtggttggcgatgtggctgggattttagcccagggcaagaagatgatcagacctcagcccatggagtacaaatatagctggaagtcctggggcaaggcgaaaattatcggggccgacgtccaaaatactaccttcataatcgatggaccaaacacacctgaatgtcccgacgatcagagggcttggaatatttgggaggtggaggactacggctttggtatcttcactaccaacatttggctgaaacttcgtgattcatatacacaggtttgcgaccaccggttgatgagtgcagccatcaaagattctaaggctgtgcacgccgacatggggtactggatagaaagcgagaaaaatgaaacgtggaagctcgcacgagcgtccttcattgaggtaaagacctgtatctggccaaaatcacatactctgtggagcaacggagtcctagaatctgagatgattatccccaagatatatggcggtcctatctcccagcacaattacagaccaggctactttacacaaaccgccgggccgtggcatctgggaaaactcgagctggatttcgacctttgcgaaggcactacagtggtggtcgatgagcactgcgggaacaggggacccagtttgcgcaccacgactgttaccggcaagattatccacgaatggtgttgccggagctgtacactgcctccattaagatttaaaggtgaggacgggtgctggtatggaatggagattaggcccgtgaaggaaaaggaggaaaatctcgtaaaatctatggtgtccgctggctcaggtgaggtcgacagtttcagcctgggccttctgtgtatctcgataatgattgaagaggtgatgcgctcccgatggtctcggaagatgttgatgaccgggactctcgccgtatttttcctgctaatcatcggacagctgacatggaacgatctcattcgtctgtgcatcatggtgggcgcaaatgctagcgacagaatggggatgggaaccacataccttgccttgatggcaacttttaaaatgaggcctatgttcgccgtcggcctgttatttcgccggctcacctcaagagaggtgctgcttctgacgattggtctaagtctcgttgcttccgtggaactgccaaactctttggaggaactgggggatggattagcgatgggcataatgatcctcaagctgcttacagacttccagagccatcaactgtgggccaccttgctctccctgacttttattaaaaccacattctcactacactatgcatggaagactatggctatggtcctgagcatcgtaagtctttttcccctctgtctgtctaccacgtcccagaagacaacctggttgccggtgctgttaggcagcctcgggtgcaaacctctgactatgttccttattgccgagaataagatctggggaaggcgatcgtggccactgaacgaaggtataatggccgttggcatcgtgtcaattttgctctctagtctgctcaagaatgatgtccccctggctgggcctcttatcgcaggaggcatgctcattgcctgttacgtgatctccggtagctctgcggacctgagcttggagaaggctgccgaggtatcctgggaagaggaagcagagcattcaggggccagtcacaatatattagtggaagtccaggatgacggaacaatgaaaattaaggatgaggagcgcgacgataccctgactatcctcctgaaagctacacttctggcagttagcggcgtgtatcccttgtctatcccagccaccctattcgtgtggtacttttggcagaagaagaaacaacggtccggcgtcctgtgggacacgccttcacccccagaagtggagagagcggttctcgatgacgggatttataggataatgcagcgtggactgcttggtcgcagtcaggtaggcgtgggggtcttccaggaaaacgtgtttcatactatgtggcacgttacccggggagctgtgttaatgtaccaaggcaagagactggagccgagctgggcctccgtcaaaaaggacctcatctcttacggtgggggatggaggttgcagggctcgtggaatacaggcgaggaagtgcaggtaattgcagtcgagcctgggaaaaaccccaagaatgtgcagaccgccccaggaacattcaagactagcgaaggtgaggttggcgctatcgccctggattttaaacccgggacctcaggatcccctattgtgaaccgagaaggcaagatcgtcggtctctatgggaatggagtggttacgacaagtggcacttacgtgtctgcaatagctcaagccaaagcgagccaggagggcccactgcccgagatcgaagacgaggtcttccggaagcgcaaccttaccattatggatctgcaccctgggtccggaaaaacaagaaggtatttgccggccatcgtgcgggaagcaattaagcgaaagctaagaaccctgatcctcgctccaactcgcgtagtggcctcagagatggctgaagcattaaaaggtatgcccataaggtaccagaccacagccgttaagtctgagcatacgggcaaagagattgtcgacctgatgtgccacgccacttttaccatgcgtcttctgagccctgtgcgggtgccaaattataacatgatcatcatggatgaagctcatttcacagaccccagttccattgcggcaagagggtacatcagcaccagggtcggaatgggcgaggccgctgccatatttatgactgcaacacctccgggttctgtagaagccttcccccaatcaaatgctgtgattcaggatgaggaacgcgacatcccagagcgatcctggaacagtgggtatgagtggattaccgattttcctggaaagacggtttggttcgtgcccagcatcaaatcgggcaatgacatagcgaactgtctcagaaagaatggcaagcgggtcattcagttgtctaggaaaactttcgatacagaataccagaagaccaaaaacaacgactgggactacgtggttaccactgatatctccgagatgggggccaattttcgcgcagaccgtgtgatcgatccaagacggtgcctgaagcctgtcattctcaaagacggacccgaaagggtgatcctggctggtccaatgccggtaacagtggccagcgcagcccaacgccgaggcagaattgggcggaaccacaataaggagggagatcagtatatatacatgggccagcctcttaacaatgacgaggatcatgctcactggaccgaagccaagatgctactggacaacatcaatacacccgagggtattatcccagcgttgttcgaacccgagagggaaaaatcagcagccatcgatggggagtatcgcttaagaggcgaggctaggaagacttttgttgaactgatgcggcgtggagacctccctgtctggctgagttacaaagtggcctctgagggcttccagtattccgatcgccgatggtgctttgacggggaaagaaacaatcaagtgcttgaggaaaacatggatgtcgagatttggacgaaggagggagaaaggaaaaagctgcggccacgctggctcgacgctagaacctacagcgaccccttggcactgagggagttcaaagaatttgccgctggtcggcgatcagttagtggcgatctaatactggagatcgggaagctccctcagcaccttacacagagagcccagaatgcactggacaacttagtgatgttgcataatagcgaacaaggaggccgcgcgtataggcacgccatggaggagctgccggatactattgaaaccctcatgctgcttgctctgatcgccgtactcacaggtggggtgaccttgttctttctgtccggccggggattaggcaagacttctattgggctactgtgtgtcatggcaagctccgtgctcctttggatggcttcagttgagccacattggatcgccgcatctataatcctggagttctttttgatggtgctgctcattcccgagcctgaccgtcagagaacgccccaggataaccagctggcctacgtcgtaatcggacttctcttcatgattctgaccgtggctgcgaatgagatgggtttgctggaaacaactaaaaaggacttaggcatcgggcacgttgccgtggagaaccaccatcacgcagctatgctagatgtcgacctgcatccagccagtgcctggaccctctacgcagtggctacaaccataattactcctatgatgaggcacacaatcgaaaacacgaccgccaatatttcgcttactgcgatcgctaaccaagccgcaatactgatgggattggataaaggctggcccatcagcaagatggacattggtgtcccactgctcgccctggggtgctattcccaggtgaatcctcttacattaaccgctgcagttctgatgctcgtggcccattacgcgatcattggcccgggattgcaggctaaagccacccgcgaggcacaaaagcggacagccgctggcatcatgaagaaccccactgtagatgggatagtggccattgacctggatccagtcgtttatgacgcaaaatttgaaaagcagctaggacagatcatgctgctcatcctttgtacgtctcagattctgttgatgcgaaccacatgggctctgtgcgagtcaatcactctcgccaccggccctctgacaaccttatgggagggtagccccgggaaattctggaatactacgatagcggtgtccatggccaacattttcagaggaagttaccttgcaggcgctggtctggccttttctctcatgaaaagcctaggcgggggaaggcgcggcacaggggcacaaggagaaaccctgggcgagaaatggaagcggcagttgaatcagctgtcaaagtccgagttcaacacttataaaagaagtggtatcatggaggtcgaccgtagcgaagctaaggaggggctcaaaaggggagagaccacaaagcacgccgtgtctcggggcactgccaaacttcgctggtttgtagaacgaaatttcgtgaagccagagggtaaggttattgatctgggctgtgggagaggaggctggtcctactattgcgcggggttgaaaaaggtgaccgaagtcaaaggatacacaaagggcggtcctgggcacgaggaacccatcccgatggctacgtacggatggaacctggtgaaactccattcaggcaaggacgtctttttcataccacctgagaaatgtgataccttactgtgcgacatcggcgagagctcgcccaatccaactattgaagaggggaggacacttcgggtgctgaagatggttgaaccctggctacgcggaaaccagttttgtatcaagattctcaatccttatatgccgtctgtagtggagaccctggagagaatgcaaaggaaacacggtggcatgttggtccgaaaccccctgagtagaaattccactcatgaaatgtactgggtgagctgcgggacaggaaacatcgtttcagcagtgaatatgacctcccgtatgctccttaacagattcacgatggcccaccgcaagccaacctatgagagggatgtcgacctgggcgctggtacacggcacgtggccgtagaacctgaggtggcaaacttagatattatcgggcagagaatagaaaatattaaacatgagcacaagtctacttggcattacgacgaggataacccctataaaacctgggcctaccacggaagctatgaagttaagcctagtggctccgctagctctatggtcaatggcgtggtgaagctgttgacaaaaccatgggacgtcatccccatggttactcagatcgcgatgaccgatacaaccccttttgggcagcaacgcgtgttcaaggagaaagtagacactaggacgccaaaggccaaacgaggaacagcacagattatggaagtgaccgctaagtggctctggggttttctgtcacggaacaagaaacccagaatatgtactagggaggagttcacccgcaaggtccgtagtaatgccgcaatcggcgccgtgtttgttgacgagaaccagtggaactccgctaaagaggccgtggaagatgagcggttctgggacctagtccatagagaaagggagcttcacaagcaagggaaatgcgcgacatgcgtgtacaacatgatgggaaagcgcgaaaagaaactgggcgagttcggtaaggcaaaagggagccgagccatttggtacatgtggctcggagctcggtttctggagttcgaagccttgggctttatgaatgaggatcactggttctctagagaaaactcgctgtcaggcgtagagggggagggactccataaacttggttatatcctgagggacattagcaaaatcccgggcgggaatatgtacgcagatgacacggctggatgggatacccgcataactgaagacgatttacagaacgaggccaagatcacagacattatggaacctgagcacgctctgttggccaaatccatctttaagctcacctatcagaataaggttgtgagagtccagcggccagccaagaacggcactgtgatggatgtgattagtaggcgtgaccaacgaggttctgggcaggtcggaacatacggcctgaataccttcacaaacatggaagcgcagctaatccgccagatggagagcgagggcatattttccccctcagaacttgagactcctaacctggccgggagagttctcgattggctggaaaagcatggagtggagcggttgaaaaggatggctattagtggtgacgactgtgtagtgaagccaatcgatgaccgcttcgccaccgcattaacggctctgaatgatatgggcaaagtcagaaaggacatcccccaatgggaaccgtctaaggggtggaacgattggcaacaggtgcctttttgcagccaccacttccatcagctcattatgaaagacggacgggagatagttgtgccctgtaggaatcaagatgagcttgtcggccgagcccgtgtgtcccagggtgcagggtggtcactgagagaaaccgcctgcctaggaaagagctatgcgcagatgtggcagctgatgtactttcaccgccgggacctcaggttggctgccaacgcaatctgttctgccgtaccagttgattgggtgcctacatccagaactacctggagtattcatgctcaccatcaatggatgacaactgaggacatgctgagcgtctggaatcgcgtgtggatcgaagagaacccctggatggaagataaaacccacatttcgtcctggggcgacgttccatatcttggcaagcgggaggaccagtggtgcgggtctctgatcggactcacggccagggcaacatgggctaccaatatacaggtggccatcaaccaagtccgaagattaattggtaatgagaactacctggattacatgacttcaatgaaacggttcaagaatgaaagcgaccccgagggcgcgttgtggtga

SEQ ID NO: 13720 - RNA, 9879 nt, synthetic construct
  misc_feature 1..9879: note = derived and/or modified CDS sequence (opt3) from DENV-1__FJ882526__SS-prME
  source 1..9879: mol_type = other RNA
agcgtgaccatgctgctcatgcttatgcccacagcactggctttccacttgactacgagaggaggggaacctcatatgatcgtctccaagcaggaaagggggaaatctttactgtttaagacctcagccggtgttaacatgtgcacactaattgccatggacctcggcgagttctgtgaagatactatgacctacaaatgcccacggataacagaagcggaaccggacgatgtggactgttggtgcaatgctaccgatacttgggtaacatatgggacctgtagtcaaacgggagaacaccgccgagacaagcgttccgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaggacgcaaactttgtttgccgccgaacattcgtggatagaggctggggtaatgggtgtggactgtttggcaaaggctccttgataacttgcgctaagttcaagtgcgtaaccaaactcgaggggaagattgtgcagtacgaaaacctgaaatattcagtcatcgtgacagttcacaccggagaccagcatcaagtgggtaatgagagtactgaacacggcacgacagccaccattactccccaggcgcctagcaccgagatccagttaacagactacggggccctgaccctcgattgttctccaaggactggacttgactttaacgaaatggtcctgttgacaatgaaggagaaatcctggctagtgcataagcagtggttcctggatctcccgctgccctggacgtcaggcgcaagcaccagtcaagagacttggaatcggaaagaccttctggtaacatttaagaccgctcacgccaagaaacaggaagttgtggtcttgggttctcaggagggggctatgcacacagccctcactggcgcaaccgaaatccaaacgtccggaaccacaactattttcgccggccatctgaagtgccgtttaaaaatggataagctgaccctaaaagggatgagctatgtgatgtgtacaggatcgttcaagctcgagaaggaagtcgctgagactcagcacggtaccgtgctggttcagataaaatacgagggcacggacgcgccttgcaagatcccattttctacacaggatgaaaaaggggtgacccaaaacggacgccttattactgcaaatcccatcgtaacagacaaggagaaacctgtcaacatagaagccgagccacccttcggcgagtcctatattgtgatcggtgctggggaaagagccttgaagctgtcatggtttaagaaaggcagtagcatcggaaagatgttcgaggcaaccgccaggggcgctcggcgaatggccattctcggggatactgcatgggactttggatccatcggtggcgttttcacctctgtggggaaactggtccatcagatttttggaacagcgtacggcgtgcttttcagcggtgtatcatggacgatgaagatagggatcggcgtgctgttgacctggctcggactgaatagtcgctccactagcttatctatgacatgtattgctgttggcctggtcaccctatacctcggggtgatggtgcaggccgattcaggatgcgtcatcaactggaaaggcagagaactgaagtgtggtagtgggatctttgttacaaatgaggtgcacacttggaccgaacagtataagttccaagcagacagcccgaaaaggctttccgccgctattggaaaggcctgggaggagggcgtgtgcggtatacggtctgcaacgcgcttggaaaacatcatgtggaaacagatttcgaacgagctgaatcatatcctcctggaaaacgacatgaagtttacagtagtcgtgggcgatgttgctgggattttagcccagggcaagaagatgatcagacctcagcccatggagtacaaatatagctggaagtcctggggcaaggcgaaaataatcggggccgacgtgcaaaataccactttcattatcgatggaccaaacacccctgaatgtcccgacgatcagagggcttggaatatttgggaggtcgaggactacggctttggtatcttcacaactaacatatggctgaaacttcgtgattcatatacccaggtgtgcgaccaccggttgatgagtgcagccattaaagattctaaggctgttcacgccgacatggggtactggatcgaaagcgagaaaaatgaaacatggaagctcgcacgagcgtccttcattgaggtgaagacgtgtatctggccaaaatcacataccctgtggagcaacggagtactagaatctgagatgataatccccaagatttatggcggtcctatctcccagcacaattacagaccaggctactttactcaaacagccgggccgtggcatctgggaaaactcgagctggatttcgacctttgcgaaggcaccactgtcgtggtggatgagcactgcgggaacaggggacccagtttgcgcacaaccacggtcactggcaagattatccacgaatggtgttgccggagctgtaccctgcctccattaagatttaaaggtgaggacgggtgctggtatggaatggagataaggcccgttaaggaaaaggaggaaaatctcgtgaaatctatggtatccgctggctcaggtgaggtggacagtttcagcctgggccttctgtgtatttcgatcatgatcgaagaggtcatgcgctcccgatggtctcggaagatgttgatgacagggaccctcgccgtgtttttcctgctaattatgggacagctgacttggaacgatctcatccgtctgtgcattatggttggcgcaaatgctagcgacagaatggggatgggaacaacctaccttgccttgatggcaacatttaaaatgaggcctatgttcgccgtgggcctgttatttcgccggctcacttcaagagaggtcctgcttctgaccataggtctaagtctcgtggcttccgttgaactgccaaactctttggaggaactgggggatggattagcgatgggcatcatgattctcaagctgcttacggacttccagagccatcaactgtgggccacattgctctccctgacctttatcaaaactaccttctcactacactatgcatggaagacaatggctatggtgctgagcattgtcagtctttttcccctctgtctgtctactacctcccagaagacgacatggttgccggtactgttaggcagcctcgggtgcaaacctctgaccatgttccttatcgccgagaataagatatggggaaggaaatcgtggccactgaacgaaggtatcatggccgtgggcattgtttcaatcttgctctctgctctgctaaagaacgatgtgcccctggcagggcctcttattgccggaggcatgctcatcgcgtgttacgtcataagtggttccagcgctgacctgtctttggagaaagccgcagaggtgagctgggaagaggaagccgagcattccggggcttcacacaatattttagtagaagtgcaggatgacggaactatgaagatcaaagatgaggagcgagacgatacactgaccatcctcctgaaggcaactcttctggccgtcagtggcgtttatcccttgagcattccagcgacactattcgtgtggtacttttggcagaagaaaaagcaacgctctggcgtgctgtgggacaccccttcacccccagaagtcgagcgggctgtgctcgatgacgggatatatagaatcatgcagaggggactgcttggtcgtagccaggttggcgtaggggtgttccaggaaaacgtctttcatacgatgtggcacgtgactcgcggagccgttttaatgtaccaaggcaaacggctggagccgagttgggcaagcgtgaagaaagacctcatttcctacggtgggggatggagattgcagggctcttggaataccggcgaggaagtccaggtgatcgccgtagagcctgggaagaaccccaagaatgtccagacagctccaggaaccttcaaaacatcggaaggtgaggtgggcgccattgcactggattttaagcccgggactagcggatcacctatcgttaacagggaaggcaaaatagtgggtctctatgggaatggagtcgtgaccacgtccggcacatacgttagtgctatcgcccaagcgaaggcctctcaggagggcccactgcccgagattgaagacgaggtgttccgaaaacggaaccttactatcatggatctgcaccctgggagcggaaagacccgcagatatttgccggcaattgtcagggaagctatcaagcggaaactacgaacactgatactcgccccaaccagagtggtagcttccgagatggcagaagccttaaagggtatgcccattcgctaccagactaccgccgtgaaatcagagcatacaggcaaggagatcgttgacctgatgtgccacgctacgtttactatgaggcttctgtctcctgtccgtgtgccaaattataacatgatcattatggatgaagcgcatttcaccgaccccagcagtatcgcagcccgggggtacatatccacaagagtgggaatgggcgaggctgccgcaatttttatgaccgccactcctccgggtagcgtcgaggctttcccccaatctaatgcggtaatccaggatgaggaaagggacattccagagcgctcatggaactccgggtatgagtggatcacagattttcctggaaaaaccgtgtggttcgttcccagtataaagagcggcaatgacattgccaactgtctccgaaagaatggcaaaagagtgatccagttgtcgcggaagacgttcgatactgaataccagaaaacaaagaacaacgactgggactacgtcgtgaccaccgatatctctgagatgggggcaaattttagggctgaccgcgttattgatccacgtagatgcctgaaacctgtgatcctcaaggacggacccgaacgggtcattctggccggtccaatgccggtgactgtagcatccgccgctcaaaggcgcggccgaatagggagaaaccacaataaggagggagatcagtatatctacatgggccagcctcttaacaatgacgaggatcatgcccactggacagaagcgaaaatgctactggacaacattaatacccccgagggtatcatcccagcattgttcgaacccgagcgggaaaagagcgccgctattgatggggagtataggttacgcggcgaggccagaaaaacatttgtggaactgatgaggcggggagacctccctgtttggctgtcatacaaggtcgctagtgagggcttccagtattctgatcgtcgctggtgctttgacggggaacgaaacaatcaagtgcttgaggaaaacatggatgtggagatatggactaaagagggagaaagaaagaaactgaggccacggtggctcgacgcacgcacgtactccgaccccttggccctgagagagttcaaggaatttgctgccggtaggcggagcgtctcaggcgatctaatcctggagattgggaagctccctcagcaccttacccagcgagcacagaatgcgctggacaacttagttatgttgcataatagtgaacaaggaggcagagcctatcgccacgctatggaggagctgccggatacaatcgaaactctcatgctgcttgccctgattgcagtgctcaccggtggggtaacattgttctttctgagcggcaggggattaggcaaaacctccatcgggctactgtgtgtgatggcttctagcgtcctcctttggatggcctccgtggagccacattggatagcagcctcaatcattctggagttctttttgatggttctgctcatccccgagcctgaccggcagcgtactccccaggataaccagctggcttacgtggtcattggacttctcttcatgatcctgacggtagcggccaatgagatgggtttgctggaaaccacaaagaaagacttaggcatagggcacgtggcagttgagaaccaccatcacgctgccatgctagatgtggacctgcatccagcctctgcatggactctctacgctgtcgccaccacaattatcacccctatgatgagacacactattgaaaacacaacggcgaatatcagtcttaccgctatagccaaccaagcagccatcctgatgggattggataagggctggcccatttcgaaaatggacatcggtgtgccactgctcgctctggggtgctatagccaggtcaatcctcttactttaacagcagccgtgctgatgctcgttgcgcattacgctattatcggcccgggattgcaggccaaggcaaccagggaggcccaaaagcgcaccgctgccggcataatgaaaaaccccacagtggatgggattgtagcaatcgacctggatccagtggtctatgacgctaagtttgaaaaacagctaggacagatcatgctgctcattctttgtacttcccagatcctgttgatgcggacgacctgggccctgtgcgagtctataacactcgcgactggccctctgaccacattatgggagggttcacccgggaagttctggaataccactattgccgttagcatggcaaacatcttccgaggatcctaccttgctggcgccggtctggcatttagtctcatgaaatctctaggcgggggaagaaggggcacgggggctcaaggagaaacactgggcgagaagtggaagcgccagttgaatcagctgagcaaatcagagttcaacacctataagcggtccggtattatggaggtggacagaagtgaagccaaagaggggctcaagcgtggagagactaccaaacacgccgtcagcaggggcacagcgaaacttcggtggtttgtggaacgcaatctggtaaagccagagggtaaagtgatcgatttgggctgtgggcgaggaggctggtcttactattgcgctgggctgaagaaagttactgaagtgaagggatacaccaaaggcggtcctgggcacgaggaacccataccgatggcaacatacggatggaacctcgtcaagttacattccggcaaagacgtgttctttatcccacctgagaagtgtgatacgctgctttgcgacattggcgagtcaagccccaatccaaccatcgaagaggggagaactctgagggtcctaaagatggtggaaccctggctccggggaaaccagttctgtattaaaatcctgaatccttatatgccgtcggttgtagagacattggagcaaatgcagcgcaagcacggtggcatgctggtgagaaaccccctctctaggaatagtacccatgaaatgtactgggtctcctgcgggactggaaacattgtgagcgccgttaatatgacatcacgaatgcttctgaaccggtttaccatggctcaccgtaaaccaacgtatgagagagatgtggacttaggcgccggtacccgccacgtcgcagtggaacctgaggtagccaacctggatatcatagggcagaggattgaaaatatcaagcatgagcacaaatccacatggcattacgacgaggataacccctataagacttgggcttaccacggatcttatgaagtgaagcctagcggcagtgcgtccagcatggttaatggcgtcgtgaaattgctcaccaagccatgggacgtgatccccatggtcacacagattgccatgactgataccacacctttcgggcaacagcgggtttttaaagagaaggtggacaccagaactccaaaagcaaagcgcggaacggctcagataatggaagtaacagccaagtggctgtggggtttcctatctaggaacaaaaagccccgaatctgtacccgggaggaatttactagaaaagtgaggtcaaatgcagccattggcgctgtcttcgtggacgagaaccaatggaatagtgccaaggaggcggttgaagatgagcgcttttgggaccttgtgcatcgtgaacgggagctgcacaaacaggggaagtgcgcaacctgcgtctacaacatgatgggaaagagagagaagaagctcggcgagttcggtaaagccaaggggtccagggctatctggtacatgtggctgggagcccgcttcttggagtttgaagcactgggcttcatgaatgaggatcactggtttagccgagaaaactctctctcgggcgtggagggggagggacttcataaactgggttatattttacgggacatctcaaagataccgggcgggaatatgtacgctgatgacacagccggatgggatacgagaatcaccgaagacgatctgcagaacgaggctaaaattactgacatcatggaacctgagcacgccttgctcgcaaagagcattttcaagctgacatatcagaataaagtagttagggtgcaacgcccagcgaagaacggcaccgtcatggatgtgatctccagacgggaccagaggggtagtggacaggtgggaacttacggcctaaatacatttaccaacatggaagcccagcttatacgtcaaatggagtctgagggcattttcagcccctccgaactggagacacctaacctcgctgggcgagtcctggattggttggaaaaacatggagttgagcgcttaaagagaatggccatctcaggtgacgactgtgtggtaaaaccaatcgatgaccggtttgcaactgctctgaccgccctcaatgatatgggcaaggtgaggaaggacattccccagtgggaaccgagtaaagggtggaacgattggcagcaggtccctttctgctctcaccactttcatcaacttataatgaaggacggacgcgagatcgtggttccctgtagaaatcaggatgagctggtgggccgggcaagggtcagccagggtgccgggtggtccctacgagaaacggcgtgcctgggaaaatcatatgctcagatgtggcaactcatgtacttccaccgtagagacttgcgcctggccgcaaacgccatttgtagcgctgtgccagtagattgggttcctacctctcggacaacttggtccatccatgcccaccatcagtggatgaccacagaggacatgcttagtgtgtggaatagggtctggattgaagagaacccctggatggaagataagactcacatcagctcgtggggcgacgtgccatatctgggcaaaagagaggaccagtggtgcgggtccctcataggattaaccgcacgcgctacgtgggccacaaatatccaagttgcgattaaccaggtgcggaggctgatcggtaatgagaactacttggattacatgacctctatgaagcgatttaagaatgaatcagaccccgagggcgctctgtggtga

SEQ ID NO: 13721 - RNA, 9879 nt, synthetic construct
  misc_feature 1..9879: note = derived and/or modified CDS sequence (opt3) from DENV-1__FJ882527__SS-prME
  source 1..9879: mol_type = other RNA
agcgtgacaatgctgctcatgcttatgcccacagcactggctttccacttgactacgagaggcggggaacctcatatgatcgtctccaagcaggaaagggggaaatctttactgtttaagacctcagccggtgttaacatgtgcacactaattgccatggacctcggcgagttctgtgaagatactatgacctacaaatgcccacggataacagaagcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaagacgcaaactttgtttgccgccgaacattcgtggatagaggctggggtaatgggtgtggactgtttggcaaaggctccttgataacttgcgctaagttcaagtgcgtaaccaaactcgaggggaagacagtgcagtacgaaaacctgaaatattcagtcattgtgaccgttcacactggagaccagcatcaagtgggtaatgagagtacggaacacggcacaaccgccactatcacaccccaggcgcctagcacagagattcagttaaccgactacggggccctgactctcgattgttctccaaggacaggacttgactttaacgaaatggtcctgttgacgatgaaggagaaatcctggctagtgcataagcagtggttcctggatctcccgctgccctggacctcaggcgcaagcacaagtcaagagacatggaatcggaaagaccttctggtaacctttaagacagctcacgccaagaaacaggaagttgtggtcttgggttctcaggagggggctatgcacactgccctcaccggcgcaacggaaatccaaacctccggaacaactaccatcttcgccggccatctgaagtgccgtttaaaaatggataagctgacactaaaagggatgagctatgtgatgtgtactggatcgttcaagctcgagaaggaagtcgctgagacccagcacggtacggtgctggttcagattaaatacgagggcacagacgcgccttgcaagataccattttctacccaggatgaaaaaggggtgactcaaaacggacgccttatcacagcaaatcccattgtaaccgacaaggagaaacctgtcaacatcgaagccgagccacccttcggcgagtcctatatagtgattggtgctggggaaaaggccttgaagctgtcatggtttaaaaagggcagtagcatcggaaaaatgttcgaggcaactgccagaggcgctaggcggatggccatcctcggggataccgcatgggactttggatccattggtggcgttttcacatctgtggggaagctggtccatcagatctttggaacggcgtacggcgtgcttttcagcggtgtatcatggaccatgaaaattgggataggcgtgctgttgacttggctcggactgaatagtcgatccactagcttatctatgacctgtatcgctgttggcctggtcacactatacctcggggtgatggtgcaggccgattcaggatgcgtcattaactggaagggccgcgaactgaagtgtggtagtgggatctttgttactaatgaggtgcacacctggacggaacagtataaattccaagcagacagcccgaagagactttccgccgctatcggaaaagcctgggaggagggcgtgtgcggtattaggtctgcaacacggttggaaaacataatgtggaagcagatctcgaacgagctgaatcatattctcctggaaaacgacatgaaatttaccgtagtcgtgggcgatgttgctgggatcttagcccagggaaagaaaatgattcgccctcagcccatggagtacaagtatagctggaagtcctggggcaaagcgaagatcataggggccgacgtgcaaaatactaccttcatcattgatggaccaaacacacctgaatgtcccgacgatcagagagcttggaatatctgggaggtcgaggactacggctttggtattttcactaccaacatctggctgaaacttagggattcatatacacaggtgtgcgaccaccgtttgatgagtgcagccataaaggattctaaagctgttcacgccgacatggggtactggattgaaagcgagaagaatgaaacgtggaagctcgcacgggcgtccttcatcgaggtgaaaacctgtatttggccaaagtcacatactctgtggagcaacggagtactagaatctgagatgatcatacccaaaatctatggcggtcctatttcccagcacaattaccgaccaggctactttacacaaaccgccgggccgtggcatctgggaaagctcgagctggatttcgacctttgcgaaggcactacagtcgtggtggatgagcactgcgggaacagaggacccagtttgaggaccacgactgtcaccggcaaaatcattcacgaatggtgttgccgcagctgtacactgcctccattacggtttaagggtgaggacgggtgctggtatggaatggagatcagacccgttaaggaaaaagaggaaaatctcgtgaagtctatggtatccgctggctcaggtgaggtggacagtttcagcctgggccttctgtgtatatcgattatgatcgaagaggtcatgaggtcccgctggtctcgaaaaatgttgatgaccgggactctcgccgtgtttttcctgctaatcatgggacagctgacatggaacgatctcattcggctgtgcatcatggttggcgcaaatgctagcgaccgtatggggatgggaaccacataccttgccttgatggcaacttttaagatgagacctatgctggccgtgggcttactcttcaggcgcctgacctcacgggaggtccttctgctaacgattggtctcagtctggtggcttccgttgaattgccaaactctctggaggaattaggggatggactcgcgatgggcataatgatcctgaaacttctgacagactttcagagccatcaattgtgggccaccctcctgtccctaactttcattaagaccacattttcactgcactatgcatggaagactatggctatggtgcttagcatcgtcagtctcttccccctgtgtttgtctaccacgtcccagaaaacaacctggctgccggtattactcggcagcctggggtgcaagcctcttgccatgtttctgattgccgagaataaaatctggggaagaaagtcgtggccattgaacgaaggtataatggctgtgggcatcgtttcaattctcctgtctagtctactgaaaaacgatgtgccccttgcagggcctctcatcgccggaggcatgctgattgcgtgttacgtcatctccggtagctctgctgacttgagcttagagaaggccgcagaggtgtcctgggaagaggaagccgagcattcaggggctagtcacaatatactggtagaagtgcaggatgacggaactatgaaaattaaggatgaggagagggacgatacactcaccatcctgcttaaggcaactctgttggccgtcagcggcgtttatcccctatctatcccagcgacactgttcgtgtggtacttctggcagaaaaagaaacaacgatccggcgtgctctgggacaccccttcacccccagaagtcgagcgcgctgtgctggatgacgggatttatcggataatgcagagaggacttttaggtaggagtcaggttggcgtaggggtgtttcaggaaaacgtcttccatacgatgtggcacgtgactcgtggagccgttctgatgtaccaaggcaagcgcctcgagccgagctgggcatccgtgaaaaaggacttgatctcttacggtgggggatggcggctgcagggctcgtggaataccggcgaggaagtccaggtgattgccgtagagcctgggaagaaccccaaaaatgtccagacagctccaggaacctttaagacaagcgaaggtgaggtgggcgccatcgcactcgatttcaaacccgggacttcaggatcccctattgttaacagagaaggcaagatcgtgggtctgtatgggaatggagtcgtgaccacgagtggcacatacgtttctgctatagcccaagcgaaagccagccaggagggcccacttcccgagatcgaagacgaggtgtttaggaagcgaaacctgactattatggatttgcaccctgggtccggaaagacccggcgctatctaccggcaatcgtcagagaagctattaaaaggaagctgcggacactcatcttagccccaacccgagtggtagcttcagagatggcagaagccctgaaaggtatgcccataagataccagactaccgccgtgaagtctgagcatacaggcaaagagattgttgaccttatgtgccacgctacgttcactatgcgcctgctcagccctgtcagggtgccaaattataacatgatcatcatggatgaagcgcattttaccgaccccagttccattgcagcccgtgggtacatcagcacacgggtgggaatgggcgaggctgccgcaatattcatgaccgccactcctccgggttctgtcgaggcttttccccaatcaaatgcggtaattcaggatgaggaaagagacatcccagagaggtcctggaacagtgggtatgagtggattacagatttccctggaaagaccgtgtggtttgttcccagcatcaagtcgggcaatgacatagccaactgtttgcgcaaaaatggcaagcgagtgattcagctgtctagaaaaacgttcgatactgaataccagaagaccaagaataacgactgggactacgtcgtgaccaccgatatctccgagatgggggcaaatttccgggctgacagggttatcgatccacgccgttgcctcaagcctgtgattctgaaggacggacccgaaagagtcatccttgccggtccaatgccggtgactgtagcaagcgccgctcaacggaggggccgcattgggcgaaaccacaataaagagggagatcagtatatatacatgggccagcctctaaacaatgacgaggatcatgcccactggacagaagcgaagatgctgttggacaacatcaatacccccgagggtattatcccagcattatttgaacccgagagagaaaaatcagccgctatcgatggggagtatcggctgaggggcgaggcccgcaagacattcgtggaactcatgagaaggggagacctgcctgtttggcttagttacaaagtcgcttctgagggctttcagtattccgatcggcgttggtgcttcgacggggaacgcaacaatcaagtgctggaggaaaacatggatgtggagatttggactaaggagggagaacgaaagaaactcagaccaaggtggttggacgcacggacgtacagcgaccccctggccctacgcgagtttaaagagttcgctgccggtagaaggtcagtcagtggcgatctgatactcgagatcgggaaacttcctcagcacctgacccagcgggcacagaatgcgttagacaacttggttatgctgcataatagcgaacaaggaggccgagcctatagacacgctatggaggagctcccggatacaattgaaactctgatgcttctggccctcatcgcagtgttgaccggtggggtaacactgtttttcttatccggccgcggactaggcaagacctctattgggctgctctgtgtgatggctagctccgtccttctgtggatggcctcagtggagccacattggatcgcagcctctataatcttggaatttttcctgatggttctcctgattcccgagcctgacaggcagcggactccccaggataaccagcttgcttacgtggtcatcggactcctgtttatgattttgacggtagcggccaatgagatgggtctgttagaaaccaccaagaaggacctaggcatcgggcacgtggcagttgagaaccaccatcacgctgccatgctggatgtggacctccatccagccagtgcatggactctttacgctgtcgccaccacaataattacccctatgatgcgtcacactatcgaaaacacaacggcgaatatttcgctgaccgctatcgccaaccaagcagccatattgatgggactggataaaggctggcccatcagcaagatggacattggtgtgccactcctggctcttgggtgctattcccaggtcaatcctttaactctgacagcagccgtgctcatgttggttgcgcattacgctatcattggcccgggactgcaggccaaggcaaccagagaggcccagaaaaggaccgctgccggcatcatgaagaaccccacagtggatgggatagtagcaattgacctagatccagtggtctatgacgctaaattcgaaaagcagctgggacagatcatgctccttatcctgtgtacttctcagattttgctgatgcgcacgacctgggccctctgcgagtcaatcacactggcgactggccctttaaccacactttgggagggtagccccgggaaattttggaataccactatagccgtttccatggcaaacattttccggggaagttacctggctggcgccggtctcgcattctctctaatgaaaagcctgggcgggggacgaagaggcacgggggctcaaggagaaacattgggcgagaagtggaaaaggcagctgaatcagctctcaaagtccgaatttaacacctataaacgcagtggtatcatggaggtggaccggagcgaagccaaggaggggcttaaaagaggagagactaccaagcacgccgtctctcgtggcacagcgaagctgaggtggttcgtggaacggaatttggtaaaaccagagggtaaggtgattgatctgggctgtgggcgcggaggctggtcctactattgcgctgggctcaaaaaggttactgaagtgaaaggatacaccaagggcggtcctgggcacgaggaacccatcccgatggcaacatacggatggaacttagtcaaactgcattcaggcaaggacgtgtttttcataccacctgagaagtgtgatacgcttctgtgcgacatcggcgagagctcgcccaatccaaccattgaagaggggcgaactctaagagtcctcaaaatggtggaaccctggctgaggggaaaccagttttgtatcaagattttgaatccttatatgccgtctgttgtagagacactggagcaaatgcagcggaaacacggtggcatgctcgtgcgcaacccccttagtagaaattccacccatgaaatgtactgggtcagctgcgggactggaaacatcgtgtcagccgttaatatgacatccaggatgctgttaaaccgattcaccatggctcaccggaagccaacgtatgagcgtgatgtggacctgggcgccggtaccagacacgtcgcagtggaacctgaggtagccaacttggatattatcgggcagcgcatagaaaatattaaacatgagcacaagtctacatggcattacgacgaggataacccctataagacttgggcttaccacggaagctatgaagtgaaacctagtggctccgcgagctctatggttaatggcgtcgtgaagctcctgaccaaaccatgggacgtgatccccatggtcacacagatcgccatgactgataccacaccttttgggcaacagagggttttcaaggagaaagtggacacccggactccaaaggcaaagagaggaacggctcagattatggaagtaacagccaaatggctatggggttttctttcacgcaacaagaaacccaggatatgtacccgagaggagttcactcggaaggtgagaagtaatgcagccatcggcgctgtctttgtggacgagaaccaatggaactccgccaaagaggcggttgaagatgagaggttctgggacctggtgcatcgcgaacgtgagctccacaagcaggggaagtgcgcaacctgcgtctacaacatgatgggaaaacgggaaaagaaactgggcgagtttggtaaggccaaagggagcagagctatttggtacatgtggttgggagccaggttcctggagttcgaagcactcggctttatgaatgaggatcactggttctctcgcgaaaactcgctttcaggcgtggagggggagggactgcataagttaggttatatcctgcgagacattagcaaaatcccgggcgggaatatgtacgctgatgacacagccggatgggatacgcggataaccgaagacgatttgcagaacgaggctaagatcactgacattatggaacctgagcacgccctcctggcaaagtccatctttaaactaacatatcagaataaggtagttagagtgcaaaggccagcgaaaaacggcaccgtcatggatgtgattagtcgcagagaccagcggggttctggacaggtgggaacttacggccttaatacattcaccaacatggaagcccagctgatcaggcaaatggagagcgagggcatattttccccctcagaactcgagacacctaacctggctgggcgtgtcttggattggttagaaaagcatggagttgagcgactgaaacgcatggccattagtggtgacgactgtgtggtaaagccaatcgatgacagattcgcaactgctctcaccgcccttaatgatatgggcaaggtgcggaaagacatcccccagtgggaaccgtctaaggggtggaacgattggcagcaggtccctttttgcagccaccacttccatcaactgattatgaaagacggaagggagatagtggttccctgtcgcaatcaggatgagctagtgggcagagcacgggtctcccagggtgccgggtggtcactgagggaaacggcgtgcctcggaaagagctatgctcagatgtggcaattgatgtactttcaccgacgtgacctgagacttgccgcaaacgccatctgttctgctgtgccagtagattgggttcctacctcccgcacaacttggagtattcatgcccaccatcagtggatgaccacagaggacatgctgagcgtgtggaatcgggtctggatcgaagagaacccctggatggaagataaaactcacatttcgtcctggggcgacgtgccatatctcggcaagagggaggaccagtggtgcgggtctttaatcggactgaccgcaagagctacgtgggccacaaatatacaagttgcgatcaaccaggtgcgccggttgattggtaatgagaactacctggattacatgacctcaatgaagaggttcaaaaatgaaagcgaccccgagggcgctctctggtga

SEQ ID NO: 13722 - RNA, 9879 nt, synthetic construct
  misc_feature 1..9879: note = derived and/or modified CDS sequence (opt3) from DENV-1__FJ882529__SS-prME
  source 1..9879: mol_type = other RNA
agcgtgaccatgctgctcatgcttatgcccacagccctggctttccacttgactacgagaggaggggaacctcatatgatcgtctccaagcaggaaaggggaaaatctttactgtttaagacctcagccggtgttaatatgtgcacactaattgccatggacctcggcgagttctgtgaagatactatgacctacaaatgcccacggataacagaagcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggttgacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaagacgcaaactttgtttgccgccgaacattcgtggatagaggctggggtaatgggtgtggactgtttggcaaaggctccttgataacttgcgctaagttcaagtgcgtaaccaaactcgaggggaagattgtgcagtacgaaaacctgaaatattcagtcatcgtgacagttcacaccggagaccagcatcaagtgggtaatgagagtactgaacacggcacgacagccaccattactccccaggcgcctagcaccgagatccagttaacagactacggggccctgaccctcgattgttctccaaggactggacttgactttaacgaaatggtcctgttgacaatgaaggagaaatcctggctagtgcataagcagtggttcctggatctcccgctgccctggacgtcaggcgcaagcaccagtcaagagacttggaatcggcaggaccttctggtaacatttaaaaccgctcacgccaagaagcaggaagttgtggtcttgggttctcaagagggggctatgcacacagccctcactggcgcaaccgaaatccagacgtccggaaccacaactattttcgccggccatctgaaatgccgtttaaagatggataaactgaccctaaaggggatgagctatgtgatgtgtacaggatcgttcaaactcgagaaggaagtcgctgagactcagcacggtaccgtgctggttcagataaagtacgagggcacggacgcgccttgcaaaatcccattttctacacaagatgaaaagggggtgacccagaacggacgccttattactgcaaatcccatcgtaacagacaaagagaagcctgtcaacatagaagccgagccacccttcggcgagtcctatattgtgatcggtgctggggaaaaagccttgaagctgtcatggtttaagaaaggcagtagcatcggaaagatgttcgaggcaaccgccagaggcgctaggcggatggccattctcggggatactgcatgggactttggatccatcggtggcgttttcacctctgtggggaaactggtccatcagatttttggaacagcgtacggcgtgcttttcagcggtgtatcatggacgatgaagatagggatcggcgtgctgttgacctggctcggactgaatagtcgatccactagcttatctatgacatgtattgctgttggcctggtcaccctatacctcggggtgatggtgcaggccgattcaggatgcgtcatcaactggaaaggccgcgaactgaagtgtggtagtgggatctttgttacaaatgaggtgcacacttggaccgaacaatataagttccaggcagacagcccgaaaagactttccgccgctattggaaaggcctgggaggagggcgtgtgcggtataaggtctgcaacgcggttggaaaacatcatgtggaaacagatttcgaacgagctgaatcatatcctcctggaaaacgacgtaaagtttacagtcgtggttggcgatgtggctgggattttagcccagggcaagaagatgatccgccctcaacccatggagtacaaatatagctggaagtcctggggcaaggcgaaaataatcggggccgacgtccagaataccactttcattatcgatggaccaaacacccctgaatgtcccgacgatcagagagcttggaatatttgggaggtggaggactacggctttggtatcttcacaactaacatatggctgaaacttagggattcatatacccaggtttgcgaccaccgtttgatgagtgcagccattaaagattctaaggctgtgcacgccgacatggggtactggatcgaaagcgagaaaaatgaaacatggaagctcgcacgggcgtccttcattgaggtaaagacgtgtatctggccaaaatcacataccctgtggagcaacggagtcctagaatctgagatgataatccccaagatttatggcggtcctatctcccaacacaattaccgaccaggctactttactcagacagccgggccgtggcatctgggaaaactcgagctggatttcgacctttgcgaaggcaccactgtggtggtcgatgagcactgcgggaacagaggacccagtttgaggacaaccacggttactggcaagattatccacgaatggtgttgccgcagctgtaccctgcctccattacggtttaaaggtgaggacgggtgctggtatggaatggagataagacccgtgaaggaaaaggaggaaaatctcgtaaaatctatggtgtccgctggctcaggtgaggtcgacagtttcagcctgggccttctgtgtatttcgatcatgatcgaagaggtgatgaggtcccgctggtctcgaaagatgttgatgacagggaccctcgccgtatttttcctgctaattatgggacagctgacttggaacgatctcatccggctgtgcattatggtgggcgcaaatgctagcgaccgtatggggatgggaacaacctaccttgccttgatggcaacatttaaaatgagacctatgttcgccgtcggcctgttatttaggcgcctcacttcacgggaggtgctgcttctgaccataggtctaagtctcgttgcttccgtggaactgccaaactctttggaggaactgggggatggattagcgatgggcatcatgattctcaagctgcttacggacttccaaagccatcagctgtgggccacattgctctccctgacctttatcaaaactaccttctcactacactatgcatggaagacaatggctatggtcctgagcattgtaagtctttttcccctctgtctgtctactacctcccagaagacgacatggttgccggtgctgttaggcagcctcgggtgcaaacctctgaccatgttccttatcgccgagaataagatatggggaagaaaatcgtggccactgaacgaaggtatcatggccgttggcattgtgtcaatcttgctctctagtctgctaaagaacgatgtccccctggctgggcctcttattgcaggaggcatgctcatcgcctgttacgtgatatccggtagctctgcggacctgagcttggagaaagctgccgaggtatcctgggaagaggaagcagagcattcaggggccagtcacaatattttagtggaagtccaggatgacggaactatgaagatcaaagatgaggagagggacgatacactgaccatcctcctgaaggctactcttctggcagttagcggcgtgtatcccttgtctattccagccacactattcgtgtggtacttttggcaaaagaaaaagcagcgatccggcgtcctgtgggacaccccttcacccccagaagtggagcgcgcggttctcgatgacgggatatatcggatcatgcagagaggactgcttggtaggagtcaggtaggcgtgggggtcttccaagaaaacgtgtttcatacgatgtggcacgttactcgtggagctgtgttaatgtaccagggcaaacgcctggagccgagctgggcctccgtcaagaaagacctcatttcttacggtgggggatggcggttgcagggctcgtggaataccggcgaggaagtgcaggtaatcgcagtcgagcctgggaagaaccccaagaatgtgcaaacagccccaggaaccttcaaaacaagcgaaggtgaggttggcgctattgccctggattttaagcccgggacttcaggatcccctatcgtgaacagagaaggcaaaatagtcggtctctatgggaatggagtggttaccacgagtggcacatacgtgtctgcaatcgctcaggccaaggcgagccaggagggcccactgcccgagattgaagacgaggtcttcaggaaacgaaaccttactatcatggatctgcaccctgggtccggaaagacccggcgctatttgccggccattgtgagagaagcaatcaagaggaaactacggacactgatactcgctccaacccgagtagtggcctcagagatggctgaagcattaaagggtatgcccattagataccaaactaccgccgttaaatctgagcatacaggcaaggagatcgtcgacctgatgtgccacgccacgtttactatgcgccttctgagccctgtgagggtgccaaattataacatgatcattatggatgaagctcatttcaccgaccccagttccatcgcggcacgtgggtacataagcacacgggtcggaatgggcgaggccgctgccatttttatgaccgcaactcctccgggttctgtagaagccttcccccagtcaaatgctgtgatccaggatgaggaaagagacattccagagaggtcctggaacagtgggtatgagtggatcacagattttcctggaaaaaccgtttggttcgtgcccagcataaagtcgggcaatgacattgcgaactgtctccgcaagaatggcaaacgagtcatccagttgtctagaaagacgttcgatactgaataccagaagacaaagaacaacgactgggactacgtggttaccaccgatatctccgagatgggggccaattttcgggcagacagggtgattgatccacgccgttgcctgaaacctgtcatcctcaaggacggacccgaaagagtgattctggctggtccaatgccggtaactgtggccagcgcagcccagcggaggggccgcatagggcgaaaccacaataaggagggagatcagtatatctacatgggccagcctcttaacaatgacgaggatcatgctcactggacagaagccaaaatgctactggacaacattaatacccccgagggtatcatcccagcgttgttcgaacccgagagagaaaagtcagcagccattgatggggagtatcggttaaggggcgaggctcgcaaaacatttgttgaactgatgagaaggggagacctccctgtctggctgagttacaaggtggcctctgagggcttccaatattccgatcggcgttggtgctttgacggggaacgcaacaatcaggtgcttgaggaaaacatggatgtcgagatatggactaaagagggagaacgaaagaaactgagaccaaggtggctcgacgctcggacgtacagcgaccccttggcactgcgcgagttcaaggaatttgccgctggtagaaggtcagttagtggcgatctaatcctggagattgggaagctccctcagcaccttacccagcgggcccaaaatgcactggacaacttagtgatgttgcataatagcgaacagggaggccgagcgtatagacacgccatggaggagctgccggatacaatcgaaactctcatgctgcttgctctgattgccgtactcaccggtggggtgacattgttctttctgtccggccgcggattaggcaaaacctctatcgggctactgtgtgtcatggcaagctccgtgctcctttggatggcttcagttgagccacattggatagccgcatctatcattctggagttctttttgatggtgctgctcatccccgagcctgacaggcagcggactccccaggataaccaactggcctacgtcgtaattggacttctcttcatgatcctgacggtggctgcgaatgagatgggtttgctggaaaccacaaagaaagacttaggcatagggcacgttgccgtggagaaccaccatcacgcagctatgctagatgtcgacctgcatccagccagtgcctggactctctacgcagtggctaccacaattatcacccctatgatgcgtcacactattgaaaacacaacggccaatatctcgcttaccgcgatagctaaccaggccgcaatcctgatgggattggataagggctggcccattagcaaaatggacatcggtgtcccactgctcgccctggggtgctattcccaggtgaatcctcttactttaacagctgcagttctgatgctcgtggcccattacgcgattatcggcccgggattgcaagctaaggccaccagagaggcacagaagaggaccgccgctggcataatgaaaaaccccacagtagatgggattgtggccatcgacctggatccagtcgtttatgacgcaaagtttgaaaaacagctaggacagatcatgctgctcattctttgtacttctcaaatcctgttgatgcgcacgacctgggctctgtgcgagtcaataacactcgccactggccctctgaccacattatgggagggtagccccgggaagttctggaataccactattgcggtgtccatggccaacatcttccggggaagttaccttgcaggcgctggtctggccttttctctcatgaaaagcctaggcgggggacgaagaggcacgggggcacagggagaaacactgggcgagaagtggaagaggcagttgaatcagctgtcaaaatccgagttcaacacctataagcgcagtggtattatggaggtcgaccggagcgaagctaaagaggggctcaagagaggagagactaccaaacacgccgtgtctcgtggcacagccaaacttaggtggtttgtagaacggaatctggtgaagccagagggtaaagttatcgatttgggctgtgggcgcggaggctggtcctactattgcgcggggctgaagaaagtgactgaagtcaagggatacaccaaaggcggtcctgggcacgaggaacccataccgatggctacatacggatggaacctcgtgaagttacattcaggcaaagacgtcttctttatcccacctgagaagtgtgatacgctgctttgcgacattggcgagagctcgcccaatccaaccatcgaagaggggcgaactctgagagtgctaaagatggttgaaccctggctcaggggaaaccaattctgtattaaaatcctgaatccttatatgccgtctgtagtggagacattggagcagatgcagcggaagcacggtggcatgctggtccgcaaccccctcagtagaaattccacccatgaaatgtactgggtgagctgcgggactggaaacattgtttcagcagtgaatatgacatccaggatgcttctgaaccgatttaccatggtccaccggaaaccaacgtatgagcgtgatgtggacttaggcgccggtaccagacacgtagctgtggaacctgaggttgccaacctggatatcatagggcagcgcattgaaaatatcaagcatgagcacaaatctacatggcattacgacgaggataacccctataagacttgggcataccacggaagctatgaagtcaagcctagtggctccgccagctctatggtgaatggcgtggtcaaattgctcaccaagccatgggacgttatccccatggtgacacaaattgctatgactgataccacacctttcgggcagcagagggtatttaaagagaaggtggacacccggactccaaaagcgaagagaggaacggcccaaataatggaagtcacagcaaagtggctgtggggtttcctatcacgcaacaaaaagcccaggatctgtacccgagaggaatttactcggaaagtgagaagtaatgctgccattggcgcagttttcgtggacgagaaccagtggaactccgccaaggaggctgtcgaagatgagaggttttgggaccttgtgcatcgcgaacgtgagctgcacaaacaggggaagtgcgcaacctgcgtatacaacatgatgggaaagcgggagaaaaagctcggcgagttcggtaaagcgaaggggagcagagcaatctggtacatgtggctgggagccaggttcttggagtttgaagctctgggcttcatgaatgaggatcactggttttctcgcgaaaactcgctctcaggcgttgagggggagggacttcataaactgggttatattttacgagacatcagcaagataccgggcgggaatatgtacgccgatgacacagcaggatgggatacgcggatcaccgaagacgatctgcagaacgaggctaaaattactgacatcatggaacctgagcacgccttgctcgctaagtccattttcaagctgacatatcaaaataaagtggtcagagtgcagaggccagccaagaacggcaccgtgatggatgtcatcagtcgcagagaccagcggggttctgggcaggttggaacttacggcctaaatacatttaccaacatggaagcacaacttataaggcagatggagagcgagggcattttctccccctcagaactggagacacctaacctcgcggggcgtgtgctggattggttggaaaaacatggagtagagcgattaaagcgcatggccatcagtggtgacgactgtgtggtcaaaccaatcgatgacagatttgctactgccctgaccgcactcaatgatatgggcaaggtgcggaaggacattccccagtgggaaccgtctaaagggtggaacgattggcagcaagttcctttctgcagccaccactttcatcagcttataatgaaggacggaagggagatcgtggtcccctgtcgcaatcaggatgagctggtgggcagagctcgggtatcccagggtgccgggtggtcactaagggaaacggcatgcctgggaaaaagctatgcccaaatgtggcagctcatgtacttccaccgacgtgacttgagactggcggctaacgccatttgttctgcagttccagtggattgggtccctacctcccgcacaacttggagtatccatgcccaccatcagtggatgaccacagaggacatgcttagcgtgtggaatcgggtttggattgaagagaacccctggatggaagataagactcacatctcgtcctggggcgacgtgccatatctgggcaaaagggaggaccaatggtgcgggtctctcataggattaaccgctagagccacgtgggcaacaaatatccaggtcgctattaaccaggtgcgccggctgatcggtaatgagaactacttggattacatgacctcaatgaagaggtttaagaatgaaagcgaccccgagggcgccctgtggtga

SEQ ID NO: 13723 - RNA, 9879 nt, synthetic construct
  misc_feature 1..9879: note = derived and/or modified CDS sequence (opt3) from DENV-1__FJ882530__SS-prME
  source 1..9879: mol_type = other RNA
agcgtgaccatgctgctaatgcttatgcccaccgcactggctttccacttgactacgagaggcggggaacctcatatgatcgtctccaagcaggaaagggggaaatctttactgtttaagacctcagccggtgttaacatgtgcacactaattgcaatggacctcggcgagttctgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaagacgcaaactttgtttgccgccgaacattcgtggatagaggctggggtaatgggtgtggactgtttggcaaaggctccttgataacttgcgctaagttcaagtgcgtaaccaaactcgaggggaagacagtgcagtacgaaaacctgaaatattcagtcattgtgaccgttcacactggagaccagcatcaagtgggtaatgagagtacggaacacggcacaaccgccactatcacaccccaggcgcctagcacagagattcagttaaccgactacggggccctgactctcgattgttctccaaggacaggacttgactttaacgaaatggtcctgttgacgatgaaggagaaatcctggctagtgcataagcagtggttcctggatctcccgctgccctggacctcaggcgcaagcacaagtcaagagacatggaatcggaaagaccttctggtaacctttaagacagctcacgccaagaaacaggaagttgtggtcttgggttctcaggagggggctatgcacactgccctcaccggcgcaacggaaatccaaacctccggaacaactaccatcttcgccggccatctgaagtgccgtttaaaaatggataagctgacactaaaagggatgagctatgtgatgtgtactggatcgttcaagctcgagaaggaagtcgctgagacccagcacggtacggtgctggttcagattaaatacgagggcacagacgcgccttgcaagataccattttctacccaggatgaaaaaggggtgactcaaaacggacgccttatcacagcaaatcccattgtaaccgacaaggagaaacctgtcaacatcgaagccgagccacccttcggcgagtcctatatagtgattggtgctggggaaaaggccttgaagctgtcatggtttaaaaagggcagtagcatcggaaaaatgttcgaggcaactgccagaggcgctaggcggatggccatcctcggggataccgcatgggactttggatccattggtggcgttttcacatctgtggggaagctggtccatcagatctttggaacggcgtacggcgtgcttttcagcggtgtatcatggaccatgaaaattgggataggcgtgctgttgacttggctcggactgaatagtcgatccactagcttatctatgacctgtatcgctgttggcctggtcacactatacctcggggtgatggtgcaggccgattcaggatgcgtcattaactggaagggccgcgaactgaagtgtggtagtgggatctttgttactaatgaggtgcacacctggacggaacagtataaattccaagcagacagcccgaagagactttccgccgctatcggaaaagcctgggaggagggcgtgtgcggtattaggtctgcaacacggttggaaaacataatgtggaagcagatctcgaacgagctgaatcatattctcctggaaaacgacatgaaatttaccgtagtcgtgggcgatgttgctgggatcttagcccagggaaagaaaatgattcgccctcagcccatggagtacaagtatagctggaagtcctggggcaaagcgaagatcataggggccgacgtgcaaaatactaccttcatcattgatggaccaaacacacctgaatgtcccgacgatcagagagcttggaatatctgggaggtcgaggactacggctttggtattttcactaccaacatctggctgaaacttagggattcacacacacaggtgtgcgaccaccgtttgatgagtgcagccataaaggattctaaagctgttcatgccgacatggggtattggattgaaagcgagaagaatgaaacgtggaagctcgcacgggcgtccttcatcgaggtgaaaacctgtatttggccaaagtcacacactctgtggagcaacggagtactagaatctgagatgatcatacccaaaatctacggcggtcctatttcccagcataattatcgaccaggctactttacacaaaccgccgggccgtggcacctgggaaagctcgagctggatttcgacctttgcgaaggcactacagtcgtggtggatgagcactgcgggaacagaggacccagtttgaggaccacgactgtcaccggcaaaatcattcatgaatggtgttgccgcagctgtacactgcctccattacggtttaagggtgaggacgggtgctggtacggaatggagatcagacccgttaaggaaaaagaggaaaatctcgtgaagtctatggtatccgctggctcaggtgaggtggacagtttcagcctgggccttctgtgtatatcgattatgatcgaagaggtcatgaggtcccgctggtctcgaaaaatgttgatgaccgggactctcgccgtgtttttcctgctaatcatgggacagctgacatggaacgatctcattcggctgtgcatcatggttggcgcaaatgctagcgaccgtatggggatgggaaccacatatcttgccttgatggcaacttttaagatgagacctatgttcgccgtgggcctgttatttaggcgcctcacctcacgggaggtcctgcttctgacgattggtctaagtctcgtggcttccgttgaactgccaaactctttggaggaactgggggatggattagcgatgggcataatgatcctcaaactgcttacagacttccagagccaccaactgtgggccaccttgctctccctgacttttattaagaccacattctcactacattacgcatggaagactatggctatggtgctgagcatcgtcagtctttttcccctctgtctgtctaccacgtcccagaaaacaacctggttgccggtactgttaggcagcctcgggtgcaagcctctgactatgttccttattgccgagaataaaatctggggaagaaagtcgtggccactgaacgaaggtataatggccgtgggcatcgtttcaattttgctctctagtctgctcaagaatgatgtgcccctggctgggcctcttatcgcaggaggcatgctcattgcctgttatgtcatctccggtagctctgcggacctgagcttggagaaggctgccgaggtgtcctgggaagaggaagcagagcactcaggggccagtcataatatattagtagaagtgcaggatgacggaacaatgaaaattaaggatgaggagagggacgataccctgactatcctcctgaaggctacacttctggcagtcagcggcgtttaccccttgtctatcccagccaccctattcgtgtggtatttttggcagaaaaagaaacaacgatccggcgtgctgtgggacacgccttcacccccagaagtcgagcgcgcggtgctcgatgacgggatttaccggataatgcagagaggactgcttggtaggagtcaggttggcgtaggggtgttccaggaaaacgtctttcacactatgtggcacgtgacccgtggagctgttttaatgtatcaaggcaagcgcctggagccgagctgggcctccgtgaaaaaggacctcatctcttacggtgggggatggcggttgcagggctcgtggaatacaggcgaggaagtccaggtgattgcagtagagcctgggaagaaccccaaaaatgtccagaccgccccaggaacattcaagactagcgaaggtgaggtgggcgctatcgccctggattttaaacccgggacctcaggatcccctattgttaacagagaaggcaagatcgtgggtctctacgggaatggagtcgtgacgacaagtggcacttatgtttctgcaatagctcaagccaaagcgagccaggagggcccactgcccgagatcgaagacgaggtgttcaggaagcgaaaccttaccattatggatctgcatcctgggtccggaaagacacggcgctacttgccggccatcgtcagagaagcaattaaaaggaagctacggaccctgatcctcgctccaactcgagtggtagcctcagagatggctgaagcattaaaaggtatgcccataagatatcagaccacagccgtgaagtctgagcacacgggcaaagagattgttgacctgatgtgccatgccacttttaccatgcgccttctgagccctgtcagggtgccaaattacaacatgatcatcatggatgaagctcacttcacagaccccagttccattgcggcacgtgggtatatcagcacccgggtgggaatgggcgaggccgctgccatatttatgactgcaacacctccgggttctgtcgaagccttcccccaatcaaatgctgtaattcaggatgaggaaagagacatcccagagaggtcctggaacagtgggtacgagtggattaccgattttcctggaaagacggtgtggttcgttcccagcatcaagtcgggcaatgacatagcgaactgtctccgcaaaaatggcaagcgagtgattcagttgtctagaaaaactttcgatacagaatatcagaagaccaaaaacaacgactgggactacgtcgtgaccactgatatctccgagatgggggccaattttcgggcagacagggttatcgatccacgccgttgcctgaagcctgtgattctcaaggacggacccgaaagagtcatcctggctggtccaatgccggtgacagtagccagcgcagcccaacggaggggccgcattgggcgaaaccataataaagagggagatcagtacatatatatgggccagcctcttaacaatgacgaggatcacgctcactggaccgaagccaagatgctactggacaacatcaatacacccgagggtattatcccagcgttgttcgaacccgagagagaaaaatcagcagccatcgatggggagtaccggttaaggggcgaggctcgcaagacttttgtggaactgatgagaaggggagacctccctgtttggctgagttataaagtcgcctctgagggcttccagtactccgatcggcgttggtgctttgacggggaacgcaacaatcaagtgcttgaggaaaacatggatgtggagatttggacgaaggagggagaacgaaagaaactgagaccaaggtggctcgacgctcggacctatagcgaccccttggcactgcgcgagttcaaagaatttgccgctggtagaaggtcagtcagtggcgatctaatactggagatcgggaaactccctcagcatcttacacagcgggcccagaatgcactggacaacttagttatgttgcacaatagcgaacaaggaggccgagcgtacagacatgccatggaggagctgccggatactattgaaaccctcatgctgcttgctctgatcgccgtgctcacaggtggggtaaccttgttctttctgtccggccgcggattaggcaagacttctattgggctactgtgtgtgatggcaagctccgtcctcctttggatggcttcagtggagccacactggatcgccgcatctataatcctggagttctttttgatggttctgctcattcccgagcctgacaggcagcggacgccccaggataaccagctggcctatgtggtcatcggacttctcttcatgattctgaccgtagctgcgaatgagatgggtttgctggaaacaactaaaaaggacttaggcatcgggcacgtggccgttgagaaccatcaccatgcagctatgctagatgtggacctgcacccagccagtgcctggaccctctacgcagtcgctacaaccataattactcctatgatgcgtcatacaatcgaaaacacgaccgccaatatttcgcttactgcgatcgctaaccaagccgcaatactgatgggattggataaaggctggcccatcagcaagatggacattggtgtgccactgctcgccctggggtgctactcccaggtcaatcctcttacattaaccgctgcagtgctgatgctcgttgcccactatgcgatcattggcccgggattgcaggctaaggccaccagagaggcacagaagaggacagccgctggcatcatgaagaaccccactgtggatgggatagtagccattgacctggatccagtggtctacgacgcaaaatttgaaaagcagctaggacagatcatgctgctcatcctttgtacgtctcagattctgttgatgcgcaccacatgggctctgtgcgagtcaatcactctcgccaccggccctctgacaaccttatgggagggtagccccgggaaattctggaatactacgatagcggtttccatggccaacattttccggggaagttatcttgcaggcgctggtctggccttttctctcatgaaaagcctaggcgggggacgaagaggcacaggggcacaaggagaaaccctgggcgagaagtggaaaaggcagttgaatcagctgtcaaagtccgagttcaacacttacaaacgcagtggtatcatggaggtggaccggagcgaagctaaggaggggctcaaaagaggagagaccacaaagcacgccgtctctcgtggcactgccaaacttaggtggtttgtggaacggaatctggtaaaaccagagggtaaggtgattgatttgggctgtgggcgcggaggctggtcctattactgcgcggggctgaaaaaggttaccgaagtgaaaggatatacaaagggcggtcctgggcatgaggaacccatcccgatggctacgtacggatggaacctcgtcaaattacactcaggcaaggacgtgttctttataccacctgagaagtgtgataccctgctttgcgacatcggcgagagctcgcccaatccaactattgaagaggggcgaacactgagagtcctaaaaatggtggaaccctggctcaggggaaaccagttctgtatcaagattctgaatccttacatgccgtctgttgtagagaccttggagcaaatgcagcggaaacatggtggcatgctggtgcgcaaccccctcagtagaaattccactcacgaaatgtattgggtcagctgcgggacaggaaacatcgtgtcagcagttaatatgacctccaggatgcttctgaaccgatttacgatggcccaccggaagccaacctacgagcgtgatgtggacttaggcgctggtacaagacatgtcgccgtggaacctgaggtagcaaacctggatattatcgggcagcgcatagaaaatattaaacacgagcataagtctacttggcactatgacgaggataacccctacaagacctgggcctatcatggaagctacgaagtgaaacctagtggctccgctagctctatggttaatggcgtcgtgaagttgctcacaaaaccatgggacgtgatccccatggtcactcagatcgcgatgaccgatacaacccctttcgggcaacagagggtttttaaggagaaagtggacactcggacgccaaaggccaagagaggaacagcacagattatggaagtaaccgctaaatggctgtggggtttcctatcacgcaacaagaaacccaggatatgtactcgagaggaatttacccggaaggtgagaagtaatgccgcaatcggcgccgtcttcgtggacgagaaccaatggaactccgctaaagaggccgttgaagatgagaggttttgggaccttgtgcaccgcgaacgtgagctgcacaagcaggggaagtgcgcgacatgcgtctataacatgatgggaaaacgggaaaagaaactcggcgagttcggtaaggcaaaagggagcagagccatttggtacatgtggctgggagctaggttcttggagtttgaagccctgggcttcatgaatgaggatcattggttttctcgcgaaaactcgctctcaggcgtggagggggagggacttcacaagctgggttacatcttacgagacattagcaaaatcccgggcgggaatatgtatgcagatgacacggctggatgggatacccggataactgaagacgatctgcagaacgaggccaagatcacagacattatggaacctgagcatgctttgctcgccaagtccatcttcaaactgacctaccagaataaggtagttagagtgcaaaggccagccaagaacggcactgtcatggatgtgattagtcgcagagaccagcggggttctggacaggtgggaacatatggcctaaatacctttacaaacatggaagcgcagcttatcaggcaaatggagagcgagggcatattctccccctcagaactggagactcctaacctcgccgggcgtgtcctggattggttggaaaagcacggagttgagcgattaaaacgcatggctattagtggtgacgactgtgtggtaaagccaatcgatgacagatttgccaccgcactgacggctctcaatgatatgggcaaggtgcggaaagacatcccccagtgggaaccgtctaaggggtggaacgattggcagcaggtccctttctgcagccaccattttcaccaacttattatgaaagacggaagggagatagtggttccctgtcgcaatcaggatgagctggtgggcagagcccgggtctcccagggtgcagggtggtcactaagggaaaccgcctgcctgggaaagagctacgcgcagatgtggcaactcatgtatttccatcgacgtgacttgagactggctgccaacgcaatctgttctgccgtgccagtagattgggttcctacatcccgcactacctggagtattcacgctcatcaccagtggatgacaactgaggacatgcttagcgtgtggaatcgggtctggatcgaagagaacccctggatggaagataaaacccacatttcgtcctggggcgacgtgccatacctgggcaagagggaggaccagtggtgcgggtctctcatcggattaacggccagagcaacatgggctaccaatatacaagttgccatcaaccaggtgcgccggctgattggtaatgagaactatttggattacatgacttcaatgaagaggtttaaaaatgaaagcgaccccgagggcgcgctgtggtga

SEQ ID NO: 13724 - RNA, 9879 nt, synthetic construct
  misc_feature 1..9879: note = derived and/or modified CDS sequence (opt3) from DENV-1__GQ868605__SS-prME
  source 1..9879: mol_type = other RNA
agcgtgaccatgctgctcatgcttatgcccacagccctggctttccacttgactacgagaggaggggaacctcatatgatcgtcaccaagcaggaaaggggaaaatccttactgtttaagacatctgttggtgtgaacatgtgcactctaattgccatggacctcggcgaactgtgtgaagataccatgacatacaaatgcccacggataaccgaggccgaaccggacgatgtagactgttggtgcaatgcgactgatacatgggtgacctatgggacgtgttcacaaactggagagcaccgccgagacaagcgtagtgtcgctcttgcaccccatgtgggcctgggtttggagaccagaacagaaacttggatgagctccgagggggcatggaaacagatccagagggttgaaacctgggccctccggcaccctggattcacagtgattgctctgtttctggcacatgccatcggcacctctattacgcagaagggcatcatattcatcctcttaatgctggtcactccatcgatggctatgcgctgcgtggggattggatcaagagattttgtagagggtcttagcggcgccacatgggttgacgtggtcttggagcacgggagttgtgtgaccactatggcgaaggataaacccacactggacatcgaactactcaagaccgaggtgacgaaccctgcagtcctgaggaaactttgcattgaagccaagatctccaataccacaactgattctcggtgtccaacccaaggagaggctacactgatggaagaacaagacgccaacttcgtttgccgccgaacttttgtggatagaggctggggtaatgggtgtggattgttcggcaaaggcagcctcataacctgcgcaaagtttaagtgcgtaacaaaactggaggggaagattgtgcagtacgaaaacttaaaatattccgtcatcgtgaccgttcacactggagaccagcatcaagtgggtaatgagtcaacggaacacggcacaaccgctactattacaccccaggcccctacaagtgagatccagctgaccgactacggggcgctcactcttgattgtagcccaaggacaggactggacttcaacgaaatggtcttgctaacgatgaaggagaaatcttggctggtgcataagcagtggtttctcgatctgccgcttccctggacctccggcgcctcaactagccaagagacatggaatcggcaggacctgttggtaaccttcaaaacagcacacgctaagaagcaggaagttgtggtcctcggtagtcaagagggggccatgcacactgctctgaccggcgccacggaaatccagacctctggaacaactaccatttttgcaggccatttaaaatgccgtctgaagatggataaactaacactcaaggggatgtcctatgtgatgtgtactgggagcttcaaactggagaaggaagtcgccgagacccagcacggtacggtgcttgttcagataaagtacgagggcacagacgctccttgcaaaatcccattctcgacccaagatgaaaagggggtgactcagaacggacgcttgattacagcgaatcccatcgtaaccgacaaagagaagcctgtcaacatagaagcagagccaccctttggcgagtcttatattgtgatcggtgttggggaaaaagccctgaagctctcctggttcaagaaaggctcaagtatcggaaagatgtttgaggctactgccagaggcgcaaggcggatggccattctgggggataccgcttgggacttcggaagcatcggtggcgtgtttacatccgtcgggaaacttgtgcatcagattttcggaacggcctacggcgtactgttttctggtgtgagctggaccatgaagatagggatcggcgttttgctcacttggctgggattaaattcacgaagtacatccctgagcatgacctgtattgcagtcggcctagtgacactctacctgggggtgatggtccaggcggattctggatgcgttatcaactggaaaggccgcgaacttaagtgtggttcagggatcttcgtgactaatgaggtgcacacctggacggaacaatataagtttcaggctgacagtccgaaaagattgagcgccgcaattggaaaggcctgggaggagggcgtatgcggtataaggtccgctacacggctggaaaacatcatgtggaaacagatttctaacgagctcaatcatatcctgttagaaaacgacatgaagttcaccgtcgtggttggcgatgtggtcgggattctggcccagggcaagaagatgatccgccctcaacccatggagcacaaatactcgtggaaaagctggggcaaggcaaagataatcggggctgacgtgcagaatactacctttattatcgatggaccaaacacacctgaatgtcccgacgatcagagagcctggaatatttgggaggttgaggactatggcttcggtatctttactaccaacatatggcttaagttgagggattcctacacacaggtgtgcgaccaccgtctcatgtcagcggccattaaagatagtaaggctgtacatgcagacatggggtattggatcgaatctgagaaaaatgatacgtggaagctggcccgggctagcttcattgaagtcaagacctgtatctggccaaaatcccacactctatggtcaaacggagtgctggagagcgaaatgataatccccaagatttacggcggtcctatctctcaacataattatcgaccaggctacttcacacagaccgccgggccgtggcacctcggaaaactggagcttgactttgatttgtgcgagggcactacagtggtcgttgacgaacactgcgggaacagaggaccctccctgaggaccacgactgtgaccggcaagattatccatgagtggtgttgccgcagttgtacattacctccactccggttcaaaggtgaagacgggtgctggtacggaatggagataagacccgtaaaggagaaggaagagaatctggtgaaaagcatggtctctgcaggctccggtgaagtggattcatttagtcttggcctgttgagcatttcgatcatgatcgaggaagttatgaggtcccgctggtctcgaaagatgctcatgaccgggactctggcggtgttcctactgctcattgtcggacagctgacatggaacgaccttatccggttgtgtattatggtgggcgccaatgctagcgatcgtatggggatgggaaccacatatctggccttaatggcaacttttaaaatgagacctatgttcgctgttggcctcctgtttaggcgccttacctcacgggaggtgctgctactcacgataggtctgagtttggtcgcctccgtagagctgccaaactctttagaagaactcggggacggactggcaatgggcatcatgattcttaagctgttgacagatttccaaagccaccagctctgggccaccctgctatccctgacttttatcaaaaccgctctttcactccattacgcgtggaagacaatggccatggtgctgagcattgttagtttgttccccctgtgcttatctactacctcccagaagacgacatggctcccggtgctgcttggcagcctggggtgtaaacctttgaccatgtttctcatcgcagaaaataagatatggggaagaaaatcgtggccactgaacgagggtatcatggctgtcggcgtggtatcaattctactgtctagtcttctcaagaacgacgtgcccctggccgggcctttgatcgccggaggcatgttaattgcttgctatgtcatctccggtagctctgcagatctgagcctcgaaaaagccgcggaggtttcctgggaggaagaggctgaacactcaggggccagtcataatatactggtggaggtgcaggacgatggaactatgaagattaaagacgaagagagggatgacacacttaccatcctgttgaaggcaactctactggccgtcagcggcgtgtaccccctctctatcccagctacactgttcgtttggtatttttggcaaaagaaaaagcagcgatccggcgtactttgggataccccttcacccccagaggtggaacgcgcagtcttagacgacgggatttaccggataatgcagagaggactgctcggtaggagtcaggtgggcgttggggtgttccaagagaacgtcttccacacgatgtggcacgtgactcgtggagccgtattgatgtatcagggcaaacgcctggaaccgagctgggcgtccgtcaagaaagatctcatctcttacggtgggggatggcggctgcagggctcgtggaataccggcgaggaggtgcaggttattgctgtggaacctgggaagaaccccaagaatgtccaaacagccccaggaacctttaaaacacccgagggtgaagtgggcgcaatcgcccttgacttcaagcctgggactagcggatcaccaattgttaacagagagggcaaaatcgtgggtctgtacgggaatggagtcgtgaccacgtccggcacatatgtaagtgctatagcccaggcaaaggcttctcaggaaggccccttgcctgagatcgaggatgaagtgtttaggaaacgaaacctaactattatggacctgcatccggggagcggaaagacccggcgctacctcccagccatcgttagagaggcgattaagaggaaattacggacactgatccttgcccccacccgagtcgtggcatccgaaatggctgaggccctgaagggtatgcctataagatatcaaactaccgctgtgaaatcagaacacacaggcaaggagattgtcgatctcatgtgtcatgcaacgttcactatgcgcttgctgtctccagtaagggtgcccaattacaacatgatcatcatggacgaggcccactttaccgatcctagcagtattgccgctcgtgggtatatctccacacgggttggaatgggcgaagcggcagccatattcatgaccgctactccgcccggtagcgtggaggcctttccacagtctaatgcagtcattcaggacgaagagagagatatccctgaaaggtcatggaactccgggtacgagtggattacagacttccccggaaaaaccgtgtggtttgttccaagtatcaagagcggcaatgatatagccaactgcctccgcaagaatggcaaacgagtgattcagctgtcgagaaagacgttcgagactgaatatcagaagacaaagaacaacgactgggactacgtcgtgaccaccgatatctctgagatgggggctaattttcgggcggacagggtaatcgatcctcgccgttgtcttaaacccgtgattctaaaggacggatccgaaagagttatcctggccggtccaatgccggtcactgtggcaagcgctgcccagcggaggggccgcattgggcgaaaccataataaggagggagatcagtacatatatatgggccagcctttgaacaatgacgaggatcacgcacactggacagaagccaaaatgttactggacaacatcaatacccccgagggtattatcccagctctcttcgaacccgagagagaaaagtcagccgcgatcgatggggagtaccggctgaggggcgaggcacgcaaaacattcgtggaacttatgagaaggggagacctgcctgtctggctcagttataaggttgcctctgagggctttcaatactccgatcggcgttggtgcttcgacggggaacgcaacaatcaggtgttggaggaaaacatggatgtagagatttggactaaagagggagaacgaaagaaactgagaccaaggtggctagacgctcggacgtatagcgaccccctggccctccgcgagtttaaggagttcgctgcaggtagaaggtcagtgagtggcgatcttataatcgagattgggaagctgcctcagcatttaacccagaaagcccaaaatgctttggacaacctggtcatgctccacaatagcgaacagggaggccgggcctaccgacatgcaatggaggagctgccggatacaatcgaaactcttatgctgctcgcgttgattgccgtgctgaccggtggggttacattatttttcctatccggcagaggactgggcaagacctctatcgggctcctttgcgtgatggctagctccgtcctgttgtggatggcctcagtagagccacactggatagcagcttctatcattctggaatttttcctcatggtgctgcttatccccgagcctgaccgccagaggactccccaggataaccaactcgcctatgttgtgattggactgttgtttatgatcctgacggtcgcagccaatgagatgggtttactagaaaccaccaagaaggacctgggcatagggcacgtggctgtcgagaaccatcaccatgcgactatgctcgatgtggaccttcacccagccagtgcatggaccctgtacgctgttgccacaaccattatcactcctatgatgcggcatacaattgaaaacacgaccgccaatatctcgttgactgcaatagctaaccaggccgcgatcctgatgggactcgataaaggctggcccattagcaagatggacatcggtgtgccactgcttgctttagggtgttactcccaggtaaatcctctgacactcaccgccgcagtgttgatgctggtcgcccactatgctattatcggcccgggactacaagcaaaggccacccgtgaggcgcagaaaagaacagctgccggcataatgaagaaccccactgttgatgggattgtggcaatcgacctggatccagtcgtgtacgacgccaaattcgaaaagcagctcggacagatcatgcttctgattttgtgcacgtctcaaatcctgctcatgaggaccacatgggctctgtgtgagtcaataactttagccaccggccctcttacaaccctgtgggagggtagccccgggaaattttggaatactacgattgcagtatccatggctaacatcttccgcggaagttatctcgccggcgcgggtctagccttttctctgatgaaatcattgggcgggggacggcgaggcacaggggcacagggagaaaccctgggcgagaagtggaaaagacagctcaatcagcttagcaagtccgagttcaacatttacaaaaggagtggtatcatggaggtggaccgcagcgaagctaaggaggggctgaaacggggagagactaccagacacgccgtttctcgtggcacagcaaagttgaggtggttcgtggaacggaatctggtcaagccagagggtaaagtgatagatctcggctgcgggcgcggaggctggtcctattactgtgctgggttaaagaaagtcactgaagtgaagggatataccaaaggcggtcctgggcatgaggaacccatcccgatggccacatacggatggaacctggttaaacttcactcaggcaaagacgtatttttcacgccacctgagaagtgcgataccctgctatgtgacattggcgagagctcgcccaatccaactatcgaagaggggcgaacactcagagtgctgaagatggtcgaaccctggttgaggggaaaccaattttgcattaaaatcctgaatccttacatgccgtctgtggttgagaccctcgagcagatgcagcggaagcatggtggcatgcttgtgcgcaaccccctgagtagaaattccactcacgaaatgtattgggtcagctgtgggacaggaaacattgtgtcagccgtaaatatgacctccaggatgttactgaaccgattcacgatggcgcaccggaaaccaacctacgagcgtgatgtggacttgggcgctggtacaagacatgttgcagtcgaacctgaggtggccaacctcgatatcatagggcagcgcattgaaaatatcaagcacgagcataaatctacttggcactatgacgaggataacccctacaagacctgggcttatcatggaagctacgaagtgaagcctagtggctccgccagctctatggtcaatggcgttgtgaaactgctaacaaagccatgggacgtaatccccatggtgactcaaattgcaatgaccgatacaaccccttttgggcagcagagggtcttcaaagagaaggtggacactcggacgccaaaagccaagagaggaacagctcaaataatggaagttaccgcgcgctggctttggtcatttctgagtaggaacaagaaaccccgaatctgcactcgggaggagttcaccagaaaggtgaggtccaatgccgcaattggtgctgtctttgtggacgagaaccagtggaatagcgccaaagaggcagtagaagatgagcgcttctgggacctcgttcagaaggaacgtgagctgcacaaacagggcaagtgtgccacatgcgtgtataacatgatggggaagcgggagaaaaagttgggagagtttggcaaagctaagggttctagagccatctggtacatgtggctgggggcgaggttcctcgagtttgaagcacttggattcatgaatgaggatcactggttctcgcgcgaaaactcactgagcggcgtcgagggcgaggggttacataaactgggatacattttgcgagacatctccaagataccgggtggcaatatgtatgccgatgacacggctgggtgggatacccggatcactgaagacgatctccaaaacgaggccaaaattacagacatcatggaacctgagcacgcactgctagctaccagtatttttaaacttacttaccagaataaggtggtgagagtccagaggccagccaaaaacggaacagttatggatgtgatctctcgcagagaccagcggggcagcggtcaagtagggacctatggactgaatacattcactaacatggaagctcagctcataaggcagatggagtccgagggcatttttctgccctcagaattggagacccctaacttagccgaacgtgtgctggattggctcgagaagcatggcgtcgaacgacttaaacgcatggcaatcagtggggacgactgcgtggttaagccaatcgatgacagattcgcgacggccctgaccgctctaaatgatatgggaaaagtgcggaaggacattccccagtgggagccgtctaagggttggaacgattggcaacaggtccctttttgtagccaccacttccatcagctgataatgaaagacggcagggagatcgtggtaccctgccgcaatcaggatgaactcgttgggagagcccgggtgtcccaaggagcaggctggtcattgagggagacagcttgtctgggtaagagctacgcccagatgtggcagcttatgtattttcaccgacgtgacctgagactcgcagccaacgcgatttgctctgctgtcccagtggattgggttcctacttcccgcaccacatggagtatccatgcccaccatcaatggatgactaccgaagacatgttaagcgtgtggaatcgggtctggattgaggaaaacccctggatggaggataaaacgcacgtgtcgtcctggggagacgtaccatacctgggaaagagggaggaccagtggtgtggctctttgatcggcctgacagcaagagccacctgggcttcaaatatacaggtggccatcaaccaggtccgccggctcattgggaatgaaaactatcttgattacatgactagcatgaaaaggttcaagaatgagggagaccccgaaggtgcactgtggtga

SEQ ID NO: 13725 - RNA, 9879 nt, synthetic construct
  misc_feature 1..9879: note = derived and/or modified CDS sequence (opt3) from DENV-1__FJ882534__SS-prME
  source 1..9879: mol_type = other RNA
agcgtgaccatgctgctcatgcttatgcccactgcactggctttccacttgactacgagaggaggggaacctcatatgatcgtctccaagcaggaaaggggaaaatctttactgtttaagacctcagccggtgttaacatgtgcacattaattgccatggacctcggcgagctgtgtgaagatactatgacctacaaatgcccacggataacagaggcggaaccggacgatgtggactgttggtgcaatgctaccgatacttgggtgacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaattgctcaagacagaggtgaccaaccctgccgtgctgaggaaactttgcattgaagctaagatctctaatacgaccacagatagccggtgtccaactcaaggagaggccaccctggtcgaagaacaggacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtcctcaagagggggctatgcacactgccctgaccggcgcaacggaaatccagaccagtggaacaactaccatttttgccggccatttaaaatgccgtctgaagatggataaactaacactcaaggggatgtcttatgtgatgtgtactggatccttcaaactggagaaggaagtcgctgagacccagcacggtacggtgcttgttcagataaagtacgagggcacagacgcgccatgcaaaatccccttcagcacccaagatgaaaagggggtgactcagaacggacgcttgattacagcaaatcctatcgtaaccgacaaagagaagccagtcaacatagaagccgagcccccgtttggcgagtcgtatattgtgatcggtgctggggaaaaagccctgaagctctcttggttcaagaaaggctcctcaatcggaaagatgtttgaggcaactgccagaggcgctaggcggatggccattctgggggataccgcatgggacttcggaagtatcggtggcgtttttacaagcgtggggaaacttgtccatcagattttcggaacggcgtacggcgtgctgttttccggtgtatcttggaccatgaagatagggatcggcgtgttgctcacttggctgggattaaatagccgatcaacaagtctgtccatgacctgtattgctgttggcctagtcacactctacctgggggtgatggtgcaggccgatagcggatgcgtcatcaactggaaaggccgcgaacttaagtgtggttctgggatcttcgttactaatgaggtgcacacctggacggaacaatataagtttcaggcagactcacctaaaagattgagtgccgctattggaaaggcctgggaggagggcgtgtgcggtataaggagcgcaacacggctggaaaacatcatgtggaaacagatttccaacgagctcaatcatatcctgttagaaaacgacatgaagctgaccgtagtcgtgggcgatgttgctgggattcttggacagggcaaaaagatgatccgcccccaaccaatggagtacaaatattcttggaagtcgtgggggaaggccaaaataatcggagcggacgcccagaatactaccttcattatcgatggccctaacacacccgaatgtccagacgatcagagagcttggaatatttgggaggtggaggactacggttttgggatcttcactaccaacatatggttgaagctcagggatagctatacacaggtctgcgaccaccgtctgatgtccgcagccattaaagattcaaaggctgtgcacgccgacatgggatactggatcgaaagtgagaaaaatgaaacgtggaagctagcacgggcgtcttttattgaggttaagacctgtatctggcccaaaagccatactctgtggtccaacggcgtgctcgaatcagagatgataatccctaagatttatggtggcccaatcagccaacacaattaccgaccggggtacttcacacagaccgccggaccctggcatctgggcaaacttgagttggatttcgacctgtgcgaagggactacagtagtcgtggatgagcactgcggaaacagaggcccttctttaaggaccacgactgtgaccggtaagattatccacgaatggtgttgccgctcctgtacactcccacccctgcggtttagaggggaggacggatgctggtatggcatggagataaggcctgtcaaagaaaaggaggaaaatcttgttaagagtatggtgagcgctggttctggcgaggtagactccttctcactggggttgctctgtattagtatcatgatcgaagaggtgatgcgcagccgatggtcgcggaaaatgctgatgaccggaactctagccgtctttttcctgctcattatgggccagctgacatggaacgatcttatccgtttgtgcattatggtgggggcaaatgcttccgacagaatgggaatgggcaccacatacctggccttaatggcaacttttaagatgaggccaatgttcgccgttggtctcctgtttcgccggcttacctctagagaggtgctgctactcacgatagggctgagcttggtcgcttcagtggaactgcccaacagtttagaggaactcggagatggcctggcgatgggcatcatgattcttaaactgttgacagacttccaatcccatcagctctgggccaccctgctatctctgacttttatcaagaccacattcagccttcactatgcatggaaaactatggctatggttctctccattgtgtcactgtttccgttgtgtctgagcaccacgagtcagaagacaacctggttacctgtcctcctggggtctcttggatgcaagccactgactatgttcttgatcgtagagaataaaatatggggtaggaagtcctggcccctcaacgaaggcatcatggccgtggggattgttagcatcctgctatcgtcactgcttaaaaacgatgtgcctctcgccggacccctgattgctggcggtatgttgatcgcatgttacgtcatatctgggagttccgccgacttaagcctggagaaggcggctgaggtgtcttgggaagaggaagccgagcatagcggagcatcccacaatattctcgtagaagtgcaggatgacggcacaatgaaaatcaaggatgaggagcgagacgataccctgactatccttctgaaagccacattgctagctgtctcaggcgtttatccactgagtattcctgcaaccctctttgtgtggtacttctggcaaaagaagaaacagcgcagcggggtgctgtgggacacgccctctccaccggaagtcgagcgggccgtgcttgatgacggaatatatagaatcatgcagaggggtttactgggccgttcccaggttggggtaggagtgttccaagaaaacgtctttcatactatgtggcacgtgacccgcggcgcggttctcatgtaccagggtaagcggttggagccttcatgggctagtgtgaaaaaggacctgattagctacgggggaggctggagactcaggggctcctggaatacaggggaggaagtccaggtgatcgccgtagagcccggcaaaaatccaaagaatgtccagaccgcacccggtacattcaagactcctgaaggcgaggtgggggccattgctctggattttaaaccaggaacctctggctcgcccatcgttaaccgagaaggtaagatagtggggctttatggaaatggcgtcgtgacgacaagcggcacttacgtttcagccatcgcacaagctaaagcctcccaggaggggcctctgccggagattgaagacgaggtgttccggaagcgcaacttgaccatcatggatctacacccaggaagtggtaaaacaagaaggtatctgcccgcgattgtccgggaagccatcaagcgaaagctcagaaccttaatactggcacctactcgcgtggtagcttctgagatggccgaagctcttaaaggcatgccaattaggtaccagaccacagcagtaaagagcgagcatacggggaaagagatcgttgacctgatgtgccacgccacttttaccatgcgtctcttgtcccccgtccgggtgcctaattataacatgatcattatggatgaagcccatttcacagacccgtcatctatcgctgcgagaggatacataagcaccagggtgggcatgggtgaggcagccgctatttttatgactgccacacccccagggagtgtcgaagcattccctcaatccaatgccgtaatccaggatgaggaacgcgacattcccgagcgaagctggaactctggatatgagtggatcaccgattttccaggcaagacggtgtggttcgttccttcaataaaatccggcaatgacattgctaactgtctgagaaagaatgggaagcgggtgatccagctcagtaggaaaacttttgatacagaataccagaagaccaaaaacaacgactgggactacgtcgtgaccactgatatcagcgagatgggagcgaatttccgcgccgaccgtgttattgatcccagacggtgcctgaagccagtgatccttaaagacggtccggaaagggtcattctagcaggccctatgcccgtgacagtagcttcggccgcacaacgccgagggagaataggacggaaccacaataaggagggcgatcagtatatctacatgggtcagccactgaacaatgacgaggatcatgcccactggaccgaagctaagatgttgttagacaacattaatacacccgaggggatcatccctgccctgttcgaaccagagagggaaaaatctgcggcagtggatggcgagtatcgcctcagaggagaggccaggaagacttttgttgaactgatgcggcgtggcgaccttcccgtctggctgtcctacaaagtggctagcgaggggttccagtattcagatcgccgatggtgctttgacggagaaagaaacaatcaagtgctcgaggaaaacatggatgtcgagatttggacgaaggagggtgaaaggaaaaagttgcggcctcgctggctggacgccagaacctacagtgacccgctagctctgagggagttcaaagaatttgcagccggccggcgatctgtttccggggatctcatacttgagatcggaaagctgccacagcacttaacacagagagctcagaatgccttggacaacctggtgatgctccataatagcgaacaaggcggtcgcgcatataggcacgcgatggaggagctgcccgatactattgaaacccttatgctgctcgccttgatcgctgtactgacagggggcgtgaccttattctttctatcaggacggggcctggggaagacaagtattggactcctttgtgtcatggccagctccgtgctgttgtggatggcatctgttgagcctcattggatcgctgccagcataatcctggagttctttctcatggtgctgcttattcccgagccagaccgtcagagaacgcctcaggataaccagctcgcatacgtcgtaatcggtctgttgttcatgattctgaccgtggccgctaatgagatgggcttactagaaacaactaaaaaggacctggggatcggacacgttgcggtggagaaccaccatcacgccgcaatgctcgatgtcgaccttcatcccgcttccgcctggaccctgtacgccgtggcaacaaccataattactccaatgatgaggcacacaatcgaaaacacgaccgctaatatttcattgactgccatcgcgaaccaagctgccatactgatgggcctcgataaaggttggcctatctctaagatggacattggggtcccgctgcttgcattaggctgctatagtcaggtgaatcccctgacactcaccgccgctgttttgatgctggtggcacattacgccatcattggaccaggcctacaggcgaaagctacccgcgaggcccaaaagcggacagcagccgggatcatgaagaaccctactgtagatggaatagtggctattgacctggatcccgtcgtttatgacgccaaatttgaaaagcagctcggccagatcatgcttctgatcttgtgtacgtcgcagattctgctcatgcgaaccacatgggcactgtgcgagagcatcactttagctaccggtccacttacaaccctgtgggaggggtcccctggaaaattctggaatactacgatagccgtgtctatggcgaacatttttagaggctcatacctcgccggtgcaggcctagctttcagcctgatgaagtccctagggggaggcaggcgcgggacaggagcccaaggcgaaaccctgggtgagaaatggaagcggcagctcaatcagcttagtaagtctgagttcaacacttataaaagaagcgggatcatggaggtcgaccgttcagaagcaaaggagggactgaaaaggggcgagaccacaaagcacgctgtgtcccggggtactgccaaattgcgctggtttgtagaacgaaatctggtgaagcccgagggcaaggttattgatctcgggtgtggaagaggcgggtggagttactattgcgccggactgaaaaaggtgaccgaagtcaaaggctacacaaagggtgggccgggacacgaggaaccaatccctatggcgacgtacggctggaacctagtgaaacttcatagcggcaaggacgtcttctttatacccccagagaaatgtgataccctgctatgcgacatcggggagtcttcccccaatcctactattgaagagggaaggacactccgggtgctgaagatggttgaaccgtggttgcgcggtaaccagttctgtatcaagattctgaatccctatatgccatcagtagtggagaccctcgagcaaatgcagagaaaacacggcgggatgcttgtcaggaaccctctgagccgaaattcgactcatgaaatgtactgggtgtcttgcggaacaggcaacatcgttagtgctgtgaatatgacctcccggatgttactgaaccgttttacgatggcacacagaaagcccacctatgagcgcgatgtcgacttgggtacagggactaggcacgtggccgtagaacctgaggtggctaacctcgatattatcggacagcggatagaaaatattaaacatgagcacaagagcacctggcattacgacgaggataacccatataaaacatgggcctaccacggctcatatgaagttaagccctccggctctgcaagcagtatggtcaatggggtggtgaagctgctaactaaaccttgggacgtcatcccaatggttacccagatcgccatgacagataccactcccttcggacaacagagagtgtttaaggagaaagtagacacgcgcacaccgaaggctaaaaggggtaccgcgcagattatggaagtgactgcccgatggctttggggcttcctgtcccggaacaagaagcctagaatatgtaccagggaggaatttacacgcaaagtccgtagcaatgcagctatcggggccgtgttcgttgacgagaaccaatggaactctgcaaaggaggccgtggaagatgagcggttttgggacctcgtccatagagaaagggagctgcacaaacagggaaagtgcgctacgtgcgtgtacaacatgatgggcaaacgcgaaaagaagttgggtgagttcgggaaagccaagggatcacgagcgatttggtacatgtggctgggcgcacggtttctcgagttcgaagcccttggcttcatgaatgaggatcactggtttagtagagaaaactccctgagcggggtagagggagagggtttacataaactgggctatatcttgagggacatttctaagatcccagggggaaatatgtacgctgatgacaccgccggctgggatactcgcataacagaagacgatctccagaacgaggcaaaaatcaccgacattatggaacccgagcacgctctgctagccaaggctatcttcaaacttacttatcagaataaggttgtgagagtccaacggcctgccaagaacggtacagtgatggatgtgatttcgaggcgtgaccagcgagggtcaggacaggtcggcacctacggcctgaatacatttactaacatggaagcacagctcatccgccaaatggagagcgaggggatattctccccaagtgaactggagacccccaacttggcggaaagagccttagattggctggagaaatatggagttgaacggctcaagaggatggctatttctggtgacgactgtgtggtaaaaccgatcgatgaccgctttgccacggcacttaccgctctgaatgatatgggcaaggtgagaaaagacatccctcagtgggagcccagcaaggggtggaacgattggcagcaggtcccattctgctcccatcactttcaccaactaattatgaaggacggacgggagatagtggttccttgtaggaatcaggatgaactggtgggccgagcccgtgtctcacagggtgcagggtggagtctcagagagacagcctgcttgggaaaatcttacgcgcagatgtggcaactgatgtatttccatcgccgggaccttaggctggctgccaacgcaatctgtagcgccgtgcccgtagattgggttccaacttccagaaccacatggtcaattcacgctcatcaccagtggatgactaccgaagacatgctcagcgtgtggaatcgcgtctggatcgaggaaaacccctggatggaggataagacgcatatttcttcctgggaggacgtgccttacttaggcaaacgggaagaccagtggtgcggcagtctgatcgggttgacagccagggcaacctgggctactaatatacaagttgccatcaaccaggtgcgaagactgattggaaatgagaactacctcgattatatgacaagcatgaagcggtttaaaaatgaatcggacccagagggtgcgctttggtga

SEQ ID NO: 13726 - RNA, 9879 nt, synthetic construct
  misc_feature 1..9879: note = derived and/or modified CDS sequence (opt3) from DENV-1__FJ882536__SS-prME
  source 1..9879: mol_type = other RNA
agcgtgaccatgctgctcatgcttatgcccacagcactggctttccacttgactacgagaggaggggaacctcatatgatcgtctccaagcaggaaaggggaaaatctttactgtttaagacctcagccggtgttaacatgtgcacattaattgccatggacctcggcgagctgtgtgaagatactatgacctacaaatgcccacggataacagaggcggaaccggacgatgtggactgttggtgcaatgctaccgatacttgggtaacatatgggacctgtagtcagacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaattgctcaagacagaggtgaccaaccctgccgtgctgaggaaactttgcattgaagctaagatctctaatacgaccacagatagccggtgtccaactcaaggagaggccaccctggtcgaagaacaggacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatgtgtactggtagcttcaaactggagaaggaagtcgctgagacccagcacggtacggtgcttgttcagataaagtacgagggcacagacgcgccttgcaaaatcccattctcgacccaagatgaaaagggggtgactcagaacggacgcttgattacagcaaatcccatcgtaaccgacaaagagaagcctgtcaacatagaagccgagccaccctttggcgagtcttatattgtgatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtttttacatccgtggggaaacttgtccatcagattttcggaacggcgtacggcgtgctgttttctggtgtaagctggaccatgaagatagggatcggcgtgttgctcacttggctgggattaaattcacgaagtacatccctgagcatgacctgtattgctgttggcctagtcacactctacctgggggtgatggtgcaggccgattctggatgcgtcatcaactggaaaggccgcgaacttaagtgtggttcagggatcttcgttactaatgaggtgcacacctggacggaacaatataagtttcaggcagacagtccgaaaagattgagcgccgctattggaaaggcctgggaggagggcgtgtgcggtataaggtccgcaacacggctggaaaacatcatgtggaaacagatttctaacgagctcaatcatatcctgttagaaaacgacatgaagctgaccgtagtcgtgggcgatgttgctgggattcttggacagggcaaaaagatgatccgccctcaacccatggagtacaaatattcgtggaaaagctgggggaaggccaaaataatcggagcggacgcccagaatactaccttcattatcgatggcccaaacacacctgaatgtcccgacgatcagagagcttggaatatttgggaggtggaggactacggttttgggatcttcactaccaacatatggttgaagctcagggattcctatacacaggtctgcgaccaccgtctgatgtcagcagccattaaagatagtaaggctgtgcacgccgacatgggatactggatcgaatctgagaaaaatgaaacgtggaagctagcacgggcgagctttattgaggttaagacctgtatctggccaaaatcccatactctgtggtcaaacggcgtgctcgaaagcgagatgataatccccaagatttatggtggccctatctctcaacacaattaccgaccagggtacttcacacagaccgccggaccgtggcatctgggcaaacttgagttggatttcgacctgtgcgaagggactacagtagtcgtggatgagcactgcggaaacagaggcccctccttaaggaccacgactgtgaccggtaagattatccacgaatggtgttgccgcagttgtacactccctccactgcggtttagaggggaggacggatgctggtatggcatggagataaggcccgtcaaagaaaaggaggaaaatcttgttaagagcatggtgtctgctggttccggcgaggtagactcattcagtctggggttgctctgtattagcatcatgatcgaagaggtgatgcgctcgcgatggtcccggaaaatgctgatgaccggaactctagccgtctttttcctgctcattatgggccagctgacatggaacgatcttatccgtttgtgcattatggtgggggcaaatgcttctgacagaatgggaatgggcaccacatacctggccttaatggcaacttttaagatgaggcctatgttcgccgttggtctcctgtttcgccggcttaccagcagagaggtgctgctactcacgatagggctgtcattggtcgctagtgtggaactgccaaactccttagaggaactcggagatggcctggcgatgggcatcatgattcttaaactgttgacagacttccaatctcatcagctctgggccaccctgctaagcctgacttttatcaagaccacattctcccttcactatgcatggaaaactatggctatggttctctcaattgtgagcctgtttcccttgtgtctgagtaccacgtctcagaagacaacctggttaccggtcctcctggggtcccttggatgcaagcctctgactatgttcttgatcgccgagaataaaatatggggtaggaagtcctggccactcaacgaaggcatcatggccgtagggattgtgtcgatcctgctatcatctctgcttaaaaacgatgttcccctcgctggacctctgattgcaggcggtatgttgatcgcctgttacgtgataagtgggtccagcgcggacttatctctggagaaggctgccgaggtcagctgggaagaggaagcagagcattccggagcctcacacaatattctcgtggaagtacaggatgacggcacaatgaaaatcaaggatgaggagcgagacgataccctgactatccttctgaaagctacattgctagcagtgagtggcgtctatcccctgagcattccagccaccctctttgtttggtacttctggcaaaagaagaaacagcgctctggggtgctgtgggacacgccttcacccccagaagtggagcgggcggtccttgatgacggaatatatagaatcatgcagaggggtttactgggccgtagccaggtgggggttggagtattccaagaaaacgtgtttcatactatgtggcacgtcacccgcggcgctgtgctcatgtaccagggtaagcggttggagccgagttgggccagcgttaaaaaggacctgatttcctacgggggaggctggagactcaggggctcttggaatacaggggaggaagtgcaggtcatcgcagtggagcctggcaaaaatcccaagaatgtacagaccgccccaggtacattcaagactcccgaaggcgaggtcggggctattgccctggattttaaacctggaacctcgggcagcccaatcgtgaaccgagaaggtaagatagttgggctttatggaaatggcgtggtcacgacatcaggcacttacgtgtccgcaatcgctcaagccaaagcgagtcaggaggggcccctgcctgagattgaagacgaggttttccggaagcgcaacttgaccatcatggatctacacccgggatctggtaaaacaagaaggtatctgccagccattgtgcgggaagcaatcaagcgaaagctcagaaccttaatactggctcccactcgcgtcgtggccagcgagatggctgaagcacttaaaggcatgcctattaggtaccagaccacagccgtaaagtccgagcatacggggaaagagatcgtggacctgatgtgccacgccacttttaccatgcgtctcttgtcaccagttcgggtccccaattataacatgatcattatggatgaagctcatttcacagacccttctagcatcgcggcaagaggatacataagtaccagggtgggcatgggtgaggccgctgccatttttatgactgcaacaccgcccgggtccgtggaagccttcccacaaagcaatgctgtcatccaggatgaggaacgcgacattcctgagcgatcttggaactcaggatatgagtggatcaccgattttcccggcaagacggtatggttcgtgccatccataaaaagtggcaatgacattgcgaactgtctgagaaagaatgggaagcgggttatccagctcagcaggaaaacttttgatacagaataccagaagaccaaaaacaacgactgggactacgtggtcaccactgatatctcggagatgggagccaatttccgcgcagaccgtgtgattgatcctagacggtgcctgaagcccgttatccttaaagacggtccagaaagggtgattctagctggcccgatgcctgtcacagtggcctctgcagcccaacgccgagggagaataggacggaaccacaataaggagggcgatcagtatatctacatgggtcagcccctgaacaatgacgaggatcatgctcactggaccgaagccaagatgttgttagacaacattaatacaccagaggggatcatccccgcgctgttcgaacctgagagggaaaaatccgcagccgtagatggcgagtatcgcctcagaggagaggctaggaagacttttgtggaactgatgcggcgtggcgaccttccagtttggctgagctacaaagtcgcctcagaggggttccagtatagtgatcgccgatggtgctttgacggagaaagaaacaatcaagtgctcgaggaaaacatggatgtggagatttggacgaaggagggtgaaaggaaaaagttgcggccccgctggctggacgctagaacctactctgaccctctagcactgagggagttcaaagaatttgccgctggccggcgatccgtcagcggggatctcatacttgagatcggaaagctgccgcagcacttaacacagagagcccagaatgcattggacaacctggttatgctccataattcagaacaaggcggtcgcgcgtataggcacgccatggaggagctgccagatactattgaaacccttatgctgctcgctttgatcgccgtgctgacagggggcgtaaccttattctttctaagtggacggggcctggggaagactagcattggactcctttgtgtgatggcatcctctgtcctgttgtggatggctagcgtggagccccattggatcgccgcatccataatcctggagttctttctcatggttctgcttattcctgagcccgaccgtcagagaacgccacaggataaccagctcgcctacgtggtcatcggtctgttgttcatgattctgaccgtagctgcgaatgagatgggcttactagaaacaactaaaaaggacctggggatcggacacgtggccgttgagaaccaccatcacgcagctatgctcgatgtggaccttcatcctgcctcagcctggaccctgtacgcagtcgctacaaccataattactcccatgatgaggcacacaatcgaaaacacgaccgccaatatttctttgactgcgatcgctaaccaagccgcaatactgatgggcctcgataaaggttggccaatcagtaagatggacattggggtgcctctgcttgccttaggctgctattcgcaggtcaatccgctgacactcaccgctgcagtgttgatgctggttgcccattacgcgatcattggacccggcctacaggctaaagccacccgcgaggcacaaaagcggacagccgctgggatcatgaagaacccaactgtggatggaatagtagccattgacctggatcctgtggtctatgacgcaaaatttgaaaagcagctcggccagatcatgcttctgatcttgtgtacgagccagattctgctcatgcgaaccacatgggctctgtgcgagtccatcactttagccaccggtccccttacaaccctgtgggaggggtctccaggaaaattctggaatactacgatagcggtttcaatggccaacatttttagaggcagctacctcgcaggagctggcctagccttctccctgatgaagagtctagggggaggcaggcgcgggacaggagcacaaggcgaaaccctgggtgagaaatggaagcggcagctcaatcagctttctaagagcgagttcaacacttataaaagatcagggatcatggaggtggaccgttccgaagctaaggagggactgaaaaggggcgagaccacaaagcacgccgtcagtcggggtactgccaaattgcgctggtttgtggaacgaaatctggtaaagcctgagggcaaggtgattgatctcgggtgtggaagaggcgggtggagctactattgcgcgggactaaagaaggttaccgaagtgaaaggctacacaaagggtgggcccggacacgaggaaccgatcccaatggctacgtacggctggaacctggtcaaacttcattctggcaaggacgtgttctttatacctcccgagaaatgtgataccctgctatgcgacatcggggagtcctcaccaaatcccactattgaagagggaaggacactccgggtcctgaagatggtggaaccttggttgcgcggtaaccagttctgtatcaagattctgaatccgtatatgcccagcgttgtagagaccctcgagcaaatgcagagaaaacacggcgggatgcttgtgaggaacccactgtcgcgaaattctactcatgaaatgtactgggtcagttgcggaacaggcaacatcgtgtccgcagttaatatgaccagccggatgttactgaaccgttttacgatggcccacagaaagcctacctatgagcgcgatgtggacttgggtacagggactaggcacgtcgctgtggaacccgaggtagccaacctcgatattatcggacagcggatagaaaatattaaacatgagcacaagtcaacctggcattacgacgaggataacccttataaaacatgggcataccacggctcctatgaagtgaagccatctggcagcgccagttccatggttaatggggtcgtgaagctgctaactaaaccctgggacgtgatccctatggtcacccagatcgctatgacagataccactccattcggacaacagagagtttttaaggagaaagtggacacgcgcacacccaaggcgaaaaggggtaccgcccagattatggaagtaactgcacgatggctttggggcttcctgagccggaacaagaagccgagaatatgtaccagggaggaatttacacgcaaagtgcgttctaatgctgccatcggggcagtcttcgtggacgagaaccaatggaactcagccaaggaggctgttgaagatgagcggttttgggacctcgtgcatagagaaagggagctgcacaaacagggaaagtgcgccacgtgcgtctacaacatgatgggcaaacgcgaaaagaagttgggtgagttcgggaaagcgaagggaagtcgagcaatttggtacatgtggctgggcgcccggtttctcgagttcgaagctcttggcttcatgaatgaggatcactggttttccagagaaaacagcctgtctggggtggagggagagggtttacataaactgggctatatcttgagggacatttcgaagatccctgggggaaatatgtacgccgatgacaccgcaggctgggatactcgcataacagaagacgatctccagaacgaggctaaaatcaccgacattatggaaccagagcacgccctgctagctaaggccatcttcaaacttacttatcagaataaggtagttagagtgcaacggcccgcaaagaacggtacagtcatggatgtgatttcaaggcgtgaccagcgagggagcggacaggtgggcacctacggcctgaatacatttactaacatggaagcgcagctcatccgccaaatggagtccgaggggatattcagtccttctgaactggagaccccaaacttggccgaaagagctttagattggctggagaaatatggagtcgaacggctcaagaggatggccattagcggtgacgactgtgttgtgaaacccatcgatgaccgctttgcaacggctcttaccgccctgaatgatatgggcaaggtaagaaaagacatcccgcagtgggagccttccaaggggtggaacgattggcaacaggtgcccttctgctcacatcactttcaccaactaattatgaaggacggacgggagatagtcgtgccatgtaggaatcaggatgaactggttggccgagcacgtgtgagtcagggtgccgggtggtctctcagagagacagcgtgcttgggaaaaagctacgctcagatgtggcaactgatgtatttccatcgccgggaccttaggctggccgcaaacgccatctgttccgctgtccctgtggattgggtacccacttcaagaaccacatggagcattcacgcccatcaccagtggatgactaccgaagacatgctctctgtttggaatcgcgtgtggatcgaggaaaacccatggatggaggataagacgcatatttccagttgggaggacgtcccctacttaggcaaacgggaagaccagtggtgcggcagcctgatcgggttgacagcaagggctacctgggccactaatatacaagtggcgatcaaccaggttcgaagactgattggaaatgagaactacctcgattatatgacatcgatgaagcggtttaaaaatgaatccgaccctgagggtgctctttggtga

SEQ ID NO: 13727 - RNA, 9879 nt, synthetic construct
  misc_feature 1..9879: note = derived and/or modified CDS sequence (opt3) from DENV-1__FJ882537__SS-prME
  source 1..9879: mol_type = other RNA
agcgtgacaatgctgctcatgcttatgcccacagcactggctttccacttgactacgagaggaggggaacctcatatgatcgtctccaagcaggaaaggggaaaatctttactgtttaagacctcagccggtgttaacatgtgcacactaattgccatggacctcggagaactgtgtgaagatactatgacctacaaatgcccacggataacagaagtggaaccggacgatgtagactgttggtgcaataccactgatacatgggtgacctatgggacgtgtagtcagactggagaacaccgccgagacaagcgtagcgtcgcgcttgctccccatgtgggcctgggtttggagaccagagccgaaacatggatgtcctctgagggggcatggaaacagatccagaaggttgaaacttgggccctcaggcaccctggattcaccgtgattgctctgtttctggcacatgccatcggcacatcgattacccagaagggcatcatattcatcctcttaatgctggtcacgccatcaatggctatgcggtgcgtggggattggaagccgcgattttgtagagggtcttagtggcgccacttgggttgacgtggtcttggagcacgggtcctgtgtgacaaccatggcgaaagataagcccactctggacatcgaactactcaaaacagaggtgaccaaccctgcagtcctgagaaaactttgcattgaagccaaaatctctaatacgaccacagatagcagatgtccaactcaaggagaggctaccctggttgaagaacaggacgccaacttcgtgtgccggcgcacatttgtagatcgaggctggggtaatgggtgtggattgttcggcaagggctccctcataacttgcgcaaagtttaaatgcgtgaccaagctggaggggaaaattgtccagtacgaaaacttaaagtattcagtgatcgttacagtgcacaccggagaccagcatcaagtcggtaatgagagtactgaacacggcacgattgctacaatcacaccccaggcccctactagcgagatccagctgaccgactacggggcgctcacacttgattgttctccaagaaccggactggacttcaacgaaatggtgttgctaactatgaaagagaagtcctggctggtacataaacagtggtttctcgatctgccgcttccctggacatcaggcgccagcacgagtcaagagacctggaataggcaggacctgttggttactttcaagacagcacacgctaagaaacaggaagtggtcgtgctcggttctcaagagggggccatgcacaccgctctgacaggcgccactgaaattcagaccacgggaaccacaactatatttgcaggccatttaaagtgccggctgaaaatggataagctaaccctcaaagggatgtcctatgtcatgtgtacaggcagcttcaagctggagaaggaagtggccgagactcagcacggtaccgttcttgtgcagatcaaatacgagggcacggacgctccttgcaagattccattctcgacacaagatgaaaaaggggtaacccagaacggacgtttgatcactgcgaatcccatagtcacagacaaggagaaacctgtgaacattgaagcagagccaccctttggcgagtcttatatcgttatcggtgccggggaaaaggctctgaagctctcctggttcaaaaagggctcaagtattggaaaaatgtttgaggccaccgcacgcggcgccagaaggatggctatcctgggggatactgcctgggacttcggaagcattggtggcgtgtttacctccgtcgggaaacttgtgcatcagatattcggaacagcatacggcgtactgttttctggtgtgagctggacgatgaaaatcgggattggcgttttgctcacctggctgggattaaattcacggagtacttccctgagcatgacatgtatcgcggtcggcctaatcaccctctacctgggggtgatggtgcaggctgattctggatgcgtcattaactggaagggccgagaacttaagtgtggttcagggatattcgttacaaatgaggtgcacacttggaccgaacaatataaatttcaggccgacagtccgaagcgcttgagcgcagccatcggaaaggcttgggaggagggcgtgtgcggtattagatccgccacgaggctggaaaacatcatgtggcggcagatttctaacgagctcaatcatatcctgttagaaaacgacatgaagttcacagtagtcgtgggcgatgttgtggggatactggcacagggcaagaagatggtccgccctcaacccatggagcacaaatactcgtggaaaagctggggcaaggctaagatcattggggccgacgtgcagaataccacttttatcattgatggaccaaacacccctgaatgtcccgacgatcagagagcgtggaatatctgggaggttgaggactatggcttcggtatatttacaactaacatttggcttaagttgagggattcctacacccaggtgtgcgaccaccgtctcatgtcagccgctatcaaagatagtaaggcagtacatgccgacatggggtattggattgaatctgagaaaaatgaaacatggaagctggctcgggccagcttcatcgaggtcaagacgtgtatatggccaaaatcccacaccctatggtcaaacggagtgctggaaagcgagatgatcattcccaagatctacggcggtcctatttctcaacataattatcgaccaggctacttcactcagacagcagggccgtggcacctcggaaaactggagcttgattttgacttgtgcgaaggcaccactgtggtcgttgatgagcactgcgggaacagaggaccctccctgaggacaaccacggtgactggcaagatcatacatgaatggtgttgccgcagttgtaccttacctccactccggttcaaaggtgaggacgggtgctggtacggaatggagattagacccgtaaaggaaaaggaggaaaatctggtgaaaagcatggtctctgcgggctccggtgaggtggactcatttagtcttggcctgttgtgtatcagcatcatgattgaagaggttatgaggtcgcgctggtcccgaaagatgctcatgacagggaccctggccgtgttctttctactgatcatgggacagctcacttggaacgatctgattcggtcttgcataatggtcggcgctaatgccagcgaccgtatggggatgggaacaacctatcttgcattgatggctacattcaaaatgagacctatgtttgccgtgggcctgttattcaggcgcctcacttcacgggaggttctgcttctgaccatcggtctaagtctcgtggcatccgtcgaactgccaaactctttggaggaactgggggatggattagccatgggcattatgatcctcaagctgcttacggactttcaaagctaccagctgtgggctacattgctctccctgaccttcattaaaactaccttttcactacactatgcgtggaagacaatggccatggtactgagcatcgtgagtcttctccccctgtgtttgtctactacctcccagaagacgacatggctgccggttttactcggcagcctggggtgcaaacctcttaccatgttcctgatagcagagaataagatctggggaagaaaatcgtggccattgaacgaaggtattatggctgtgggcatcgtctcaattctcctgtctagtctactgaagaacgatgtgccccttgccgggcctctcatcgccggaggcatgctgatagcttgttacgtaatttccggtagctctgcagacttgagcttagagaaagccgcggaggtgtcctgggaagaggaagctgagcattcaggggccagtcacaatatcctggtcgaagttcaggatgacggaactatgaagatcaaagatgaggagagggacgatacactcaccattctgcttaaggcaactctgttggccgtgagcggcgtgtatcccctatctataccagctacactgtttgtctggtacttctggcaaaagaaaaagcagcgatccggcgtgctctgggacaccccttcacccccagaagttgagcgcgcagtactggatgacgggatctatcggattatgcagagaggacttttaggtaggagtcaggtgggcgtcggggtgttccaagaaaacgtttttcatacgatgtggcacgtgactcgtggagccgtcctgatgtaccagggcaaacgcctcgagccgagctgggcgtccgtgaagaaagacttgatctcttacggtgggggatggcggctgcagggctcgtggaataccggcgaggaagtacaggtcattgctgtggagcctgggaagaaccccaagaatgttcaaacagccccaggaaccttcaaaacacccgaaggtgaggtgggcgcaatcgccctcgattttaagcctgggactagcggatcaccaatagtcaacagagaaggcaaaatcgtgggtctgtatgggaatggagttgtgaccacgtccggcacatacgtcagtgctattgcccaggcaaaggcttctcaggagggcccccttcctgagatcgaagacgaggtgttcaggaaacgaaacctgactattatggatttgcacccggggagcggaaagacccggcgctatctaccagccatcgtaagagaagcgataaagaggaaactgcggacactcattttagcccccacccgagtggttgcatccgagatggctgaagccctgaagggtatgcctatcagataccaaactaccgctgtcaaatcagagcatacaggccgcgagatcgtggaccttatgtgccacgcaacgtttactatgaggctgctctctccagtgcgtgtccccaattataacatgattatcatggatgaagcccatttcaccgaccctagcagtatagccgctcgggggtacatttccacaagagtaggaatgggcgaggcggcagccatctttatgaccgctactccgcccggtagcgtggaagccttcccacagtctaatgcagttattcaggatgaggaaagggacatccctgagcgctcatggaactccgggtatgagtggataacagattttcccggaaagaccgtgtggttcgtcccaagtattaaaagcggcaatgacatcgccaactgtttgcgaaagaatggcaagagagtgatccagctgtcgcggaaaacgtttgatactgaataccaaaagaccaagaacaacgactgggactacgttgtgaccaccgatatttctgagatgggggctaatttcagggcggaccgcgtcatcgatcctcgtagatgcctcaagcccgtgattctgaaagacggaccagaacgggtaatacttgccggtccgatgcctgtgactgttgcatccgctgcccagaggcgcggccgaatcgggagaaaccacaataaggagggagatcagtatatttacatgggccagcccctaaacaatgacgaggatcatgcacactggacagaagccaagatgctgttggacaacatcaataccccagagggtatcattcccgctttattcgaacctgagcgggagaaaagcgccgcgatagatggggagtataggctgcgcggcgaggcaagaaagacatttgtcgaactcatgaggcggggagacctgccagtgtggctttcatacaaagtggccagtgagggcttccaatattctgatcgtcgctggtgctttgacggggaacgaaacaatcaggtcctggaggaaaacatggatgttgagatctggactaaggagggagaaaggaaaaagctcaggccccggtggttggacgctcgcacgtactccgaccctctggccctaagagagttcaaagaatttgctgcaggtaggcggagcgtgtcaggcgatctgattctcgagatcgggaaacttccgcagcacctgacccagcgagcccaaaatgctttagacaacttggtaatgctgcataatagtgaacagggaggcagagcctatcgccacgcaatggaggagctcccagatacaattgaaactctgatgcttctggcgctcatcgccgtgttgaccggtggggtcacactgttctttttaagcggcaggggactaggcaagacctccatagggctgctctgtgtgatggcttctagcgcccttctgtggatggcatccgttgagccccattggatcgctgcctcaattatcttggagttctttctgatggtgctcctgattcctgagcccgaccggcagcgtactccacaggataaccaacttgcatacgtcgtaatcggactcctgttcatgatattgacggtggccgctaatgagatgggtctgttagaaaccaccaaaaaggacctaggcattgggcacgttgcggtggagaaccaccatcacgccactatgctggatgtcgacctccatcctgcatctgcttggaccctttacgccgtggccacaaccatcattactcccatgatgagacacacaatcgaaaacacgaccgcaaatataagtctgactgctatcgccaaccaggcggctattttgatgggactggataaaggctggccaatctcgaagatggacattggtgtccctctcctggcccttgggtgctatagccaggtgaatccgttaacactgaccgcagccgttctcatgttggtggctcattacgcaatcataggccccggactgcaagccaaagcgaccagggaggctcagaagcgcacagccgcaggcattatgaagaacccaactgtagatgggatcgtggccatcgacctagatcctgtcgtttatgacgctaaatttgaaaagcagctgggacagattatgctccttatcctgtgtacgtcccaaatattgctgatgcggaccacatgggccctctgcgagtctattactctggcaaccggccccttaacaaccctttgggagggttcaccagggaaattctggaatactacgatcgctgtgagcatggccaacatttttcgaggatcctacctggcgggcgccggtctcgcattcagtctaatgaagtctctgggcgggggaagaaggggcacaggggctcagggagaaaccttgggcgagaaatggaagcgccagctgaatcagctcagcaagtcagagttcaacacttataaacggtccggtatcatggaggtcgacagaagtgaagccaaggaggggcttcgtaggggagagaccacaaaacacgcagtgagccggggcactgctaagctgcgctggtttgtagaacgaaatttggtgaaacctgagggtaaggttatagatctgggctgtgggagaggaggctggtcttactattgcgccgggctcaagaaagtgaccgaagtcaagggatacacaaaaggcggtcccgggcacgaggaaccgatcccaatggccacgtacggatggaacttagtgaagctgcattccggcaaagacgtcttctttattcctcccgagaagtgtgatacccttctgtgcgacatcggcgagtcaagcccaaatcccactattgaagaggggaggacactacgggtgctcaaaatggttgaaccttggctgcgcggaaaccaattctgtatcaagattttgaatccgtatatgccctcggtagtggagaccctggagcacatgcagagaaagcatggtggcatgctcgtcaggaacccactttctcgaaatagtactcacgaaatgtactgggtgtcctgcgggacaggaaacatcgttagcgcggtgaatatgacctcacggatgctgttaaaccgttttacgatggctcacagaaaacctacctatgagcgcgatgtcgacctgggcgcaggtacaaggcatgtggccgtagaacccgaggtggctaacttggatataattgggcagcggatcgaaaatatcaagcacgagcataaatccacttggcactacgacgaggataacccttataagacctgggcctaccatggatcttatgaagttaaaccaagcggcagtgcatccagcatggtcaatggcgtggtgaagctcctgacaaagccctgggacgtcattcctatggttactcagatagccatgaccgatacaaccccattcgggcaacagagagtgtttaaagagaaggtagacactcgcacgcccaaagctaagaggggaacagcgcagatcatggaagtgaccgcccgatggctatggggtttcctttctcggaacaaaaagccgagaatttgtactagggaggaatttacccgcaaggtccgttcaaatgcagctatcggcgccgtgttcgttgacgagaaccaatggaatagtgcaaaagaggccgtggaagatgagcggttttgggacctggtccacagagaaagggagctccacaagcaggggaaatgcgctacatgcgtgtacaacatgatgggaaagcgcgagaaaaagctgggcgagttcggtaaggccaaagggtcccgagcgatttggtacatgtggttgggagcacggtttctggagttcgaagccctcggcttcatgaatgaggatcattggtttagcagagaaaactctctttcgggcgtagagggggagggactgcacaagttaggttatatcctgagggacatatcaaaaatccctggcgggaatatgtacgctgatgacacggccggatgggatacccgcattactgaagacgatttgcagaacgaggcaaagatcacagacattatggaaccagagcatgctctcctggccaccagcatcttcaaactaacttatcagaataaggttgtgagagtccaacggcccgctaaaaacggcacagtgatggatgtgatatccaggcgtgaccagcgaggtagtgggcaggtcggaacctacggccttaatacatttactaacatggaagcccagctgattcgccaaatggagtctgagggcatcttcagcccttccgaactcgagaccccaaacctggcagaaagagttttggattggttagagaagtatggggtggaacggctgaagaggatggcgatctcaggagacgactgtgtagtgaaacccattgatgaccgctttgccacggctctcaccgcccttaatgatatgggtaaggtcagaaaagacataccgcagtgggagcctagtaagggctggaacgattggcaacaggtgcccttctgctctcaccactttcatcaactgatcatgaaagacgggcgggagattgttgtgccatgtaggaatcaggatgagctagtcggacgagcacgtgtgagccagggcgctggttggtccctgagagagacagcctgcctcgggaagtcatacgcacagatgtggcaattgatgtatttccaccgccgggacctgaggcttgccgcgaacgctatctgtagcgccgtacctgttgattgggtgcccacttctagaaccacatggtccattcatgcacaccatcagtggatgactaccgaagacatgctgagtgtctggaatcgcgtgtggatcgaggaaaacccatggatggaggataagacgcacataagctcgtggggagacgttccctacctcggcaaacgggaggaccagtggtgcggctccttaatcgggctgacagccagggctacctgggccactaatattcaagtggcaatcaaccaggtccgaagattgattggaaatgaaaactacctggattatatgacatctatgaagcggtttaaaaatgagtcagaccctgaaggtgctctctggtga

SEQ ID NO: 13728 - RNA, 9879 nt, synthetic construct
  misc_feature 1..9879: note = derived and/or modified CDS sequence (opt3) from DENV-1__GQ868606__SS-prME
  source 1..9879: mol_type = other RNA
agcgtgaccatgctgctaatgcttatgcccaccgcactggctttccacttgactacgagaggcggggaacctcatatgatcgtctccaagcaggaaagggggaagtctttactgtttaagacctcagccggtgttaacatgtgcacactaattgccatggacctcggcgagttctgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaagacgcaaactttgtttgccgccgaacattcgtggatagaggctggggtaatgggtgtggactgtttggcaaaggctccttgataacttgcgctaagttcaagtgcgtaaccaaactcgaggggaagacagtgcagtacgaaaacctgaaatattcagtcattgtgaccgttcacactggagaccagcatcaagtgggtaatgagagtacggaacacggcacaaccgccactatcacaccccaggcgcctagcacagagattcagttaaccgactacggggccctgactctcgattgttctccaaggacaggacttgactttaacgaaatggtcctgttgacgatgaaggagaaatcctggctagtgcataagcagtggttcctggatctcccgctgccctggacctcaggcgcaagcacaagtcaagagacatggaatcggaaagaccttctggtaacctttaagacagctcacgccaagaaacaggaagttgtggtcttgggttctcaggagggggctatgcacactgccctcaccggcgcaacggaaatccaaacctccggaacaactaccatcttcgccggccatctgaagtgccgtttaaaaatggataagctgacactaaaagggatgagctatgtgatgtgtactggatcgttcaagctcgagaaggaagtcgctgagacccagcacggtacggtgctggttcagattaaatacgagggcacagacgcgccttgcaagataccattttctacccaggatgaaaaaggggtgactcaaaacggacgccttatcacagcaaatcccattgtaaccgacaaggagaaacctgtcaacatcgaagccgagccacccttcggcgagtcctatatagtgattggtgctggggaaaaggccttgaagctgtcatggtttaaaaagggcagtagcatcggaaaaatgttcgaggcaactgccagaggcgctaggcggatggccatcctcggggataccgcatgggactttggatccattggtggcgttttcacatctgtggggaagctggtccatcagatctttggaacggcgtacggcgtgcttttcagcggtgtatcatggaccatgaaaattgggataggcgtgctgttgacttggctcggactgaatagtcgatccactagcttatctatgacctgtatcgctgttggcctggtcacactatacctcggggtgatggtgcaggccgattcaggatgcgtcattaactggaagggccgcgaactgaagtgtggtagtgggatctttgttactaatgaggtgcacacctggacggaacagtataaattccaagcagacagcccgaagagactttccgccgctatcggaaaagcctgggaggagggcgtgtgcggtattaggtctgcaacacggttggaaaacataatgtggaagcagatctcgaacgagctgaatcatattctcctggaaaacgacatgaaatttaccgtagtcgtgggcgatgttgctgggatcttagcccagggaaagaaaatgattcgccctcagcccatggagtacaagtatagctggaagtcctggggcaaagcgaagatcataggggccgacgtgcaaaatactaccttcatcattgatggaccaaacacacctgaatgtcccgacgatcagagagcttggaatatctgggaggtcgaggactacggctttggtattttcactaccaacatctggctgaaacttagggattcatatacacaggtgtgcgaccaccgtttgatgagtgcagccataaaggattctaaagctgttcacgccgacatggggtactggattgaaagcgagaagaatgaaacgtggaagctcgcacgggcgtccttcatcgaggtgaaaacctgtatttggccaaagtcacatactctgtggagcaacggagtactagaatctgagatgatcatacccaaaatctatggcggtcctatttcccagcacaatcatcgaccaggctactttacacaaaccgccgggccgtggcacctgggaaagctcgagctggatttcgacctttgcgaaggcactacagtcgtggtggatgagcactgcgggaacagaggacccagtttgaggaccacgactgtcaccggcaaaatcattcatgaatggtgttgccgcagctgtacactgcctccattacggtttaagggtgaggacgggtgctggtacggaatggagatcagacccgttaaggaaaaagaggaaaatctcgtgaagtctatggtatccgctggctcaggtgaggtggacagtttcagcctgggccttctgtgtatatcgattatgatcgaagaggtcatgaggtcccgctggtctcgaaaaatgttgatgaccgggactctcgccgtgtttttcctgctaatcatgggacagctgacatggaacgatctcattcggctgtgcatcatggttggcgcaaatgctagcgaccgtatggggatgggaaccacatatcttgccttgatggcaacttttaagatgagacctatgttcgccgtgggcctgttatttaggcgcctcacctcacgggaggtcctgcttctgacgattggtctaagtctcgtggcttccgttgaactgccaaactctttggaggaactgggggatggattagcgatgggcataatgatcctcaaactgcttacagacttccagagccaccaactgtgggccaccttgctctccctgacttttattaagaccacattctcactacattacgcatggaagactatggctatggtgctgagcatcgtcagtctttttcccctctgtctgtctaccacgtcccagaaaacaacctggttgccggtactgttaggcagcctcgggtgcaagcctctgactatgttccttattgccgagaataaaatctggggaagaaagtcgtggccactgaacgaaggtataatggccgtgggcatcgtttcaattttgctctctagtctgctcaagaatgatgtgcccctggctgggcctcttatcgcaggaggcatgctcattgcctgttatgtcatctccggtagctctgcggacctgagcttggagaaggctgccgaggtgtcctgggaagaggaagcagagcactcaggggccagtcataatatattagtagaagtgcaggatgacggaacaatgaaaattaaggatgaggagagggacgataccctgactatcctcctgaaggctacacttctggcagtcagcggcgtttaccccttgtctatcccagccaccctattcgtgtggtatttttggcagaaaaagaaacaacgatccggcgtgctgtgggacacgccttcacccccagaagtcgagcgcgcggtgctcgatgacgggatttaccggataatgcagagaggactgcttggtaggagtcaggttggcgtaggggtgttccaggaaaacgtctttcacactatgtggcacgtgacccgtggagctgttttaatgtatcaaggcaagcgcctggagccgagctgggcctccgtgaaaaaggacctcatctcttacggtgggggatggcggttgcagggctcgtggaatacaggcgaggaagtccaggtgattgcagtagagcctgggaagaaccccaaaaatgtccagaccgccccaggaacattcaagactagcgaaggtgaggtgggcgctatcgccctggattttaaacccgggacctcaggatcccctattgttaacagagaaggcaagatcgtgggtctctacgggaatggagtcgtgacgacaagtggcacttatgtttctgcaatagctcaagccaaagcgagccaggagggcccactgcccgagatcgaagacgaggtgttcaggaagcgaaaccttaccattatggatctgcatcctgggtccggaaagacacggcgctacttgccggccatcgtcagagaagcaattaaaaggaagctacggaccctgatcctcgctccaactcgagtggtagcctcagagatggctgaagcattaaaaggtatgcccataagatatcagaccacagccgtgaagtctgagcacacgggcaaagagattgttgacctgatgtgccatgccacttttaccatgcgccttctgagccctgtcagggtgccaaattacaacatgatcatcatggatgaagctcacttcacagaccccagttccattgcggcacgtgggtatatcagcacccgggtgggaatgggcgaggccgctgccatatttatgactgcaacacctccgggttctgtcgaagccttcccccaatcaaatgctgtaattcaggatgaggaaagagacatcccagagaggtcctggaacagtgggtacgagtggattaccgattttcctggaaagacggtgtggttcgttcccagcatcaagtcgggcaatgacatagcgaactgtctccgcaaaaatggcaagcgagtgattcagttgtctagaaaaactttcgatacagaatatcagaagaccaaaaacaacgactgggactacgtcgtgaccactgatatctccgagatgggggccaattttcgggcagacagggttatcgatccacgccgttgcctgaagcctgtgattctcaaggacggacccgaaagagtcatcctggctggtccaatgccggtgacagtagccagcgcagcccaacggaggggccgcattgggcgaaaccataataaagagggagatcagtacatatatatgggccagcctcttaacaatgacgaggatcacgctcactggaccgaagccaagatgctactggacaacatcaatacacccgagggtattatcccagcgttgttcgaacccgagagagaaaaatcagcagccatcgatggggagtaccggttaaggggcgaggctcgcaagacttttgtggaactgatgagaaggggagacctccctgtttggctgagttataaagtcgcctctgagggcttccagtactccgatcggcgttggtgctttgacggggaacgcaacaatcaagtgcttgaggaaaacatggatgtggagatttggacgaaggagggagaacgaaagaaactgagaccaaggtggctcgacgctcggacctatagcgaccccttggcactgcgcgagttcaaagaatttgccgctggtagaaggtcagtcagtggcgatctaatactggagatcgggaaactccctcagcatcttacacagcgggcccagaatgcactggacaacttagttatgttgcacaatagcgaacaaggaggccgagcgtacagacatgccatggaggagctgccggatactattgaaaccctcatgctgcttgctctgatcgccgtgctcacaggtggggtaaccttgttctttctgtccggccgcggattaggcaagacttctattgggctactgtgtgtgatggcaagctccgtcctcctttggatggcttcagtggagccacactggatcgccgcatctataatcctggagttctttttgatggttctgctcattcccgagcctgacaggcagcggacgccccaggataaccagctggcctatgtggtcatcggacttctcttcatgattctgaccgtagctgcgaatgagatgggtttgctggaaacaactaaaaaggacttaggcatcgggcacgtggccgttgagaaccatcaccatgcagctatgctagatgtggacctgcacccagccagtgcctggaccctctacgcagtcgctacaaccataattactcctatgatgcgtcatacaatcgaaaacacgaccgccaatatttcgcttactgcgatcgctaaccaagccgcaatactgatgggattggataaaggctggcccatcagcaagatggacattggtgtgccactgctcgccctggggtgctactcccaggtcaatcctcttacattaaccgctgcagtgctgatgctcgttgcccactatgcgatcattggcccgggattgcaggctaaggccaccagagaggcacagaagaggacagccgctggcatcatgaagaaccccactgtggatgggatagtagccattgacctggatccagtggtctacgacgcaaaatttgaaaagcagctaggacagatcatgctgctcatcctttgtacgtctcagattctgttgatgcgcaccacatgggctctgtgcgagtcaatcactctcgccaccggccctctgacaaccttatgggagggtagccccgggaaattctggaatactacgatagcggtttccatggccaacattttccggggaagttatcttgcaggcgctggtctggccttttctctcatgaaaagcctaggcgggggacgaagaggcacaggggcacaaggagaaaccctgggcgagaagtggaaaaggcagttgaatcagctgtcaaagtccgagttcaacacttacaaacgcagtggtatcatggaggtggaccggagcgaagctaaggaggggctcaaaagaggagagaccacaaagcacgccgtctctcgtggcactgccaaacttaggtggtttgtggaacggaatctggtaaaaccagagggtaaggtgattgatttgggctgtgggcgcggaggctggtcctattactgcgcggggctgaaaaaggttaccgaagtgaaaggatatacaaagggcggtcctgggcatgaggaacccatcccgatggctacgtacggatggaacctcgtcaaattacactcaggcaaggacgtgttctttataccacctgagaagtgtgataccctgctttgcgacatcggcgagagctcgcccaatccaactattgaagaggggcgaacactgagagtcctaaaaatggtggaaccctggctcaggggaaaccagttctgtatcaagattctgaatccttacatgccgtctgttgtagagaccttggagcaaatgcagcggaaacatggtggcatgctggtgcgcaaccccctcagtagaaattccactcacgaaatgtattgggtcagctgcgggacaggaaacatcgtgtcagcagttaatatgacctccaggatgcttctgaaccgatttacgatggcccaccggaagccaacctacgagcgtgatgtggacttaggcgctggtacaagacatgtcgccgtggaacctgaggtagcaaacctggatattatcgggcagcgcatagaaaatattaaacacgagcataagtctacttggcactatgacgaggataacccctacaagacctgggcctatcatggaagctacgaagtgaaacctagtggctccgctagctctatggttaatggcgtcgtgaagttgctcacaaaaccatgggacgtgatccccatggtcactcagatcgcgatgaccgatacaacccctttcgggcaacagagggtttttaaggagaaagtggacactcggacgccaaaggccaagagaggaacagcacagattatggaagtaaccgctaaatggctgtggggtttcctatcacgcaacaagaaacccaggatatgtactcgagaggaatttacccggaaggtgagaagtaatgccgcaatcggcgccgtcttcgtggacgagaaccaatggaactccgctaaagaggccgttgaagatgagaggttttgggaccttgtgcaccgcgaacgtgagctgcacaagcaggggaagtgcgcgacatgcgtctataacatgatgggaaaacgggaaaagaaactcggcgagttcggtaaggcaaaagggagcagagccatttggtacatgtggctgggagctaggttcttggagtttgaagccctgggcttcatgaatgaggatcattggttttctcgcgaaaactcgctctcaggcgtggagggggagggacttcacaagctgggttacatcttacgagacattagcaaaatcccgggcgggaatatgtatgcagatgacacggctggatgggatacccggataactgaagacgatctgcagaacgaggccaagatcacagacattatggaacctgagcatgctttgctcgccaagtccatcttcaaactgacctaccagaataaggtagttagagtgcaaaggccagcacgcaacggcactgtcatggatgtgattagtagacgggaccagaggggttctggacaggtgggaacatatggcctaaatacctttacaaacatggaagcgcagcttatccgtcaaatggagagcgagggcatattctccccctcagaactggagactcctaacctcgccgggcgagtcctggattggttggaaaaacacggagttgagcgcttaaagagaatggctattagtggtgacgactgtgtggtaaaaccaatcgatgaccggtttgccaccgcactgacggctctcaatgatatgggcaaggtgaggaaggacatcccccagtgggaaccgtctaaagggtggaacgattggcagcaggtccctttctgcagccaccattttcaccaacttattatgaaggacggacgcgagatagtggttccctgtagaaatcaggatgagctggtgggccgggccagggtctcccagggtgcagggtggtcactacgagaaaccgcctgcctgggaaaaagctacgcgcagatgtggcaactcatgtatttccatcgtagagacttgcgcctggctgccaacgcaatctgttctgccgtgccagtagattgggttcctacatcccggactacctggagtattcacgctcatcaccagtggatgacaactgaggacatgcttagcgtgtggaatagggtctggatcgaagagaacccctggatggaagataagacccacatttcgtcctggggcgacgtgccatacctgggcaaaagagaggaccagtggtgcgggtctctcatcggattaacggcccgcgcaacatgggctaccaatatacaagttgccatcaaccaggtgcggaggctgattggtaatgagaactatttggattacatgacttcaatgaagcgatttaagaatgaaagcgaccccgagggcgcgctgtggtga

SEQ ID NO: 13729 - RNA, 9879 nt, synthetic construct
  misc_feature 1..9879: note = derived and/or modified CDS sequence (opt3) from DENV-1__FJ882539__SS-prME
  source 1..9879: mol_type = other RNA
agcgtgacaatgctgctcatgcttatgcccacagcactggctttccacttgactacgcgaggcggggaacctcatatgatcgtctccaagcaggaaaggggaaaatctttactgtttaagacctcagccggtgttaacatgtgcacactaattgccatggacctcggcgagttctgtgaagatactatgacctacaaatgcccacggataacagaagcggaaccggacgatgtggactgttggtgcaatgctaccgatacttgggtaacatatgggacctgtagtcagacgggagaacaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaagacgcaaactttgtttgccgccgaacattcgtggatagaggctggggtaatgggtgtggactgtttggcaaaggctccttgataacttgcgctaagttcaagtgcgtaaccaaactcgaggggaagacagtgcagtacgaaaacctgaaatattcagtcattgtgaccgttcacactggagaccagcatcaagtgggtaatgagagtacggaacacggcacaaccgccactatcacaccccaggcgcctagcacagagattcagttaaccgactacggggccctgactctcgattgttctccaaggacaggacttgactttaacgaaatggtcctgttgacgatgaaggagaaatcctggctagtgcataagcagtggttcctggatctcccgctgccctggacctcaggcgcacttgctagccaagagacttggaatcggaaagacctgttggtaacatttaagaccgcccacgctaagaaacaggaagttgtggtcctcggtagtcaggagggggccatgcacacagcactgactggcgccaccgaaatccaaacgtctggaaccacaactatcttcgctggccatttaaagtgccgtctgaaaatggataagctaaccctcaaagggatgtcctatgtgatgtgtacagggagcttcaagctggagaaggaagtcgcggagactcagcacggtaccgtgcttgttcagattaaatacgagggcacggacgcaccttgcaagataccattttcgacacaggatgaaaaagggatcacccaaaacggacgcttgattactgccaatcccatcgtgacagacaaggagaaacctgtaaacatagaagctgagccacccttcggcgagtcttatattgtcatcggtgccggggaaaaggcactgaagctctcctggtttaaaaagggctcaagtatcggaaaaatgttcgaggccaccgctagaggcgccaggcggatggcaattctgggggatactgcgtgggactttggaagcatcggtggcgtgttcacctccgttgggaaacttgtgcatcagatttttggaacagcttacggcgtcctgttctctggtgtgagctggacgatgaaaatagggatcggcgtattgctcacctggctgggattaaattcacgaagtacttccctgagcatgacatgtattgccgtgggcctagttaccctctacctgggggtcatggtgcaggcagattctggatgcgtgatcaactggaagggccgcgaacttaagtgtggttcagggatctttgtcacaaatgaggttcacacttggaccgaacagtataaattccaagccgacagtccgaagagattgagcgctgccattggaaaagcatgggaggagggcgtgtgcggtataaggtccgctacgcggctggaaaacatcatgtggaagcagatttctaacgagctcaatcatatcctgttagaaaacgacatgaaatttacagtggtagtcggcgatgtggccgggattctggcgcagggaaagaaaatgatccgccctcagcccatggagtacaagtattcgtggaaaagctggggcaaagccaagataatcggggctgacgttcaaaataccactttcattatcgatggaccaaacacccctgaatgtcccgacgatcagagagcatggaatatttgggaggtggaggactacggctttggtatcttcacaactaacatatggcttaaattgagggattcctatacccaggtctgcgaccaccgtctcatgtcagccgctattaaggatagtaaagccgtgcacgcagacatggggtactggatcgaatctgagaagaatgaaacatggaagctggcgcgggccagcttcattgaggttaaaacgtgtatctggccaaagtcccataccctatggtcaaacggagtgctggaaagcgagatgataatccccaaaatttatggcggtcctatctctcagcacaatcatcgaccaggctactttactcaaacagctgggccgtggcacctcggaaagctggagcttgatttcgacttgtgcgaaggcaccactgtagtcgtggatgagcactgcgggaacagaggaccctccctgaggacaaccacggtgactggcaaaattatccatgaatggtgttgccgcagttgtaccttacctccactccggtttaagggtgaggacgggtgctggtacggaatggagataagacccgtcaaggaaaaagaggaaaatctggttaagagcatggtgtctgccggctccggtgaggtagactcattcagtcttggcctgttgtgtattagcatcatgatcgaagaggtgatgaggtcgcgctggtcccgaaaaatgctcatgacagggaccctggcagtctttttcctactgattatgggacagctcacttggaacgatctgatccggctttgcattatggtgggcgctaatgcctctgaccgtatggggatgggaacaacctatttggcactgatggccacatttaagatgagacctatgttcgctgttggcttactctttaggcgcctgactagccgggaggtgcttctgctaaccataggtctctcactggtcgcgagtgtggaattgccaaactccctggaggaattaggggatggactcgccatgggcatcatgattctgaaacttctgacggacttccagtctcaccaattgtgggcaacactcctgagcctaacctttatcaagactaccttctccctgcattacgcttggaagacaatggccatggttctttcaattgtgagcctctttcccctgtgtttgagtactacctctcagaaaacgacatggctgccggtcttactcggctccctggggtgcaagcctcttaccatgttcctgatcgccgagaataaaatatggggaagaaagagctggccattgaacgaaggtatcatggctgtaggcattgtgtcgatcctcctgtcatctctactgaaaaacgatgttccccttgcagggcctctcattgccggaggcatgctgatcgcgtgttatgtgataagtggttccagcgctgacttgtctttagagaaggccgcagaggtcagctgggaagaggaagccgagcactccggggcttcacataatattctggtggaagtacaggatgacggaactatgaaaatcaaggatgaggagagggacgatacactcaccatcctgcttaaggcaactctgttggccgtgagtggcgtctaccccctaagcattccagcgacactgttcgtttggtatttttggcagaaaaagaaacaacgatctggcgtgctctgggacaccccttcacccccagaagtggagcgcgctgtcctggatgacgggatataccggatcatgcagagaggacttttaggtaggagccaggtgggcgttggggtattccaggaaaacgtgtttcacacgatgtggcacgtcactcgtggagccgtgctgatgtatcaaggcaagcgcctcgagccgagttgggcaagcgttaaaaaggacttgatttcctacggtgggggatggcggctgcagggctcttggaataccggcgaggaagtgcaggtcatcgccgtggagcctgggaagaaccccaaaaatgtacagacagctccaggaaccttcaagacatcggaaggtgaggtcggcgccattgcactcgattttaaacccgggactagcggatcacctatcgtgaacagagaaggcaagatagttggtctgtacgggaatggagtggtcaccacgtccggcacatatgtgagtgctatcgcccaagcgaaagcctctcaggagggcccacttcccgagattgaagacgaggttttcaggaagcgaaacctgactatcatggatttgcatcctgggagcggaaagacccggcgctacctaccggcaattgtgagagaagctatcaaaaggaagctgcggacactcatattagccccaacccgagtcgtggcttccgagatggcagaagccctgaaaggtatgcccattagatatcagactaccgccgtaaagtcagagcacacaggcaaagagatcgtggaccttatgtgccatgctacgtttactatgcgcctgctctctcctgttagggtcccaaattacaacatgatcattatggatgaagcgcacttcaccgaccccagcagtatcgcagcccgtgggtatatatccacacgggtgggaatgggcgaggctgccgcaatttttatgaccgccactcctccgggtagcgtggaggctttcccccaatctaatgcggtcatccaggatgaggaaagagacattccagagaggtcatggaactccgggtacgagtggatcacagattttcctggaaagaccgtatggttcgtgcccagtataaagagcggcaatgacattgccaactgtttgcgcaaaaatggcaagcgagttatccagctgtcgagaaaaacgttcgatactgaatatcagaagaccaagaacaacgactgggactacgtggtcaccaccgatatctctgagatgggggcaaattttcgggctgacagggtgattgatccacgccgttgcctcaagcctgttatcctgaaggacggacccgaaagagtgattcttgccggtccaatgccggtcactgtggcatccgccgctcaacggaggggccgcatagggcgaaaccataataaagagggagatcagtacatctatatgggccagcctctaaacaatgacgaggatcacgcccactggacagaagcgaagatgctgttggacaacattaatacccccgagggtatcatcccagcattattcgaacccgagagagagaaatccgccgctattgatggggagtaccggctgaggggcgaggcccgcaagacatttgtagaactcatgagaaggggagacctgcctgtgtggctttcatataaagttgctagtgagggcttccagtactctgatcggcgttggtgctttgacggggaacgcaacaatcaagtcctggaggaaaacatggatgtggagatatggactaaggagggagaaagaaagaagctcagaccaaggtggttggacgcacggacgtattccgaccccctggccctacgcgagttcaaggaatttgctgccggtagaaggagcgtgtcaggcgatctgatcctcgagattgggaaacttcctcagcatctgacccagcgggcacagaatgcgttagacaacttggtcatgctgcacaatagtgaacaaggaggccgagcctacagacatgctatggaggagctcccggatacaatcgaaactctgatgcttctggccctcattgcagttttgaccggtggggtgacactgttctttttaagcggccgcggactaggcaagacctccatcgggctgctctgtgtaatggcttctagcgtgcttctgtggatggcctccgtcgagccacactggatagcagcctcaatcattttggagttctttctgatggtgctcctgatccccgagcctgacaggcagcggactccccaggataaccagcttgcttatgttgtgattggactcctgttcatgatcttgacggtcgcggccaatgagatgggtctgttagaaaccaccaaaaaggacctaggcatagggcacgtagcagtggagaaccatcaccatgctgccatgctggatgttgacctccacccagcctctgcatggactctttacgctgtggccaccacaattatcacccctatgatgcgtcatactattgaaaacacaacggcgaatatcagtctgaccgctatagccaaccaagcagccatcttgatgggactggataaaggctggcccatttcgaagatggacatcggtgtcccactcctggctcttgggtgctacagccaggtgaatcctttaactctgacagcagccgtcctcatgttggtggcgcactatgctattatcggcccgggactgcaggccaaggcaaccagagaggcccagaaaaggaccgctgccggcataatgaagaaccccacagttgatgggattgtggcaatcgacctagatccagtagtgtacgacgctaaatttgaaaagcagctgggacagatcatgctccttattctgtgtacttcccagatcttgctgatgcgcacgacctgggccctctgcgagtctataacactggcgactggccctttaaccacactttgggagggttcacccgggaaattctggaataccactattgccgtcagcatggcaaacatcttccggggatcctatctggctggcgccggtctcgcatttagtctaatgaagtctctgggcgggggacgaagaggcacgggggctcaaggagaaacattgggcgagaagtggaaaaggcagctgaatcagctcagcaagtcagagttcaacacctacaaacgctccggtattatggaggttgaccggagtgaagccaaggaggggcttaaaagaggagagactaccaagcacgccgtgagccgtggcacagcgaagctgaggtggtttgtcgaacggaatttggtgaaaccagagggtaaggtaatcgatctgggctgtgggcgcggaggctggtcttattactgcgctgggctcaaaaaggtgactgaagttaaaggatataccaagggcggtcctgggcatgaggaacccataccgatggcaacatacggatggaacttagtgaaactgcactccggcaaggacgtcttctttatcccacctgagaagtgtgatacgcttctgtgcgacattggcgagtcaagccccaatccaaccatcgaagaggggcgaactctaagagtgctcaaaatggtcgaaccctggctgaggggaaaccagttctgtattaagatcttgaatccttacatgccgtcggtggttgagacactggagcaaatgcagcggaaacatggtggcatgctcgtacgcaaccccctttctagaaatagtacccacgaaatgtattgggtgtcctgcgggactggaaacattgtcagcgccgtgaatatgacatcaaggatgctgttaaaccgatttaccatggctcaccggaagccaacgtacgagcgtgatgttgacctgggcgccggtaccagacatgtggcagtcgaacctgaggtggccaacttggatatcatagggcagcgcattgaaaatatcaaacacgagcataagtccacatggcactatgacgaggataacccctacaagacttgggcttatcatggatcttacgaagtaaaacctagcggcagtgcgtccagcatggtgaatggcgttgtcaagctcctgaccaaaccatgggacgtgatccccatggtgacacagattgccatgactgataccacacctttcgggcaacagagggtctttaaggagaaagttgacacccggactccaaaggcaaagagaggaacggctcagataatggaagtgacagccaaatggctatggggtttcctttctcgcaacaagaaacccaggatctgtacccgagaggaatttactcggaaggtaagatcaaatgcagccattggcgctgtgttcgtcgacgagaaccaatggaatagtgccaaagaggcggtggaagatgagaggttttgggacctggttcaccgcgaacgtgagctccacaagcaggggaagtgcgcaacctgcgtgtataacatgatgggaaaacgggaaaagaaactgggcgagttcggtaaggccaaagggtccagagctatctggtacatgtggttgggagccaggttcctggagtttgaagcactcggcttcatgaatgaggatcattggtttagccgcgaaaactctctttcgggcgtcgagggggagggactgcacaagttaggttacattctgcgagacatctcaaaaataccgggcgggaatatgtatgctgatgacacagccggatgggatacgcggatcaccgaagacgatttgcagaacgaggctaagattactgacatcatggaacctgagcatgccctcctggcaaagagcattttcaaactaacataccagaataaggtggtaagagttcaaaggccagcgaaaaacggcaccgtgatggatgtcatctcccgcagagaccagcggggtagtggacaggtgggaacttatggccttaatacatttaccaacatggaagcccagctgataaggcaaatggagtctgagggcattttcagcccctccgaactcgagacacctaacctggctgggcgtgtgttggattggttagaaaagcacggagtcgagcgactgaaacgcatggccatctcaggtgacgactgtgttgtgaagccaatcgatgacagatttgcaactgctctcaccgcccttaatgatatgggcaaggtacggaaagacattccccagtgggaaccgagtaaggggtggaacgattggcaacaggtgcctttctgctctcaccattttcaccaactgataatgaaagacggaagggagatcgtcgtgccctgtcgcaatcaggatgagctagttggcagagcacgggtgagccagggtgccgggtggtccctgagggaaacggcgtgcctcggaaagtcatacgctcagatgtggcaattgatgtatttccatcgacgtgacctgagacttgccgcaaacgccatttgtagcgctgtcccagtggattgggtacctacctctcgcacaacttggtccatccacgcccatcaccagtggatgaccacagaggacatgctgagtgtttggaatcgggtgtggattgaagagaacccctggatggaagataaaactcacatcagctcgtggggcgacgtcccatacctcggcaagagggaggaccagtggtgcgggtccttaataggactgaccgcaagagctacgtgggccacaaatatccaagtggcgattaaccaggttcgccggttgatcggtaatgagaactatctggattacatgacctctatgaagaggtttaaaaatgaatcagaccccgagggcgctctctggtga

SEQ ID NO: 13730 - RNA, 9879 nt, synthetic construct
  misc_feature 1..9879: note = derived and/or modified CDS sequence (opt3) from DENV-1__FJ882541__SS-prME
  source 1..9879: mol_type = other RNA
agcgtgaccatgctgctcatgcttatccccacagccctggctttccacttgactacgagaggcggggagcctcatatgattgtctccaagcaggaaaggggaaaatctttactgtttaagacctcagcaggtgttaacatgtgcacactaatagccatggacctcggcgagctgtgtgaagatactatgacctacaaatgcccacggatcacagaggtggaaccggacgatgtagactgttggtgcaataccactgatacatgggtgacctatgggacgtgtagtcaaactggagagcaccgccgagacaagcgtagcgtcgcgcttgctccccatgtgggcctgggtttggagaccagagccgaaacatggatgtcctctgagggggcatggaaacagattcagaaggttgaaacttgggccctcaggcaccctggattcaccgtgatcgctctgtttctggcacatgccattggcacatcgatcacccagaagggcataatcttcattctcttaatgctggtcacgccatcaatggctatgcggtgcgtggggatcggaagccgcgattttgtagagggtcttagtggcgccacttgggttgacgtggtcttggagcacgggtcctgtgtgacaaccatggcgaaagataagcccactctggacattgaactactcaaaacagaggtgaccaaccctgcagtcctgagaaagctttgcatcgaagccaaaatatctaatacgaccacagatagcaggtgtccaactcaaggagaggctaccctggttgaagagcaggacgccaacttcgtgtgccggcgcacatttgtagatcgaggctggggtaatgggtgtggattgttcggcaagggctccctcattacttgcgcaaagtttaaatgcgtgaccaagctggaggggaaaatcgtccagtacgaaaacttaaagtattcagtgattgttacagtgcacaccggagaccagcatcaagtcggtaatgagagtactgaacacggcacgacagctaccatcactccccaggcccctaccagcgagatccagctgacagactacggggcgctcacccttgattgttctccaagaactggactggacttcaacgaaatggtgttgctaacaatgaaaggcaagtcctggctggtacataaacagtggtttctcgatctgccgcttccctggacgtcaggtgccagcaccagtcaagagacttggaataggcaggacctgttggttacattcaagaccgcacacgctaagaaacaggaggtggtcgtgctcgggtctcaagaaggcgccatgcacacagctctgactggagccaccgagattcagacgtccggcaccacaactatatttgcagggcatttaaagtgccggctgaaaatggataagctaaccctcaaaggaatgagctatgtcatgtgtacaggttcgttcaagctggaaaaggaggtggccgaaactcagcacggcaccgttcttgtgcagatcaaatacgaggggacggacgctccttgcaagattccattctctacacaagatgagaaaggagtaacccagaacggccgtttgatcactgcgaatcccatagtcacagacaaggaaaaacctgtgaacattgaggcagaaccaccctttggtgagtcctatatcgttatcggggccggcgagaaggctctgaagctctcatggttcaaaaagggaagtagcattggcaaaatgtttgaagccaccgcacgcggggccagaaggatggctatcctgggagatactgcctgggacttcggttccattggcggggtgtttacctctgtcggaaagcttgtgcatcagatattcggcacagcatacggtgtactgtttagcggggtgtcatggacgatgaaaatcggcattggagttttgctcacctggctgggcttaaatagtcggtccactagcctgtctatgacatgtatcgcggtcgggctagtgaccctctacctgggagtgatggtccaggctgattcaggctgcgttatcaactggaagggtcgagagcttaagtgtgggagtggaattttcgtgacaaatgaagtgcacacttggaccgagcaatataaatttcaggccgacagcccgaagcgcttgtccgcagccataggcaaagcttgggaagagggtgtatgcggcatcagatctgccacgaggctggagaacattatgtggcggcagatctcgaacgaactcaatcatattctgttagagaacgacatgaagttcacagtcgtggttggggatgtggtcggaatcctggcacagggcaaaaagatgatacgccctcaacccatggaacacaaatacagctggaagtcctgggggaaggctaaaatcattggagccgacgtgcagaataccacttttatcattgatggcccaaacacccctgagtgtcccgacgatcagagagcgtggaatatctgggaagttgaggactatggtttcgggatatttacaactaacatttggcttaagttgagggattcatacacccaggtgtgcgaccaccgtctcatgagtgccgctatcaaagattctaaggcagtacatgccgacatgggatattggattgagagcgaaaaaaatgagacatggaagctggctcgggcctccttcatcgaagtcaagacgtgtatatggccaaaatcacacaccctatggagcaacggcgtgctggagtctgaaatgatcattcccaagatctacggtggccctatttcccaacataattatcgaccagggtacttcactcagacagcaggaccgtggcacctcggcaaactggagcttgattttgacttgtgcgaggggaccactgtggtcgttgatgaacactgcggaaacagaggccccagtctgaggacaaccacggtgactggtaagatcatacatgagtggtgttgccgcagctgtaccttacctccactccggttcaaaggggaagacggatgctggtacggcatggagattagacccgtaaaggagaaggaagagaatctggtgaaatctatggtctccgcgggttcaggcgaagtggacagttttagccttgggctgttgtgtatctcgatcatgattgaggaagttatgaggtcccgctggtctcgaaagatgctcatgacaggaaccctggccgtgttctttctactgatcatgggccagctcacttggaacgatctgattcggagctgcataatggtcggggctaatgcctcagaccgtatgggaatgggcacaacctatcttgcattgatggctacattcaaaatgagacctatgtttgccgtgggtctgttattcaggcgcctcactagtcgggaggttctgcttctgaccatcgggctatccctcgtggcatctgtcgagctgccaaacagcttggaagagctgggagatggcttagccatgggcattatgatcctcaagctgcttacggactttcaatcctaccagctgtgggctacattgctctcactgaccttcattaaaactacctttagcctacactatgcgtggaagacaatggccatggtactgagtatcgtgtctcttctccccctgtgtttgtccactaccagccagaagacgacatggctgccggttttactcgggtcgctgggatgcaaacctcttaccatgttcctgatagcagaaaataagatctggggtagaaaatcatggccattgaacgagggcattatggctgtggggatcgtctctattctcctgagttccctactgaagaacgatgtgccccttgccggacctctcatcgccggcggtatgctgatagcttgttacgtaattagcgggtctagcgcagacttgtccttagaaaaagccgcggaggtgtcatgggaggaagaggctgaacatagtggagccagccacaatatcctggtcgaggttcaggatgacggcactatgaagatcaaagatgaagagagggacgatacactcaccattctgcttaaggcaactctgttggccgtgtctggcgtgtatcccctatccataccagctacactgtttgtctggtacttctggcaaaagaaaaagcagcgatcaggggtgctctgggacacccctagtcccccagaggttgaacgcgcagtactggatgacggaatctatcggattatgcagagaggtcttttaggcaggagccaggtgggggtcggagtgttccaagagaacgtttttcatacgatgtggcacgtgactcgtggcgccgtcctgatgtaccagggtaaacgcctcgaaccgtcctgggcgtctgtgaagaaagacttgatctcgtacgggggaggctggcggctgcagggcagctggaataccggggaggaggtacaggtcattgctgtggaacctggaaagaaccccaagaatgttcaaacagccccaggtaccttcaaaacacccgagggcgaagtgggggcaatcgccctcgattttaagcctggaacttcaggctccccaatagtcaacagagagggtaaaatcgtggggctgtatggaaatggcgttgtgaccacgagtggcacatacgtctctgctattgcccaggcaaaggctagccaggaagggccccttcctgagatcgaggacgaagtgttcaggaaacgaaacctgactattatggatttgcacccgggatccggtaagacccggcgctatctaccagccatcgtaagagaggcgataaagaggaaactgcggacactcattttagcccccacccgagtggttgcatcagaaatggctgaggccctgaagggcatgcctatcagataccaaactaccgctgtcaaatctgaacatacagggcgcgagatcgtggaccttatgtgccacgcaacgtttactatgaggctgctcagcccagtgcgtgtccccaattataacatgattatcatggatgaggcccatttcaccgaccctagttccatagccgctcggggatacattagcacaagagtaggcatgggtgaagcggcagccatctttatgaccgctactccgcccgggtctgtggaggccttcccacagtcaaatgcagttattcaggatgaagagagggacatccctgaacgctcctggaacagtggatatgagtggataacagattttcccggcaagaccgtgtggttcgtcccaagcattaaatcgggcaatgacatcgccaactgtttgcgaaagaatgggaagagagtgatccagctgtctcggaaaacgtttgatactgagtaccaaaagacaaaaaacaacgactgggactacgttgtgaccaccgatatttccgaaatgggagctaatttcagggcggaccgcgtcatcgatcctcgtagatgcctcaagcccgtgattctgaaagacggtccagagcgggtaatacttgccggcccgatgcctgtgactgttgcaagcgctgcccagaggcgcgggcgaatcggaagaaaccacaataaggaaggcgatcagtatatttacatgggtcagcccctaaacaatgacgaggatcatgcacactggacagaggccaagatgctgttggacaacatcaataccccagaagggatcattcccgctttattcgagcctgaacgggagaaatcagccgcgatagatggcgaatataggctgcgcggagaggcaagaaagacatttgtcgagctcatgaggcggggcgacctgccagtgtggcttagttacaaagtggcctctgaagggttccaatattccgatcgtcgctggtgctttgacggagagcgaaacaatcaggtcctggaagagaacatggatgttgaaatctggactaaggagggtgagagaaaaaagctcaggccccggtggttggacgctcgcacgtacagcgaccctctggccctaagagaattcaaagagtttgctgcaggcaggcggtcagtgagtggggatctgattctcgaaatcggaaagcttccgcagcacctgacccagcgagcccaaaatgctttagacaacttggtaatgctgcataatagcgagcagggcggtagagcctatcgccacgcaatggaagagctcccagatacaattgagactctgatgcttctggcgctcatcgccgtgttgaccgggggcgtcacactgttctttttatccggaaggggcctagggaagacctctataggactgctctgtgtgatggctagctccgcccttctgtggatggcatcagttgaaccccattggatcgctgcctctattatcttggagttctttctgatggtgctcctgattcctgaacccgaccggcagcgtactccacaggataaccaacttgcatacgtcgtaatcggtctcctgttcatgatattgacggtggccgctaatgagatgggcctgttagagaccacaaaaaaggacctagggattggacacgttgcggtggaaaaccaccatcacgccactatgctggatgtcgacctccatcctgcaagtgcttggaccctttacgccgtggccacaaccatcattactcccatgatgagacacacaatcgagaacacgaccgcaaatatatcgctgactgctatcgccaaccaggcggctattttgatgggcctggataaaggttggccaatcagcaagatggacattggggtccctctcctggcccttggctgctattcccaggtgaatccgttaacactgaccgcagccgttctcatgttggtggctcattacgcaatcataggacccggcctgcaagccaaagcgaccagggaagctcagaagcgcacagccgcagggattatgaagaacccaactgtagatggaatcgtggccatcgacctagatcctgtcgtttatgacgctaaatttgagaagcagctgggccagattatgctccttatcctgtgtacgtctcaaatattgctgatgcggaccacatgggccctctgcgaatcaattactctggcaaccggtcccttaacaaccctttgggaggggagcccaggaaaattctggaatactacgatcgctgtgtccatggccaacatttttcgaggcagttacctggcgggtgccggcctcgcattctctctaatgaagagcctggggggaggcagaagggggacaggagctcagggcgagaccttgggtgaaaaatggaagcgccagctgaatcagctctcaaagtccgagttcaacacttataaacggagtgggatcatggaagtcgacagaagcgaggccaaggaaggacttcgtaggggcgagaccacaaaacacgcagtgtctcggggtactgctaagctgcgctggtttgtagagcgaaatttggtgaaacctgaaggcaaggttatagatctggggtgtggaagaggcgggtggtcctactattgcgccggactcaagaaagtgaccgaggtcaagggctacacaaaaggtgggcccggacacgaagagccgatcccaatggccacgtacggctggaacttagtgaagctgcattcaggcaaagacgtcttctttattcctcccgaaaagtgtgatacccttctgtgcgacatcggggagagctcgccaaatcccactattgaggaaggaaggacactacgggtgctcaaaatggttgagccttggctgcgcggtaaccaattctgtatcaagattttgaatccgtatatgccctctgtagtggaaaccctggagcagatgcagagaaagcacggcgggatgctcgtcaggaacccacttagtcgaaattccactcatgagatgtactgggtgagctgcggaacaggcaacatcgtttcagcggtgaatatgacctcccggatgctgttaaaccgttttacgatggctcacagaaaacctacctatgaacgcgatgtcgacctgggtgcagggacaaggcacgtggccgtagagcccgaagtggctaacttggatataattggacagcggatcgagaatatcaagcatgaacacaaatctacttggcattacgacgaggataacccttataagacctgggcctaccacggcagctatgaggttaaaccaagtggctccgcaagctctatggtcaatggggtggtgaagctcctgacaaagccctgggacgtcattcctatggttactcaaatagccatgaccgatacaaccccattcggacagcagagagtgtttaaagaaaaggtagacactcgcacgcccaaagctaagaggggtacagcgcaaatcatggaggtgaccgcccgatggctatggggcttcctttcacggaacaaaaagccgagaatttgtactagggaagagtttacccgcaaggtccgtagtaatgcagctatcggggccgtgttcgttgacgaaaaccagtggaattccgcaaaagaggccgtggaggatgaacggttttgggacctggtccatagagagagggaactccacaagcagggaaaatgcgctacatgcgtgtacaacatgatgggcaagcgcgagaaaaagctgggtgaattcgggaaggccaaaggaagccgagcgatttggtacatgtggttgggcgcacggtttctggagttcgaggccctcggcttcatgaatgaagatcactggttttctagagagaactcgctttcaggggtagaaggagagggtctgcataagttaggctatatcctgagggacataagcaaaatccctgggggaaatatgtacgctgatgacacggccggctgggatacccgcattactgaggacgatttgcagaacgaagcaaagatcacagacattatggagccagaacacgctctcctggccacctccatcttcaaactaacttatcaaaataaggttgtgagagtccagcggcccgctaggaacggtacagtgatggatgtgataagtcgtcgagaccagcgcgggtctggacaggtcggcacctacggccttaatacatttactaacatggaggcccaactgattagacagatggaaagcgaggggatcttctccccttcagagctcgaaaccccaaacctggcagagcgggttttggattggttagaaaaacatggagtggagaggctgaagcgcatggcgatcagtggtgacgactgtgtagtgaagcccattgatgacagatttgccacggctctctctgcccttaatgatatgggcaaagtccggaaggacataccgcagtgggaacctagcaaagggtggaacgattggcagcaagtgcccttctgctcccaccactttcatcagctgatcatgaaggacggaagggagattgttgtgccatgtcgaaatcaggatgagctagtcggccgtgcaagagtgtcacagggtgctgggtggagcctgcgcgaaaccgcctgcctcggaaaatcttatgcacaaatgtggcagttgatgtacttccaccggagggacctgagacttgccgcgaacgctatctgttccgccgtacctgttgattgggtgcccacaagtcgcactacctggagcattcatgcacaccatcagtggatgacaactgaggacatgctgtcggtctggaatcgggtgtggatcgaagagaacccatggatggaagataagacccacatatcctcttggggcgacgttccctatctcggcaagagggaggaccaatggtgcgggtcattaatcggactgacggcccgagctacatgggccaccaatattcaggtggcaatcaaccaggtcagacggttgattggtaatgagaactacctggattacatgactagcatgaaaaggtttaagaatgaaagtgaccctgagggcgctctctggtga

SEQ ID NO: 13731 - RNA, 9879 nt, synthetic construct
  misc_feature 1..9879: note = derived and/or modified CDS sequence (opt3) from DENV-1__FJ882542__SS-prME
  source 1..9879: mol_type = other RNA
agcgtgaccatgctgctcatgcttatgcccaccgcactggctttccacttgactacgagaggaggggagcctcatatgatcgtcaccaagcaggaaaggggaaaatccttactgtttaagacatctgccggtgttaacatgtgcactctaattgccatggacctcggagagctgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaggaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggcagcttcaaactggagaaggaagtggctgagacccagcacggtacggtccttgtgcagataaagtacgagggcacagacgcgccttgcaaaatcccattctcgacccaagatgaaaagggggttactcagaacggacgcttgattacagcaaatcccatcgtgaccgacaaagagaagcctgtaaacatagaagccgagccaccctttggcgagtcttatattgtcatcggtgctggggaaaaagccctgaagctctcctggttcaagaaaggctcaagtatcggaaagatgtttgaggcaactgccagaggcgctaggcggatggccattctgggggataccgcatgggacttcggaagcgtgggtggcgtttttacatccgtggggaaacttgtccatcagatcttcggaacggcgtacggcgtgctgttttctggtgtaagctggaccatgaagattgggataggcgtgttgctcacttggctgggattaaattcacgaagtacatccctgagcatgacctgtatcgctgttggcctagtcacactctacctgggggtgatggtgcaggccgattctggatgcgtcattaactggaaaggccgcgaacttaagtgtggttcagggatcttcgttactaatgaggtgcacacctggacggaacaatataagtttcaggcagacagtccgaaaagattgagcgccgctatcggaaaggcctgggaggagggcgtgtgcggtattaggtccgcaacacggctggaaaacataatgtggaaacagatctctaacgagctcaatcatattctgttagaaaacgacatgaagttcaccgtagtcgtgggcgatgttgtggggatcctggctcagggcaaaaagatgattcgccctcaacccatggagcacaaatactcgtggaaaagctggggcaaggccaagatcataggggcggacgtccagaatactacctttatcattgatggaccatccacacctgaatgtcccgacgatcagagagcctggaacatctgggaggtggaggactatggcttcggtatttttactaccaatatctggcttaagttgagggattcatacacacaggtttgcgaccaccgtctcatgagtgctgcaataaaagattctaaggccgtgcatgctgacatggggtattggattgaaagcgagaaaaacgaaacgtggaagctggcccgggcatccttcatcgaggtaaagacctgtatttggccaaaatcacacactctatggagcaatggagtcctggaatctgagatgatcatacccaagatctacggcggtcctatttcccaacataactatcgaccaggctacttcacacagaccgcggggccgtggcacctcggaaaactggagcttgattttgacttgtgcgaaggcactacagtggtggtcgatgagcactgcgggaatagaggacccagtctgaggaccacgactgttaccggcaagatcattcatgaatggtgttgccgcagctgtacattacctccactccggttcaaaggtgaggacgggtgctggtacggaatggagatcagacccgtgaaggaaaaggaggaaaacctggtaaaatctatggtgtccgccggctcaggtgaggtcgacagttttagccttggcctgttgtgtatatcgattatgatcgaagaggtgatgaggtcccgctggtctcgaaagatgctcatgaccgggactctggctgttttcctactgctcatcatgggacagctgacatggaatgatcttattcggttgtgcatcatggtgggcgccaacgcaagcgaccgtatggggatgggaaccacatatctggctttaatggccacttttaaaatgagacctatgttcgcagtcggcctcctgtttaggcgccttacctcacgggaggtgctgctactcacgattggtctgagtttggttgcctccgtggaactgccaaattctttagaggaactcggggatggactggctatgggcataatgatccttaagctgttgacagacttccaaagccaccagctctgggcgaccctgctatccctgacttttattaaaaccacactttcactccattacgcctggaagactatggcaatggtcctgagcatcgctagtttgttccccctgtgtttatctaccacgtcccagaagacaacctggctcccggtactgcttggcagcctggggtgcaaacctttgactatgtttctcattacagagaccaagatctggggaagaaaatcgtggccactgaacgaaggtataatggccgtgggcgttgtgtcaatcctactgtctagtcttctcaagaatgatgtccccctggccgggcctttgattgctggaggcatgttaatcgcatgttatgtgatttccggtagctctgccgacctgagcctcgagaaagcggctgaggtatcctgggaagaggaagccgagcactcaggggcaagtcataacatcctggtggtcgttcaggatgacggaactatgaagataaaagatgaagagagggacgatacacttaccattctgttgaaggccacgctactggctgtgagcggcgtgtaccccctctctatcccagcaactctgttcgtctggtatttttggcaaaagaaaaagcagcgatccggcgtgctttgggacaccccttcacccccagaggttgaacgcgccgtattagatgacgggatctaccggattatgcagagaggactgctcggtaggagtcaggtgggcgtcggggtgttccaagagaacgttttccacacaatgtggcacgtgacccgtggagcggtcttgatgtatcagggcaaacgcctggaaccgagctgggcttccgtgaagaaagacctcatatcttacggtgggggatggcggctgcagggctcgtggaatacaggcgaggaggtacaggtcatcgccgtggaacctgggaagaaccccaagaatgttcaaactgcaccaggaacctttaaaacgcccgagggtgaagtgggcgccattgctcttgatttcaagcctgggacaagcggatcaccaatcgtcaacagagagggcaaaattgtgggtctgtacgggaatggagttgtgactacctccggcacatatgtcagtgccatcgcacaggctaaggcctctcaggaaggccccttgcctgagatagaggacgaagtgtttaggaaacgaaacctaaccatcatggatctgcatccggggagcggaaagactcggcgctacctcccagcgattgtaagagaggccatcaagaggaaattacggaccctgattcttgcacccacacgagtggttgcttccgaaatggccgaggctctgaagggtatgcctatcagatatcaaacgactgcagtcaaatcagaacacaccggcaaggagatagtggacctcatgtgccatgccacattcaccatgcgcttgctgtctccagtgagggtccccaattacaacatgattatcatggatgaggcccactttactgaccctagcagtatcgctgcgcgtgggtatatttccacacgggtaggaatgggcgaagcagccgctatcttcatgaccgccacgccgcccggtagcgtggaggcatttccacagtctaatgccgttatacaggatgaagagagagacattcctgaaaggtcatggaactccgggtacgagtggatcactgatttccccggaaaaacagtgtggtttgtcccaagtattaagagcggcaatgacatcgctaactgtctccgcaagaatggcaaacgagtgatacagctgtcgagaaagaccttcgataccgagtatcagaaaactaagaacaatgactgggactacgttgtgacaaccgatatttctgaaatgggggcgaactttcgggccgacagggtcatcgatcctcgccgttgccttaaacccgtgatcctaaaggacggaccagagagagtaattctggcaggtccgatgcctgtgacagttgcttccgccgcacagcggaggggccgcatcgggcgaaaccataataaggaaggagatcagtacatttatatgggccagcccttgaacaatgacgaggatcacgcccactggactgaggctaaaatgttactggacaacataaatacgccagaaggtatcattcccgccctcttcgagcctgaaagagaaaagagcgcggcaatcgatggggaataccggctgaggggcgaggcccgcaaaaccttcgtcgagcttatgagaaggggagacctgccagtgtggctctcatataaggtggctagtgaaggctttcaatactctgatcggcgttggtgcttcgacggggagcgcaacaatcaggtcttggaagagaacatggatgttgaaatctggacaaaagagggagagcgaaagaaactgagacccaggtggctagacgcccggacttattccgaccctctggctctccgcgaatttaaggagttcgcagccggtagaaggagcgtgtcaggcgatcttattctggaaatagggaagttaccgcagcatttgacccagcgggctcaaaatgccctggacaacctcgtaatgctgcacaatagtgagcagggaggccgagcatacagacatgcgatggaggaacttccagatacaatcgagaccctgatgctcttggccctgattgctgtgttaactggtgggatgacgctatttttcctgagcggccgcggactcggcaaaacctccatcgggcttctgtgtgtcatggcctctagcgtgttgctgtggatggcatccgttgaaccccactggattgctgcctcaatcatactcgagtttttcctgatggtgcttctcatccctgaacccgacaggcagcggacaccacaggataaccaactggcatatgtcgtaattggattgctgtttatgatcttaactgtggccgctaatgagatgggtctactggagaccacaaagaaagacctcggcattgggcacgttgcggtggaaaaccatcaccatgccaccatgcttgatgtcgacctgcaccctgcatctgcttggactttgtacgccgtggccacaacgatcataacccccatgatgcgtcatactattgagaatacaaccgcaaacatcagtctgaccgctattgccaaccaggcggctatcctcatgggactggataagggctggccaatatcgaaaatggacatcggtgtccctcttttagccctggggtgctacagccaggtgaatccgctcacattgactgcagccgttctgatgctagtggctcactatgcaattatcggccccggactgcaagccaaggcgacgagagaagctcagaagaggaccgccgcaggcattatgaaaaacccaacagtagatgggatcgtggccatagacctcgatcctgtcgtttacgacgctaagttcgagaaacagcttggacagattatgctgttgatcctgtgtacttcccaaatcctcctgatgcgcaccacatgggccttatgcgaatctattacccttgcaactggccccctgacgacactctgggagggttcaccagggaagttttggaataccactatcgctgtgagcatggccaacatattccggggatcctatctagcgggcgccggtctggcatttagtttgatgaaatctctgggcgggggacgaagaggcaccggggctcagggagagacactcggcgaaaagtggaagaggcagcttaatcagctgagcaaatcagagttcaacatttacaagcgctccggtatcatggaagtcgaccggagtgaggccaaagaagggttgaagagaggagagactacccgtcacgcagtgagcaggggcacagctaaactgcggtggttcgtagagcgcaatctcgtgaagcctgaaggtaaggttattgatttaggctgtgggcgaggaggctggtcttattactgcgccgggctgaaaaaggtgacggaggtcaaaggatataccaagggcggtcccgggcatgaggagccgatcccaatggccacttacggatggaaccttgtgaaactgcactccggcaaggacgtctttttcacacctcccgaaaaatgtgataccctactctgcgacataggcgagtcaagcccaaatcccactatcgaggaagggagaacactgagggtgttgaagatggttgagccttggctgcggggaaaccaattttgtattaagatcctcaatccgtacatgccctcggtagtggaaacccttgagcagatgcagcgcaaacatggtggcatgctggtcagaaacccattatctaggaatagtacgcacgagatgtattgggtgtcctgcgggaccggaaacattgttagcgcggtgaatatgacatcacgaatgctgttgaaccggttcactatggctcaccgtaagcctacctacgaaagagatgtcgacctcggcgcaggtacacgccatgtggccgtagagcccgaagtggctaatctggatatcattgggcagaggatcgagaacataaaacacgaacataagtccacttggcactatgacgaggataacccttacaaaacctgggcctatcatggatcttacgaggttaagccaagcggcagtgcatccagcatggtcaatggcgtggtgaagctacttacaaaaccctgggacgtcattcctatggttacccaaatcgccatgactgatacgacaccatttgggcagcagcgggtgttcaaggaaaaagtagacaccagaactcccaaggctaaacgcggaaccgcgcaaatcatggaggtgacagccaggtggctgtggggttttctctctcgaaacaagaagccgcggatttgtacgagagaagagttcaccaggaaagtccgctcaaatgcagctataggcgccgtgtttgttgacgaaaaccagtggaatagtgcaaaggaggccgtggaggatgaacgtttctgggacctggtccagaaagagcgggaattgcacaagcaggggaaatgcgctacttgcgtgtataacatgatgggaaagagagagaagaaactgggcgaatttggtaaggccaaagggtccagggcgatctggtacatgtggctcggagcacgcttccttgagtttgaggccctgggcttcatgaatgaagatcactggttcagccgagagaactctttatcgggcgtagaaggggagggactgcataagttgggttacattctccgggacatctcaaaaattcctggcgggaatatgtatgctgatgacacagccggatgggataccagaatcactgaggacgatctgcaaaacgaagcaaagataacagacatcatggagccagaacacgctctacttgccaccagcatttttaaactgacataccagaataaggttgtgagggtccagcgccccgctaagaacggcactgtgatggatgtgatctccagacgggaccagaggggtagtgggcaagtcggaacctatggcctcaatacgttcaccaacatggaggcccagctgattcgtcagatggaatctgagggcatctttttgcctagcgagttagaaacaccaaatctggcagagcgagttctcgattggcttgaaaaatacggggtggagcgcctgaagagaatggcgatatccggagacgactgtgtagtgaaacccattgatgaccggttcgccactgctctaaccgccctgaacgatatgggtaaggtcaggaaagacatcccgcagtgggaaccttcaaagggctggaacgattggcaacaggtgcccttttgcagtcatcacttccaccagctcatcatgaaggacgggcgcgagattgttgtgccatgtagaaatcaggatgagttggtcggacgggcaagggtgtctcaaggcgctggttggagcctgcgagaaacagcctgccttgggaaatcctatgcacagatgtggcagctgatgtactttcatcgtagagacctccgcttagccgcgaacgctatatgttcagccgtacctgttgattgggtgcccactagccggaccacgtggtctatccacgcacatcaccaatggatgacaaccgaggacatgctgtccgtctggaatagggtgtggattgaagagaacccatggatggaagataagactcatgttagtagctggggagacgtgccctatttgggcaaaagagaggaccagtggtgcggctcgctgatcgggctcacagcccgcgctacctgggcctccaatattcaggtcgcaatcaaccaggtgcggaggcttataggaaatgagaactacctggattacatgacttctatgaagcgattcaaaaatgaaggtgaccctgagggcgctctatggtga

SEQ ID NO: 13732 - RNA, 9879 nt, synthetic construct
  misc_feature 1..9879: note = derived and/or modified CDS sequence (opt3) from DENV-1__FJ882543__SS-prME
  source 1..9879: mol_type = other RNA
agcgtgaccatgctgctcatgcttatgcccacagcactggctttccacttgactacgagaggaggggagcctcatatgatcgtcaccaagcaggaaaggggaaaatccttactgtttaagacatctgccggtgttaatatgtgcactctaattgccatggacctcggcgagctgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggtagcttcaaactggagaaggaagtggctgagacccagcacggaacggtccttgtgcagataaagtacgagggcacagacgcgccttgcaaaatcccattctcgacccaagatgaaaagggggttactcagaacggacgcttgattacagcaaatcccatcgtgaccgacaaagagaagcctgtaaacatagaagccgagccaccctttggcgagtcttatattgtcatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtgtttacatccattgggaaacttgttcatcagatattcggaacggcgtacggcgtgctgttttctggtgtcagctggaccatgaagatcgggattggcgtgttgctcacttggctgggattaaattcacgaagtacatccctgagcatgacctgtatcgctgtaggcctagtgacactctacctgggggttatggtccaggccgattctggatgcgtgatcaactggaaaggccgcgaacttaagtgtggttcagggattttcgtgactaatgaggtccacacctggacggaacaatataagtttcaggcagacagtccgaaaagattgagcgccgctataggaaaggcctgggaggagggcgtttgcggtatcaggtccgcaacacggctggaaaacattatgtggaaacagatctctaacgagctcaatcatattctgttagaaaacgacatgaagttcaccgtggtggtaggcgatgtcgtggggatcctggctcagggcaagaagatgatacgccctcaacccatggagcacaaatactcgtggaaaagctggggcaaggccaagatcattggggcggacgttcagaatactacctttatcattgatggaccaaacacacctgaatgtcccgacgatcagagagcctggaatatctgggaggtggaggactatggcttcggtatatttactaccaacatttggcttaagatgagggattcctacacacaggtctgcgaccaccgtttgatgtcagctgcaatcaaagatagtaaggccgtgcatgctgacatggggtattggattgaatctgagaaaaatgaaacgtggaagctcgcccgggcatccttcatcgaggttaagacctgtatatggccaaaatcccacactctgtggtcaaacggagtgctagaaagcgagatgatcattcccaagatctacggcggtcctatttctcaacataatcaccgaccaggctatttcacacagaccgcggggccgtggcacctgggaaaactcgagctggattttgacctttgcgaaggcactacagtagtcgtggatgagcattgcgggaacagaggaccctccttgaggaccacgactgtgaccggcaagatcatacacgaatggtgttgccgcagttgtacactgcctccattacggttcaaaggtgaggacgggtgctggtacggaatggagattagacccgtcaaggaaaaggaggaaaatctcgttaaaagcatggtgtctgccggctccggtgaggtagactcatttagtctgggccttctgtgtatcagcatcatgattgaagaggtgatgaggtcgcgctggtcccgaaagatgttgatgaccgggactctcgctgtcttcctgctactgatcatgggacagctcacatggaacgatctgattcggctttgcataatggtgggcgccaatgcatctgaccgtatggggatgggaaccacatacttggctctgatggccacttttaaaatgagacctatgttcgcagttggcttactctttaggcgcctgaccagccgggaggtgcttctgctaacgatcggtctctcactggtcgccagtgtggaattgccaaactccctggaggaattaggggatggactcgctatgggcattatgatcctgaaacttctgacagacttccaatctcatcagttgtgggcggccctcctgagcctaacctttattaaaactaccctgtcccttcactatgcatggaagacaatggctatggttctctcaatcgtgagcctgatacccttgtgtctgagtactacctctcagaagacgacatggttaccggtcctcctgggctcccttgggtgcaaacctctgaccatgttcttgatcgccgagaataagatttggggaagaaaaagctggccactcaacgaaggtatcatggccgtaggcgtggtttcgattctgctatcatctctgcttaagaacgatgtgcccctcgctgggcctctgatcgcaggaggcatgttgatagcctgttacgtcattagtggttccagcgcggacttatctctggagaaagctgccgaggtgagctgggaagaggaagcagagcattccggggcctcacacaatatcctcgtagaagtgcaggatgacggaactatgaagatcaaagatgaggagagggacgatacactgaccattcttctgaaggctactttgctagcagtcagtggcgtttatcccctgagcataccagccacactctttgtgtggtacttctggcaaaagaaaaagcagcgatctggcgtgctgtgggacaccccttcacccccagaagtcgagcgcgcggtgcttgatgacgggatctatcggattatgcagagaggattactgggtaggagccaggttggcgtaggggtgtttcaagaaaacgtcttccacacgatgtggcatgtgactcgtggagctgttctcatgtaccagggcaaacgcttggagccgagttgggccagcgtgaagaaagacctgatctcctatggtgggggatggcggctccagggctcttggaataccggcgaggaagtccaggtgattgcagtagagcctgggaagaaccccaagaatgtccaaacagccccaggaaccttcaaaacacccgaaggtgaggtgggcgctatcgccctggattttaagcctgggacttcgggaagcccaatagttaacagagaaggcaaaatcgtgggtctttacgggaatggagtcgtgaccacgtcaggcacatacgtttccgcaattgctcaggccaaggcgagtcaggagggccccctgcctgagatcgaagacgaggtgttcaggaaacgaaacttgactattatggatctacacccggggtctggaaagacccggcgctatctgccagccatcgtcagagaagcaataaagaggaaactccggacattaattctggctcccacccgagtggtagccagcgagatggctgaagcacttaagggtatgcctatcagataccaaactaccgccgtgaaatccgagcatacaggcaaggagatcgttgacctgatgtgccacgccacgtttactatgcgcctcttgtcaccagtcagggtgcccaattataacatgattatcatggatgaagctcatttcaccgacccttctagcatagcggcacgtgggtacattagtacacgggtgggaatgggcgaggccgctgccatctttatgaccgcaactccgcccggttccgtcgaagccttcccacagagcaatgctgtaattcaggatgaggaaagagacatccctgagaggtcttggaactcagggtatgagtggataacagattttctgggaaaaaccgtgtggttcgttccctccattaagagtggcaatgacatcgcgaactgtctccgcaagaatggcaaacgagtgatccagctgagcagaaagacgtttgatactgaataccagaaaaccaagaacaacgactgggactatgtcgtgaccaccgatatttcggagatgggggccaatttccgggcagacagggttatcgatccacgccgttgccttaaacctgtgattctaaaggacggacccgaaagagtcatactggctggtccaatgccggtgactgtagcctctgcagcccagcggaggggccgcatcgggcgaaaccacaataaggagggagatcagtacatttacatgggccagcctttgaacaatgacgaggatcacgctcattggacagaagccaaaatgttactggacaacatcaatacccccgagggtatcattccagcgctctttgaacccgagagagaaaagtccgcagccatagatggggagtatcggctgaggggcgaggctcgcaaaacattcgtggaacttatgagaaggggagacctgcctgtttggctcagctacaaggtcgcctcagagggcttccaatatagtgatcggcgttggtgctttgacggggaacgcaacaatcaggtgttggaggaaaacatggatgtggagatctggactaaagagggagaacgaaagaaactgagaccaaggtggctagacgctcggacgtactctgaccccctggcactccgcgagttcaaggaatttgccgctggtagaaggtccgtcagcggcgatcttattctggagatcgggaagttacctcagcacttgacccagcgggcccaaaatgcactggacaacctcgttatgctgcataattcagaacagggaggccgagcgtatagacacgccatggaggagcttccggatacaattgaaactctgatgctcttggctctgatcgccgtgttaaccggtggggtaacactattctttctgagtggccgcggactcggcaaaaccagcatagggcttctgtgtgtgatggcatcctctgtcttgctgtggatggctagcgtggagccacactggatcgccgcatccattatcctcgagttctttctgatggttcttctcattcccgagcctgacaggcagcggactccccaggataaccaactggcctacgtggtcatcggattgctgttcatgatattaacggtagctgcgaatgagatgggtctactggaaaccacaaagaaagacctcggcattgggcatgtggccgttgagaaccaccatcacgcaactatgcttgatgtggacctgcatccagcttcagcctggaccttgtatgccgtcgcaacaaccatcattactcctatgatgcgtcacacaatcgaaaacacgaccgctaatatatctctgactgccatcgcgaaccaggctgccattctcatgggactggataagggctggcccatcagtaaaatggacattggtgtgccacttttagcactggggtgctactcgcaggtcaatcctctcacattgaccgccgctgtgctgatgctagttgcacactacgccatcataggcccgggactgcaagcgaaggctaccagagaggcccagaagaggacagcagccggcattatgaaaaaccccactgtggatgggatcgtagctatcgacctcgatccagtggtctatgacgccaagtttgaaaaacagcttggacagattatgctgttgatcctgtgtacgagccaaatactcctgatgcgcaccacatgggcattatgcgagtccattactcttgctaccggccctctgacaaccctctgggagggttctcccgggaagttctggaatactacgatcgccgtttcaatggcgaacatttttcggggaagctacctagccggcgcaggtctggctttctccttgatgaaaagtctgggcgggggacgaagaggcacaggggcccagggagaaaccctcggcgagaagtggaagaggcagcttaatcagctgtctaaaagcgaatttaacatctataagcgctcaggtataatggaggtggaccggtccgaagcaaaagaggggttgaagagaggagagactacccgtcatgctgtcagtaggggcacagccaaactgcggtggttcgtggaacgcaatctcgtaaagccagagggtaaggtgatcgatttaggctgtgggcgaggaggctggagctactattgcgccgggctgaaaaaggttactgaagtgaaaggatacaccaagggcggtcctgggcacgaggaacccattccgatggcgacatatggatggaaccttgtcaaactgcattctggcaaggacgtgttctttacgccacctgagaaatgtgataccctactctgcgacatcggcgagtcctcacccaatccaactattgaagaggggagaacactgagggtcttgaagatggtggaaccctggctgcggggaaaccaattctgtatcaagattctcaatccttacatgccgagcgttgtagagacccttgagcagatgcagcgcaaacacggtggcatgctggtgagaaaccccttatcgagaaattctactcacgaaatgtactgggtcagttgcgggacaggaaacatcgtgtccgctgttaatatgaccagccgaatgctgttgaaccggtttacgatggcacatcgtaagccaacctatgagaaagatgtggacctcggcgccggtacaagacacgtcgctgtggaacctgaggtagccaacctggatataattgggcagcgcatcgaaaatatcaagcatgagcacaaatcaacttggcattacgacgaggataacccctataagacctgggcataccacggatcctatgaagtgaagccttctggcagcgccagttccatggttaatggcgtcgtgaaactacttacaaagccatgggacgtgattcccatggtcactcaaatagctatgaccgatacaacccctttcgggcagcagagggtttttaaagagaaggtggacactcggacgccaaaagcgaagagaggaacagtacaaatcatggaagtgaccgcccgctggctgtggggtttcctcagcaggaacaagaaaccccgaatttgtactcgggaggaatttaccagaaaggtcaggtctaatgcagctatcggcgccgtgttcgttgacgagaaccagtggaactcagcaaaagaggccgtggaagatgagcgcttttgggacctggtcaagaaagaacgtgagttgcacaagcaggggaagtgcgctacatgcgtgtacaacatgatgggaaaacgggaaaagaaactgggcgagttcggtaaggccaaagggagtagagcgatttggtatatgtggctcggagcaaggtttcttgagttcgaagccctgggctttatgaatgaggatcattggttctcccgcgaaaacagcttatctggcgtagagggggagggactgcacaagttgggttacatcctccgagacatatcgaaaatcccgggcgggaatatgtacgctgatgacacggccggatgggatacccggattactgaagacgatctgcagaacgaggcaaagatcacagacattatggaacctgagcatgctctacttgccacctcaatcttcaagctgacttatcaaaataaagttgtgagagtccagaggccagctaagaacggcacagtgatggatgtgataagccgcagagaccagcggggttccgggcaggtcggaacctacggcctcaatacatttactaacatggaagcccaactgattaggcagatggagagtgagggcatcttcttgccctctgaattagagacccctaacctggcagaacgtgttctcgattggcttgagaaatatggggtggaacgactgaagcgcatggcgatcagcggagacgactgtgtagtgaaaccaattgatgacagatttgccacggctctaaccgccctgaatgatatgggtaaggtccggaaggacataccccagtgggagccgtccaaaggctggaacgattggcagcaagtgcctttctgctcacaccactttcatcagctcatcatgaaggacgggagggagattgttgtgccctgtcgcaatcaggatgaattggtcggaagggcacgggtgagtcagggcgctggttggtctctgagggagacagcctgccttgggaaaagctacgcacaaatgtggcagctgatgtatttccaccgacgtgacctcagattagccgcgaacgctatctgttccgccgtaccagttgattgggtgcctacttcacgcaccacatggagcattcatgcacaccatcagtggatgactaccgaagacatgctgtctgtctggaatcgggtgtggatcgaggaaaacccctggatggaggataagacgcacgtttccagttgggaggacgtgccatacttgggaaaaagggaagaccaatggtgcggcagcctgataggcctcacagccagagctacctgggcctcgaatatccaggtcgcaattaaccaggtgcgccggcttatcgggaatgagaactatctggattacatgacttccatgaagaggtttaagaatgaaggagaccccgagggtgctctatggtga

SEQ ID NO: 13733 - RNA, 9879 nt, synthetic construct
  misc_feature 1..9879: note = derived and/or modified CDS sequence (opt3) from DENV-1__FJ882544__SS-prME
  source 1..9879: mol_type = other RNA
agcgtgaccatgctgctcatgcttatgcccacggccctggctttccacttgactacgagaggaggggaacctcatatgatcgtctccaagcaggaaagaggaaaatctttactgtttaagacctcagccggtgttaacatgtgcacactaattgccatggacctcggagaactgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggactgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaaacagagattttgtggagggtcttagcggcgccacatgggtagacgttgtgttggagcacgggagttgtgtcaccactatggcgaaggataaacccacactggacatcgaactactcaagaccgaggtgacgaatcctgcagtgctgaggaaactttgcattgaagccaagatctccaacaccacaactgattctcggtgtccaacccaaggagaggctacactggtcgaagaacaagacgccaatttcgtttgccgccgaacttttgtggatagaggctggggtaacgggtgtggattgttcggcaaaggcagcctcataacctgcgcaaagtttaagtgcgtaacaaaactggaggggaagattgtgcagtacgaaaatttaaaatattccgtcatcgtgaccgttcacactggagaccagcatcaagtgggtaacgagtcaacggaacacggcacaaccgctactattacaccccaagcccctaccaccgagatccagctgactgactacggggcgctcacacttgattgtagtccaaggacgggactggacttcaatgaaatggtcttgctaaccatgaaggagaaaagctggctggtgcataagcagtggtttctcgatctgccgcttccctggacttctggcgcctccacatcacaagagacctggaaccggcaggacctgttggtaacattcaaaactgcacacgctaagaagcaggaagttgtggtcctcggtagccaagagggggccatgcacaccgctctgacgggcgccaccgaaatccagacaagtggaactaccacaatttttgcaggccatttaaaatgccgtctgaagatggataaactaactctcaaggggatgtcttatgtgatgtgtaccggatccttcaaactggagaaggaagtcgccgagacgcagcacggtacagtgcttgttcagataaagtacgagggcaccgacgctccttgcaaaatcccattcagcactcaagatgaaaagggggtgacacagaatggacgcttgattaccgcgaaccccatcgtaactgacaaaggcaagcctgtcaatatagaggcagaaccaccctttggtgagtcgtatattgtgatcggggccggcgagaaagctctgaagctctcttggttcaagaaaggatcctcaatcggcaagatgtttgaagccaccgcaagaggggccaggcggatggctattctgggagatacagcctgggacttcggtagtatcggcggggtttttacgagcgtgggaaaacttgtccatcagattttcggcaccgcatacggtgtgctgttttccggggtatcttggactatgaagataggcatcggagtgttgctcacatggctgggcttaaacagccgatcaaccagtctgtccatgacatgtattgcggttgggctagtcactctctacctgggagtgatggtgcaggctgatagcggctgcgtcatcaattggaaaggtcgcgagcttaagtgtgggtctggaatcttcgttaccaacgaagtgcacacgtggacagagcaatataagtttcaggccgactcaccgaaaagattgagtgcagccattggcaaggcttgggaagagggtgtgtgcggcataaggagcgccacccggctggagaacatcatgtggaaacagatttccaatgaactcaaccatatcctgttagagaatgacatgaagttcactgtagtcgtgggggatgttgcaggcattctggctcagggcaaaaagatgatccgccctcaacccatggaatacaaatattcttggaagtcgtgggggaaggccaaaataatcggagcggacgtgcagaacaccacatttattatcgatggcccaaatactcctgagtgtcccgacgatcagagagcctggaacatttgggaagtcgaggactacggtttcgggatctttaccacaaatatatggcttaagttgagggatagctatacacaggtgtgcgaccaccgtctcatgtccgctgcaattaaagattcaaaggccgttcacgctgacatgggatactggatcgagagtgagaaaaatgagacctggaagctggcccgggcatctttcattgaagtgaagacttgtatctggccaaaaagccatacactatggtccaatggcgtactggagtcagaaatgataatccccaagatttatggtggccctatcagccaacacaactaccgaccagggtacttcacccagactgcgggaccgtggcatctcggcaaactggagcttgattttgacttgtgcgaggggacaaccgtcgtggtggatgaacactgcggaaatagaggcccctctctgaggacgactaccgtcacaggtaagattatccacgagtggtgttgccgctcctgtaccttacctccactccggttcagaggggaagacggatgctggtatggcatggagataaggcccgttaaagagaaggaagagaacctggtgaagagtatggtaagcgccggttctggcgaagtggactccttttcacttgggctgttgtgtattagtatcatgatcgaggaagtcatgcgcagccgatggtcgcggaaaatgctcatgactggaacactggctgtgttctttctactgattatgggccagctcacctggaatgatctgatccgtctttgcattatggttggggccaacgcatccgacagaatgggaatgggcacaacttacttggctctgatggccaccttcaagatgaggcctatgtttgcagtgggtttactcttccgccggctgacgtctagagaggtccttctgctaacaatagggctcagcctggtggcctcagttgagttgccaaatagtctggaagagttaggagatggcctcgctatgggcatcatgattctgaaacttctgaccgactttcaatcccatcagttgtgggcgactctcctgtctctaaccttcatcaagacaacttttagcctgcactatgcctggaaaaccatggcaatggtgctttccattgtctcactcttccccctgtgtttgagcacgacaagtcagaagaccacttggctgccggtattactcgggtctctgggatgcaagcctcttacaatgtttctgatcgctgaaaacaaaatatggggtaggcgatcctggccattgaacgagggcatcatggccgtggggattgttagcatcctcctgtcgtcactactgaagaatgatgtgccccttgccggacctctcattgctggcggtatgctgatcgcatgttacgtcatatctgggagttccgccgacttgagcttagaaaaagcggctgaggtgtcttgggaggaagaggccgaacatagcggagcatcccacaacattctggtagaggtgcaggatgacggcaccatgaagatcaaagatgaagaacgcgacgatactctcacaatcctgcttaaggccaccctgttggctgtctcaggcgtttatcccctaagtattccagcaacgctgttcgtgtggtacttctggcagaaaaagaagcagcggagcggggtgctctgggacactccttctcccccagaggtcggcagagccgtgctggatgacggtatatataggatcatgcagcgtggccttttagggcgctcccaggttggagtaggcgtgtttcaagaaaatgtcttccataccatgtggcacgtgacacggggtgcggttctgatgtaccaggggaaaagactcgagccgtcatgggctagtgtgaagaaagacttgattagctacggaggcggctggaggctgcaggggtcctggaacaccggagaagaggtccaggtgatcgccgtagagcctggtaagaatcccaaaaacgtccaaacagcaccaggcacttttaagacccccgaaggggaggtgggagccattgctctcgatttcaagcctggcacgtctggttcgccaatcgttaatcgagaagggaaaatagtgggactgtatggcaacggcgtcgtgacaactagcgggacctacgtttcagccatcgcacaggctaaggcctcccaggagggaccccttcctgaaattgaggacgaggtgtttcggaaacgcaatctgacaatcatggatttgcacccgggtagtggcaagaccagaaggtatctaccagcgattgtccgggaagccatcaaacgaaagctgagaactctcatattagcacccacccgcgtggtagcttctgagatggccgaagctctgaaggggatgcctattaggtaccaaacaacggcagtgaaaagcgagcatactggaaaggaaatcgttgaccttatgtgccacgccaccttcacaatgcgtctgctctccccagtccgggtgcccaactataatatgatcattatggatgaggcccattttaccgacccttcatctatcgctgcgagaggctacataagcactagggtgggtatgggggaggcagccgctattttcatgacagccaccccgcccggaagtgtcgaagcatttccacagtccaacgccgtaatccaggatgaggaacgcgacattcctgagcgaagctggaactctggctatgaatggatcacggatttccccggcaaaactgtgtggtttgttccatcaataaagtccgggaacgacattgctaattgtttgaggaaaaacggaaagcgggtgatccagctgagtaggaagacattcgataccgagtaccagaaaaccaagaacaatgactgggactacgtcgtgactacagatatcagcgagatgggtgcgaacttccgcgccgaccgtgttattgatcctagacggtgcctcaaacccgtgatcctgaaggacggcccagaaagggtcattcttgcagggccgatgcctgtgaccgtagcttcggccgcacagcgccgaggaagaataggccggaatcacaacaaagagggtgatcagtatatctacatggggcagcccctaaataacgacgaagatcatgcccactggacagaggctaagatgctgttggacaatattaacactccagagggcatcatccccgccttatttgaacctgagagggaaaagtctgcggcaattgatggagagtatcgcctgagaggcgaagccaggaaaacgttcgtggagctcatgcggcgtggggacctgccagtttggctttcctacaaggtcgctagcgagggatttcaatattcagatcgccgatggtgcttcgacggtgaaagaaataaccaggtgctggaggaaaatatggatgtggagatatggaccaaagaaggcgagaggaagaaactccggccccgctggttggacgccagaacatacagtgaccctctggctctaagggagtttaaggagttcgcagccgggcggcgatctgtctccggagatctgatcctcgagattggcaaacttccgcagcacctgactcagagagctcaaaacgccttagacaatttggttatgctgcataacagcgaacagggtgggcgcgcatataggcacgcgatggaggaactcccagataccatcgagacactgatgcttctggccctcattgctgtgttgaccggcggagtaactctgtttttcttatcaggccgggggctaggaaagacgagtatcggtctgctctgtgtgatggccagctccgtccttctgtggatggcatctgtggagccccattggatagctgccagcatcattttggaatttttcctgatggttctcctgatccctgagcccgaccgtcagagaaccccacaggataatcaacttgcatacgtggtcattggcctcctgtttatgatcttgacagtagccgctaacgaaatggggctgttagagactaccaagaaagacctaggaataggccacgtggcggttgagaaccaccatcacgccgcaatgctggatgtggacctccatcctgcttccgcctggacactttacgccgtcgcaaccactattatcacacccatgatgaggcacacgattgaaaataccactgctaacatctcactgacagccatagcgaatcaggctgccatcttgatgggtctggataaggggtggccaatttctaaaatggacatcggcgtgcctctcctggcacttggatgctatagtcaggtcaacccgttaaccctgaccgccgctgtgctcatgttggttgcacattacgccattatcggccccgggctgcaagcgaaggctacacgcgaggcccagaaacggactgcagccggaataatgaagaatccaacggtggatggcattgtagctatcgacctagatcctgtggtctatgacgccaagttcgaaaaacagctgggtcagatcatgctccttattctgtgtacctcgcaaatcttgctgatgcgaacaacttgggcactctgcgagagcataaccctggctacagggcccttaaccactctttgggaaggatccccaggcaagttttggaacacgacaattgccgtttctatggcgaatatcttcagaggttcatacctggccggcgcagggctcgctttcagcctaatgaaatccctgggaggcgggaggcgcggaaccggcgcccagggtgagactttgggggagaagtggaaacggcagctgaaccagctcagtaagtctgaatttaatacctataagagaagcggaattatggaggtggaccgttcagaagcaaaagagggccttaagaggggtgaaacaactaaacacgctgtctcccggggcaccgccaagctgcgctggttcgtggagcgaaacttggtaaaacctgaggggaaggtgatcgatctgggatgtggcagagggggatggagttactattgcgccggcctcaagaaagttacagaagtgaagggttacacgaaagggggacccggccacgaggaaccgataccaatggcgacctacggctggaatttagtcaagctgcatagcgggaaagacgtgtttttcatccctcccgagaagtgtgatactcttctgtgcgacattggagaatcttccccaaaccccacaatcgaggagggtaggaccctacgggtcctcaaaatggtggaaccttggctgcgcggcaatcaattttgtattaagatcttgaacccgtatatgccctcagttgtagagactctggaacagatgcagagaaagcacgggggaatgctcgtgaggaatccacttagccgaaactcgacacatgagatgtactgggtctcttgcggcaccggtaatattgtgagtgctgttaacatgacgtcccggatgctgttaaaccgtttcaccatggcacacagaaaacctacatatgagcgcgatgtggacctgggggccggaactaggcacgtcgctgtggaacccgaggtagccaatttggatatcataggccagcggattgaaaacatcaagcatgagcacaaaagcacctggcattacgacgaagataatccttataagacatgggcataccacggctcatatgaggtgaaaccatccgggtctgccagcagtatggttaacggagtcgtgaagctcctgactaagccctgggacgtgatccctatggtcacccaaattgctatgacagataccactccatttggtcagcagagagttttcaaagagaaggtggacacgcgcacacccaaagcgaagaggggcaccgcccaaataatggaagtaactgcaaaatggctatgggggtttctttcccgaaataagaagccgcggatctgtaccagagaggagttcacaaggaaagtgcgcagcaacgctgccattggagcagtctttgtggacgagaatcagtggaactctgccaaggaagctgttgaggatgagcgtttctgggacctggtgcatcgggaaagagagctccacaaacagggcaagtgcgccacgtgcgtctacaatatgatgggtaaaagggaaaagaagctgggggagtttggaaaagcgaagggctcacgcgcaatctggtacatgtggttgggcgcccgattcctggagttcgaggctctcgggtttatgaacgaggatcactggttcagtcgggaaaattcccttagcggagtggagggtgaaggcctgcataaattagggtatattctgagagacatctctaacatacctggaggcaatatgtacgccgatgacaccgcaggttgggatactaggatcacagaggacgatttgcagaacgaggctcgcattaccgacatcatggaaccagagcacgccctcctggctaagtcgatttttaaactaacttatcaaaataaggtagttagagtgcagcggcccgccaaaaacgggacagtcatggatgtgatctcaaggcgtgaccagcgaggaagcggccaggtgggcacctacgggcttaacacattcactaatatggaagcacaactgatacgccagatggagtccgaaggaatttttagtccttctgagctcgagaccccaaacctggcggaaagagtcttggattggttagagaagtatggtgttgaacggctgaagaggatggccatcagcggcgacgactgtgtggtaaaacccatcgatgaccgcttcgctacggccctcaccgcacttaatgatatggggaaggtgagaaaagacattccgcagtgggagccttccaagggatggaacgattggcagcaagtccccttttgctcacatcacttccaccagctgataatgaaagacggccgggaaatcgtggttccatgtaggaatcaggatgagctagtgggtcgagctcgtgtcagtcagggggccggatggtctctgagagagacagcatgcctcggcaagagctacgcccaaatgtggcagttgatgtattttcatcgccgggacctgaggcttgcggctaacgccatttgttccgcagtgcctgtagattggatccccacttcaagaaccacatggagcattcacgcccatcaccagtggatgactaccgaagacatgctgtctgtttggaatcgcgtgtggatcgaggaaaacccatggatggaggataagacgcatatatccagttggggcgacgtcccctacctcgggaaacgggaagaccaatggtgcggcagcttaatcggtctgacagctagggccacctgggcaactaatattcaggtggctatcaaccaggttcgaagattgattggcaatgagaactacctggattatatgacatcgatgaagcggttcaaaaatgagtccgaccctgaaggggccctctggtga

SEQ ID NO: 13734 - RNA, 9879 nt, synthetic construct
  misc_feature 1..9879: note = derived and/or modified CDS sequence (opt3) from DENV-1__FJ898371__SS-prME
  source 1..9879: mol_type = other RNA
agcgtgaccatgctgctcatgcttatgcccacagccctggctttccacttgactacgagaggcggggagcctcatatgatcgtcaccaagcaggaaaggggaaaatccttactgtttaagacatctgcaggtgttaacatgtgcactctaattgccatggacctcggcgagctgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagagcaggacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattaccccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggaagcttcaaactggagaaggaagtggctgagacccagcacggtacggtccttgtgcagataaagtacgagggcacagacgcgccttgcaaaatcccattcttgacccaagatgaaaagggggttactcagaacggacgcctgattacagcaaatcccatcgtgaccgacaaagagaagcctgtaaacatagaagccgagccaccctttggcgagtcgtatattgtcatcggtgctggggaaaaagccctcaagctgtcttggttcaagaaaggctcctcaatcggaaagatgtttgaggcaactgccagaggcgctaggcggatggccattcttggggataccgcatgggacttcggaagtatcggtggcgtgtttacaagcgttgggaaactggtgcatcagattttcggaacggcgtacggcgtcttgttttccggtgtgtcttggaccatgaagatagggatcggcgtactcctgacttggttaggactgaatagccgatcaacaagtctatccatgacctgtattgctgtgggcctcgttacactgtaccttggggtcatggtgcaggccgatagcggatgcgtgatcaactggaaaggccgcgaattgaagtgtggttctgggatcttcgtcactaatgaggttcacacctggacggaacaatataagtttcaggcagactcaccgaaaagactgagtgccgctattggaaaggcctgggaggagggcgtgtgcggtataaggagcgcaacacggctcgaaaacatcatgtggaaacagatttccaacgagctgaatcatatcttactggaaaacgacatgaagttcaccgtggtagtcggcgatgtggttgggattcttgctcagggaaaaaagatgatccgccctcaacccatggagcacaaatactcttggaagtcgtggggcaaggccaaaataatcggggcggacgtgcagaatactacctttattatcgatggaccaaacacacctgaatgtcccgacgatcagagagcctggaatatttgggaggtcgaggactatggcttcggtatctttactaccaacatatggttgaagctcagggatagccacacacaggtgtgcgaccatcgtctgatgtccgctgcaattaaagattcaaaggccgttcacgctgacatggggtactggatcgaaagtgagaaaaatgaaacgtggaagctagcccgggcatctttcattgaggtgaagacctgtatctggccaaaaagccatactctgtggtccaacggagtactcgaatcagagatgataatccccaagatttatggcggtcctatcagccaacacaattaccgaccaggctatttcacacagaccgcggggccgtggcacctgggaaaacttgagttggattttgacctgtgcgaaggcactacagtcgtggtggatgagcattgcgggaacagaggaccctctttaaggaccacgactgtcaccggcaagattatccacgaatggtgttgccgctcctgtacactccctccactgcggttcaaaggtgaggacgggtgctggtacggaatggagataagacccgttaaggaaaaggaggaaaatcttgtgaaaagtatggtaagcgccggctctggtgaggtggactccttttcactgggcttgctctgtattagtatcatgatcgaagaggtcatgaggagccgctggtcgcgaaagatgctgatgaccgggactctagctgtgttcctgctcctgattatgggacagcttacatggaacgatttgatccggctgtgcattatggttggcgccaatgcatccgaccgtatggggatgggaaccacatacttagctctcatggccacttttaaaatgagacctatgttcgcagtgggcctgctttttaggcgcctgacctctcgggaggtcctactcctgacgataggtttgagcctggtggcctcagttgaattaccaaacagtctcgaggaactgggggatggacttgctatgggcatcatgattctgaagttgctcacagacttccaatcccatcagctgtgggcgaccctactgtctcttacttttatcaaaaccacactcagcctgcactatgcctggaagactatggcaatggtgttgtccattgtctcactgttccccttatgtctcagcaccacgagtcagaagacaacctggctgccggtacttctgggctctttggggtgcaaacctctcactatgtttctgatcgctgagaataagatatggggaagaaaatcctggccactaaacgaaggtatcatggccgtgggcgttgtgagcattctgctttcgtcactcctgaagaacgatgtccccttggccgggcctttaatcgctggaggcatgctgattgcatgttacgtgatctctggtagttccgccgacctcagcctggagaaagcggctgaggtatcttgggaagaggaagccgagcatagcggggcatcccacaatatacttgtggaagtccaggatgacggaacaatgaagattaaagatgaggagagggacgataccctgactatcttgctaaaggccacactgctcgctgtttcaggcgtgtatcccctgagtatcccagcaacccttttcgtgtggtacttttggcaaaagaaaaagcagcgaagcggcgtcttatgggacacgccttctcccccagaagtggagcgcgccgttctggatgacgggatttatcggataatgcagagaggactcttgggtaggtcccaggtaggcgtgggggtcttccaagaaaacgtgttccacactatgtggcatgttacccgtggagcggtgctgatgtaccagggcaaacgcctcgagccgtcatgggctagtgtcaagaaagacctgatcagctatggtgggggatggcggcttcagggctcctggaatacaggcgaggaagtgcaggtaattgccgtcgagcctgggaagaaccccaagaatgtgcaaaccgcaccaggaacatttaaaactcccgaaggtgaggttggcgccatcgctctggatttcaagcctgggacctctggatcgccaattgtgaacagagaaggcaaaatcgtcggtttgtacgggaatggagtggttacgacaagcggcacttacgtgtcagccatagcacaggctaaggcctcccaggagggccccctacctgagatcgaagacgaggtctttaggaaacgaaacctgaccattatggatctccacccggggagtggaaagacacggcgctatttaccagcgatcgtgagagaagccattaagaggaaactgcggacccttatcctggcacccactcgagtagtggcttctgagatggccgaagctctcaagggtatgcctataagataccaaaccacagcagttaaaagcgagcatacgggcaaggagattgtcgacttgatgtgccacgccactttcaccatgcgcctgctctccccagtgagggtgcccaattataacatgatcatcatggatgaagcccattttacagacccttcatctattgctgcgcgtgggtacatcagcacccgggtcggaatgggcgaggcagccgctatattcatgactgccacaccgcccggtagtgtagaagcatttccacagtccaatgccgtgattcaggatgaggaaagagacatccctgagaggagctggaactctgggtatgagtggattaccgatttccccggaaaaacggtttggtttgtgccatcaatcaagtccggcaatgacatagctaactgtctgcgcaagaatggcaaacgagtcattcagcttagtagaaagactttcgatacagaataccaaaaaaccaagaacaacgactgggactatgtggttaccactgatatcagcgagatgggggcgaattttcgggccgacagggtgatcgatcctcgccgttgcctaaaacccgtcattctgaaggacggaccagaaagagtgatcttggcaggtccgatgcctgtaacagtggcttcggccgcacagcggaggggccgcattgggcgaaaccacaataaggagggagatcagtacatatacatgggccagcccttaaacaatgacgaggatcacgcccattggaccgaagctaaaatgctgctcgacaacatcaatacaccagagggtattatccccgccctgttcgaacctgagagagaaaagtctgcggcaatcgatggggagtatcggcttaggggcgaggcccgcaaaactttcgttgaactgatgagaaggggagacctcccagtctggttgtcctacaaggtggctagcgagggctttcaatattcagatcggcgttggtgcttcgacggggaacgcaacaatcaggtgctggaggaaaacatggatgtcgagatttggacgaaagagggagaacgaaagaaactaagacccaggtggctggacgcccggacctacagtgaccctctcgctcttcgcgagtttaaggaattcgcagccggtagaaggtctgtttccggcgatctgatattagagatcgggaagttgccgcagcacctgacacagcgggctcaaaatgccctcgacaacctggtgatgcttcataatagcgaacagggaggccgagcatatagacacgcgatggaggagctgccagatactattgaaaccctcatgttgctggccttaatcgctgtactaacaggtggggtgaccctgtttttcctctcaggccgcggacttggcaaaactagtattgggctgttgtgtgtcatggccagctccgtgctgctctggatggcatctgttgagccccactggatcgctgccagcataatcctggaatttttccttatggtgctcctgattcctgagcccgacaggcagcggacgccacaggataaccaattggcatacgtcgtaatcggactgttatttatgattctaaccgtggccgctaatgagatgggtctgctcgaaacaactaagaaagaccttggcatcgggcatgttgcggtggagaaccaccatcacgccaccatgctggatgtcgacttgcatcctgcatccgcttggacactgtatgccgtggccaccactataattacacccatgatgcgtcacacgatcgaaaacaccactgcaaatatttcactcacagctatcgccaaccaggcggctatactgatgggacttgataagggctggccaatctctaaaatggacattggtgtccctttactggccctcgggtgctacagtcaggtgaatccgttgaccctgaccgcagccgttctaatgctggtggctcactacgcaatcattggccccggactccaagccaaggcgacaagagaggctcagaagaggactgccgcaggcatcatgaaaaacccaacggtagatgggatagtggccattgaccttgatcctgtcgtttatgacgctaagttcgaaaaacagctgggacagatcatgttgctgatcctctgtacctcgcaaattctgttaatgcgcacaacttgggccctttgcgagagcatcaccctggcaacaggccccctcaccactctatgggagggttccccagggaagttttggaatacgacaatagctgtgtctatggccaacattttccggggatcatacctggcgggcgccggtttggcatttagcctgatgaaatccctcggcgggggacgaagaggcaccggggctcagggagaaactcttggcgagaagtggaagaggcagctgaatcagttgagtaaatctgaattcaacatctataagcgcagcggtattatggaggtcgaccggtcagaagccaaagaggggctgaagagaggagagaccacacgtcatgcagtgtccaggggcactgctaaactccggtggttcgtagaacgcaatttagtgaagcctgagggtaaggttatcgatctgggctgtgggcgaggaggctggagttactattgcgccgggcttaaaaaggtgaccgaagtcaaaggatacacaaagggcggtcccgggcacgaggaaccgataccaatggccacgtatggatggaacctggtgaaactacatagcggcaaggacgtctttttcacccctcccgagaaatgtgatactctcctgtgcgacatcggcgagtcttccccaaatcccacaattgaagaggggagaaccttgagggtgctgaagatggttgaaccttggctccggggaaaccaattttgtatcaagattcttaatccgtacatgccctcagtagtggagactctggagcagatgcagcgcaaacacggtggcatgttagtcagaaacccactgagcaggaattcgacacacgaaatgtactgggtgtcttgcgggaccggaaacatcgttagtgcggtgaatatgacgtcccgaatgttgctcaaccggttcaccatggctcatcgtaagcctacatatgagagagatgtcgacctgggcgcaggtactcgccacgtggccgtagaacccgaggtggctaacctagatattatcgggcagaggatagaaaatattaaacatgagcacaagagcacctggcattacgacgaggataacccttataaaacatgggcctaccacggatcatatgaagttaagccatccggctctgcaagcagtatggtcaatggcgtggtgaagcttctgactaaaccctgggacgtcatccctatggttacccaaatcgccatgacagataccactccatttgggcagcagcgggtgttcaaggagaaagtagacacgagaacacccaaggctaaacgcggaaccgcgcaaattatggaagtgactgccaggtggctctggggttttctgtcccgaaacaagaagccgcggatatgtaccagagaggaattcacaaggaaagtccgcagcaatgcagctatcggcgccgtgtttgttgacgagaaccagtggaattctgcaaaggaggccgtggaagatgagcgtttctgggacttggtccagaaagaacgggagctgcacaagcaggggaaatgcgctacgtgcgtgtacaacatgatgggaaagagagaaaagaaactcggcgagtttggtaaggccaaagggtcaagggcgatttggtatatgtggcttggagcacgcttcctggagtttgaagccttaggcttcatgaatgaggatcattggttcagtcgagaaaactccctgagcggcgtagagggggagggattgcacaagctcggttacatcctgcgggacatttctaaaatccctggcgggaatatgtacgctgatgacaccgccggatgggatactagaataacagaagacgatctacaaaacgaggcaaagatcaccgacattatggaaccagagcatgctcttctggccacttcgatctttaaactcacatatcagaataaggttgtgagggtccagcgccccgctaagaacggcaccgtgatggatgtgatttcaagacgggaccagaggggtagcgggcaagtcggaacatacggcctgaatactttcaccaacatggaagcccagttgatccgtcagatggagtccgagggcatatttttacctagtgaactggagacgcagaacctcgcagaacgagttcttgattggctggagaaatatggggtggaacgcctaaagagaatggcgatttctggagacgactgtgtagtgaaaccaatcgatgaccggttcgccaccgctctgacagccctcaatgatatgggtaaggtcaggaaagacatcccccaatgggagccgagcaagggctggaacgattggcagcaggtgcctttttgctcccaccacttccatcagttgattatgaaggacgggcgcgagatagttgtgccctgtagaaatcaagatgaactggtcggacgggcaagggtgtcacagggcgctggttggagtcttcgagagactgcctgcctggggaaatcttacgcacagatgtggcaactcatgtattttcaccgtagagacttacgcctggccgcgaacgctatctgtagcgccgtaccagttgattgggtgcctacctcccggacaacttggtcaattcatgcacaccatcagtggatgaccacggaagacatgttgagcgtctggaatagggtgtggatcgaggaaaacccctggatggagaataagacacacgtttcttcctggggagatgtgccatacctgggcaaaagagaggaccagtggtgcggcagtctcattgggcttaccgcccgcgctacttgggccagcaacatccaggtcgcaataaatcaagtgcggaggctgatcggaaacgaaaattatctagactacatgacatcgatgaagcgattcaaaaacgagggtgatcccgaaggcgctctgtggtga

SEQ ID NO: 13735 - RNA, 9879 nt, synthetic construct
  misc_feature 1..9879: note = derived and/or modified CDS sequence (opt3) from DENV-1__FJ882545__SS-prME
  source 1..9879: mol_type = other RNA
agcgtgaccatgctgctcatgcttatgcccacagcactggctttccacttgactacgagaggaggggaacctcatatgatcgtctccaagcaggaaaggggaaaatctttactgtttaagacctcagccggtgttaacatgtgcacattaattgccatggacctcggcgagctgtgtgaagatactatgacctacaaatgcccacggataacagaggcggaaccggacgatgtggactgttggtgcaatgctaccgatacttgggtaacatatgggacctgtagtcagacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaattgctcaagacagaggtgaccaaccctgccgtgctgaggaaactttgcattgaagctaagatctctaatacgaccacagatagccggtgtccaactcaaggagaggccaccctggtcgaagaacaggacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatgtgtactggtagcttcaaactggagaaggaagtcgctgagacccagcacggtacggtgcttgttcagataaagtacgagggcacagacgcgccttgcaaaatcccattctcgacccaagatgaaaagggggtgactcagaacggacgcttgattacagcaaatcccatcgtaaccgacaaagagaagcctgtcaacatagaagccgagccaccctttggcgagtcttatattgtgatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtttttacatccgtggggaaacttgtccatcagattttcggaacggcgtacggcgtgctgttttctggtgtaagctggaccatgaagatagggatcggcgtgttgctcacttggctgggattaaattcacgaagtacatccctgagcatgacctgtattgctgttggcctagtcacactctacctgggggtgatggtgcaggccgattctggatgcgtcatcaactggaaaggccgcgaacttaagtgtggttcagggatcttcgttactaatgaggtgcacacctggacggaacaatataagtttcaggcagacagtccgaaaagattgagcgccgctattggaaaggcctgggaggagggcgtgtgcggtataaggtccgcaacacggctggaaaacatcatgtggaaacagatttctaacgagctcaatcatatcctgttagaaaacgacatgaagctgaccgtagtcgtgggcgatgttgctgggattcttggacagggcaaaaagatgatccgccctcaacccatggagtacaaatattcgtggaaaagctgggggaaggccaaaataatcggagcggacgcccagaatactaccttcattatcgatggcccaaacacacctgaatgtcccgacgatcagagagcttggaatatttgggaggtggaggactacggttttgggatcttcactaccaacatatggttgaagctcagggattcctatacacaggtctgcgaccaccgtctgatgtcagcagccattaaagatagtaaggctgtgcacgccgacatgggatactggatcgaatctgagaaaaatgaaacgtggaagctagcacgggcgagctttattgaggttaagacctgtatctggccaaaatcccatactctgtggtcaaacggcgtgctcgaaagcgagatgataatccccaagatttatggtggccctatctctcaacacaattaccgaccagggtacttcacacagaccgccggaccgtggcatctgggcaaacttgagttggatttcgacctgtgcgaagggactacagtagtcgtggatgagcactgcggaaacagaggcccctccttaaggaccacgactgtgaccggtaagattatccacgaatggtgttgccgcagttgtacactccctccactgcggtttagaggggaggacggatgctggtatggcatggagataaggcccgtcaaagaaaaggaggaaaatcttgttaagagcatggtgtctgctggttccggcgaggtagactcattcagtctggggttgctctgtattagcatcatgatcgaagaggtgatgcgctcgcgatggtcccggaaaatgctgatgaccggaactctagccgtctttttcctgctcattatgggccagctgacatggaacgatcttatccgtttgtgcattatggtgggggcaaatgcttctgacagaatgggaatgggcaccacatacctggccttaatggcaacttttaagatgaggcctatgttcgccgttggtctcctgtttcgccggcttaccagcagagaggtgctgctactcacgatagggctgtcattggtcgctagtgtggaactgccaaactccttagaggaactcggagatggcctggcgatgggcatcatgattcttaaactgttgacagacttccaatctcatcagctctgggccaccctgctaagcctgacttttatcaagaccacattctcccttcactatgcatggaaaactatggctatggttctctcaattgtgagcctgtttcccttgtgtctgagtaccacgtctcagaagacaacctggttaccggtcctcctggggtcccttggatgcaagcctctgactatgttcttgatcgccgagaataaaatatggggtaggaagtcctggccactcaacgaaggcatcatggccgtagggattgtgtcgatcctgctatcatctctgcttaaaaacgatgttcccctcgctggacctctgattgcaggcggtatgttgatcgcctgttacgtgataagtgggtccagcgcggacttatctctggagaaggctgccgaggtcagctgggaagaggaagcagagcattccggagcctcacacaatattctcgtggaagtacaggatgacggcacaatgaaaatcaaggatgaggagcgagacgataccctgactatccttctgaaagctacattgctagcagtgagtggcgtctatcccctgagcattccagccaccctctttgtttggtacttctggcaaaagaagaaacagcgctctggggtgctgtgggacacgccttcacccccagaagtggagcgggcggtccttgatgacggaatatatagaatcatgcagaggggtttactgggccgtagccaggtgggggttggagtattccaagaaaacgtgtttcatactatgtggcacgtcacccgcggcgctgtgctcatgtaccagggtaagcggttggagccgagttgggccagcgttaaaaaggacctgatttcctacgggggaggctggagactcaggggctcttggaatacaggggaggaagtgcaggtcatcgcagtggagcctggcaaaaatcccaagaatgtacagaccgccccaggtacattcaagactcccgaaggcgaggtcggggctattgccctggattttaaacctggaacctcgggcagcccaatcgtgaaccgagaaggtaagatagttgggctttatggaaatggcgtggtcacgacatcaggcacttacgtgtccgcaatcgctcaagccaaagcgagtcaggaggggcccctgcctgagattgaagacgaggttttccggaagcgcaacttgaccatcatggatctacacccgggatctggtaaaacaagaaggtatctgccagccattgtgcgggaagcaatcaagcgaaagctcagaaccttaatactggctcccactcgcgtcgtggccagcgagatggctgaagcacttaaaggcatgcctattaggtaccagaccacagccgtaaagtccgagcatacggggaaagagatcgtggacctgatgtgccacgccacttttaccatgcgtctcttgtcaccagttcgggtccccaattataacatgatcattatggatgaagctcatttcacagacccttctagcatcgcggcaagaggatacataagtaccagggtgggcatgggtgaggccgctgccatttttatgactgcaacaccgcccgggtccgtggaagccttcccacaaagcaatgctgtcatccaggatgaggaacgcgacattcctgagcgatcttggaactcaggatatgagtggatcaccgattttcccggcaagacggtatggttcgtgccatccataaaaagtggcaatgacattgcgaactgtctgagaaagaatgggaagcgggttatccagctcagcaggaaaacttttgatacagaataccagaagaccaaaaacaacgactgggactacgtggtcaccactgatatctcggagatgggagccaatttccgcgcagaccgtgtgattgatcctagacggtgcctgaagcccgttatccttaaagacggtccagaaagggtgattctagctggcccgatgcctgtcacagtggcctctgcagcccaacgccgagggagaataggacggaaccacaataaggagggcgatcagtatatctacatgggtcagcccctgaacaatgacgaggatcatgctcactggaccgaagccaagatgttgttagacaacattaatacaccagaggggatcatccccgcgctgttcgaacctgagagggaaaaatccgcagccgtagatggcgagtatcgcctcagaggagaggctaggaagacttttgtggaactgatgcggcgtggcgaccttccagtttggctgagctacaaagtcgcctcagaggggttccagtatagtgatcgccgatggtgctttgacggagaaagaaacaatcaagtgctcgaggaaaacatggatgtggagatttggacgaaggagggtgaaaggaaaaagttgcggccccgctggctggacgctagaacctactctgaccctctagcactgagggagttcaaagaatttgccgctggccggcgatccgtcagcggggatctcatacttgagatcggaaagctgccgcagcacttaacacagagagcccagaatgcattggacaacctggttatgctccataattcagaacaaggcggtcgcgcgtataggcacgccatggaggagctgccagatactattgaaacccttatgctgctcgctttgatcgccgtgctgacagggggcgtaaccttattctttctaagtggacggggcctggggaagactagcattggactcctttgtgtgatggcatcctctgtcctgttgtggatggctagcgtggagccccattggatcgccgcatccataatcctggagttctttctcatggttctgcttattcctgagcccgaccgtcagagaacgccacaggataaccagctcgcctacgtggtcatcggtctgttgttcatgattctgaccgtagctgcgaatgagatgggcttactagaaacaactaaaaaggacctggggatcggacacgtggccgttgagaaccaccatcacgcagctatgctcgatgtggaccttcatcctgcctcagcctggaccctgtacgcagtcgctacaaccataattactcccatgatgaggcacacaatcgaaaacacgaccgccaatatttctttgactgcgatcgctaaccaagccgcaatactgatgggcctcgataaaggttggccaatcagtaagatggacattggggtgcctctgcttgccttaggctgctattcgcaggtcaatccgctgacactcaccgctgcagtgttgatgctggttgcccattacgcgatcattggacccggcctacaggctaaagccacccgcgaggcacaaaagcggacagccgctgggatcatgaagaacccaactgtggatggaatagtagccattgacctggatcctgtggtctatgacgcaaaatttgaaaagcagctcggccagatcatgcttctgatcttgtgtacgagccagattctgctcatgcgaaccacatgggctctgtgcgagtccatcactttagccaccggtccccttacaaccctgtgggaggggtctccaggaaaattctggaatactacgatagcggtttcaatggccaacatttttagaggcagctacctcgcaggagctggcctagccttctccctgatgaagagtctagggggaggcaggcgcgggacaggagcacaaggcgaaaccctgggtgagaaatggaagcggcagctcaatcagctttctaagagcgagttcaacacttataaaagatcagggatcatggaggtggaccgttccgaagctaaggagggactgaaaaggggcgagaccacaaagcacgccgtcagtcggggtactgccaaattgcgctggtttgtggaacgaaatctggtaaagcctgagggcaaggtgattgatctcgggtgtggaagaggcgggtggagctactattgcgcgggactaaagaaggttaccgaagtgaaaggctacacaaagggtgggcccggacacgaggaaccgatcccaatggctacgtacggctggaacctggtcaaacttcattctggcaaggacgtgttctttatacctcccgagaaatgtgataccctgctatgcgacatcggggagtcctcaccaaatcccactattgaagagggaaggacactccgggtcctgaagatggtggaaccttggttgcgcggtaaccagttctgtatcaagattctgaatccgtatatgcccagcgttgtagagaccctcgagcaaatgcagagaaaacacggcgggatgcttgtgaggaacccactgtcgcgaaattctactcatgaaatgtactgggtcagttgcggaacaggcaacatcgtgtccgcagttaatatgaccagccggatgttactgaaccgttttacgatggcccacagaaagcctacctatgagcgcgatgtggacttgggtacagggactaggcacgtcgctgtggaacccgaggtagccaacctcgatattatcggacagcggatagaaaatattaaacatgagcacaagtcaacctggcattacgacgaggataacccttataaaacatgggcataccacggctcctatgaagtgaagccatctggcagcgccagttccatggttaatggggtcgtgaagctgctaactaaaccctgggacgtgatccctatggtcacccagatcgctatgacagataccactccattcggacaacagagagtttttaaggagaaagtggacacgcgcacacccaaggcgaaaaggggtaccgcccagattatggaagtaactgcacgatggctttggggcttcctgagccggaacaagaagccgagaatatgtaccagggaggaatttacacgcaaagtgcgttctaatgctgccatcggggcagtcttcgtggacgagaaccaatggaactcagccaaggaggctgttgaagatgagcggttttgggacctcgtgcatagagaaagggagctgcacaaacagggaaagtgcgccacgtgcgtctacaacatgatgggcaaacgcgaaaagaagttgggtgagttcgggaaagcgaagggaagtcgagcaatttggtacatgtggctgggcgcccggtttctcgagttcgaagctcttggcttcatgaatgaggatcactggttttccagagaaaacagcctgtctggggtggagggagagggtttacataaactgggctatatcttgagggacatttcgaagatccctgggggaaatatgtacgccgatgacaccgcaggctgggatactcgcataacagaagacgatctccagaacgaggctaaaatcaccgacattatggaaccagagcacgccctgctagctaaggccatcttcaaacttacttatcagaataaggtagttagagtgcaacggcccgcaaagaacggtacagtcatggatgtgatttcaaggcgtgaccagcgagggagcggacaggtgggcacctacggcctgaatacatttactaacatggaagcgcagctcatccgccaaatggagtccgaggggatattcagtccttctgaactggagaccccaaacttggccgaaagagctttagattggctgggaaaatatggtgtcgagcggctcaagaggatggccattagcggcgacgactgtgttgtgaaacccatcgatgaccgctttgcaacggctcttaccgccctgaatgatatggggaaggtaagaaaagacatcccgcagtgggaaccttccaagggatggaacgattggcaacaggtgcccttctgctcacatcactttcaccaactaattatgaaggacggccgggagatagtcgtgccatgtaggaatcaggatgagctggttggtcgagcacgtgtgagtcagggggccggatggtctctcagagaaacagcgtgcttgggcaaaagctacgctcagatgtggcaactgatgtatttccatcgccgggaccttaggctggccgcaaacgccatctgttccgctgtccctgtggattgggtacccacttcaagaaccacatggagcattcacgcccatcaccagtggatgactaccgaggacatgctctctgtttggaatcgcgtgtggatcgaagagaacccatggatggaagataagacgcatatttccagttgggaggacgtcccctacttaggcaaacgggaggaccagtggtgcgggagcctgatcggattgacagcaagggctacctgggccactaatatacaagtggcgatcaaccaggttcgaagactgattggtaatgaaaactacctcgattatatgacatcgatgaagcggtttaaaaatgagtccgaccctgaaggcgctctttggtga

SEQ ID NO: 13736 - RNA, 9879 nt, synthetic construct
  misc_feature 1..9879: note = derived and/or modified CDS sequence (opt3) from DENV-1__FJ898372__SS-prME
  source 1..9879: mol_type = other RNA
tccgtgaccatgctgctcatgcttatgcccacagcactggctttccacttgactacgcggggcggggaacctcatatgatcgtctccaagcaggaaaggggaaagtctttactgtttaagacctcagccggtgttaatatgtgcacattgattgcaatggacctcggcgagctgtgtgaagatactatgacctacaagtgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaagggataagcccactctggacatcgaactactcaagacagaggtgaccaaccctgccgtgctgcggaaactttgcattgaagctaaaatctctaatacgaccacagatagccgctgtccaactcaaggagaggccaccctggtcgaagaacaggacgcaaacttcgtttgccgaagaacatttgtggataggggctggggtaatgggtgtggattgttcggcaagggctccctcataacttgcgctaaatttaagtgcgtaaccaagctggaggggaaaattgtgcagtacgaaaacttaaagtattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccacggacaggactggacttcaacgaaatggtcttgctaacgatgaaagagaagtcttggctggtgcataaacagtggtttctcgatctgccgcttccctggacctccggcgcatcaactagccaagagacatggaatcgtcaggacctgttggtaaccttcaagacagctcacgccaaaaagcaggaagttgtggtcctcggtagtcaagagggggctatgcacactgccctgaccggcgcaacggaaatccagacctctggaacaactaccatttttgccggccatttaaagtgccgcctgaaaatggataagctaacactcaaagggatgtcctatgtgatgtgtactgggagcttcaagctggagaaagaagtcgctgagacccagcacggtacggtgcttgttcagataaagtacgagggcacagacgcgccttgcaagatcccattctcgacccaagatgaaaaaggggtgactcagaacggaagattgattacagcaaatcccatcgtaaccgacaaggagaaacctgtcaacatagaagccgagccaccctttggcgagtcttatattgtgatcggtgctggggaaaaggccctgaaactctcctggttcaagaagggctcaagtatcggaaaaatgtttgaggcaactgccaggggcgctcggcgaatggccattctgggggataccgcatgggacttcggaagcatcggtggcgtttttacatccgtggggaaacttgtccatcagattttcggaacggcgtacggcgtgctgttttctggtgtaagctggaccatgaaaatagggatcggcgtgttgctcacttggctgggattaaattcacgcagtacatccctgagcatgacctgtattgctgttggcctagtcacactctacctgggggtgatggtgcaggccgattctggatgcgtcatcaactggaagggcagagaacttaaatgtggttcagggatcttcgttactaatgaggtgcacacctggacggaacaatataagtttcaggcagacagtccgaagaggttgagcgccgctattggaaaagcctgggaggagggcgtgtgcggtatacggtccgcaacacgcctggaaaacatcatgtggaagcagatttctaacgagctcaatcatatcctgttagaaaacgacatgaaactgaccgtagtcgtgggcgatgttgctgggattcttggacagggcaagaaaatgatcagacctcaacccatggagtacaagtattcgtggaaaagctgggggaaggccaagataatcggagcggacgcccagaatactaccttcattatcgatggcccaaacacacctgaatgtcccgacgatcagagggcttggaatatttgggaggtggaggactacggttttgggatcttcactaccaacatatggttgaaactccgtgattcctatacacaggtctgcgaccaccggctgatgtcagcagccattaaggatagtaaagctgtgcacgccgacatgggatactggatcgaatctgagaagaatgaaacgtggaaactagcacgagcgagctttattgaggttaagacctgtatctggccaaagtcccatactctgtggtcaaacggcgtgctcgaaagcgagatgataatccccaaaatttatggtggccctatctctcaacacaattacagaccagggtacttcacacagaccgccggaccgtggcatctgggcaaacttgagttggatttcgacctgtgcgaagggactacagtagtcgtggatgagcactgcggaaacaggggcccctccttacgcaccacgactgtgaccggtaaaattatccacgaatggtgttgccggagttgtacactccctccactgagatttaggggagaagacggatgctggtatggcatggagatacgccccgtcaaggaaaaagaggaaaatcttgttaagagcatggtgtctgctggttccggcgaggtagactcattcagtctggggttgctctgtattagcatcatgatcgaagaggtgatgcgatcgcggtggtcccgtaagatgctgatgaccggaactctagccgtctttttcctgctcattatgggccagctgacatggaacgatcttatcagattgtgcattatggtgggggcaaatgcttctgacaggatgggaatgggcaccacatacctggccttaatggcaacttttaaaatgcgccctatgttcgccgttggtctcctgtttcggagacttaccagcagggaggtgctgctactcacgatagggctgtcattggtcgctagtgtggaactgccaaactccttagaggaactcggagatggcctggcgatgggcatcatgattcttaagctgttgacagacttccaatctcatcagctctgggccaccctgctaagcctgacttttatcaaaaccacattctcccttcactatgcatggaagactatggctatggttctctcaattgtgagcctgtttcccttgtgtctgagtaccacgtctcagaaaacaacctggttaccggtcctcctggggtcccttggatgcaagcctctgactatgttcttgatcgccgagaataagatatggggtcgaaaaagctggccactcaacgaaggcatcatggccgtagggattgtgtcgatcctgctatcatctctgcttaagaacgatgttcccctcgctggacctctgattgcaggcggtatgttgatcgcctgttacgtgataagtgggtccagcgcggacttatctctggagaaagctgccgaggtcagctgggaagaggaagcagagcattccggagcctcacacaatattctcgtggaagtacaggatgacggcacaatgaagatcaaagatgaggagcgcgacgataccctgactatccttctgaaggctacattgctagcagtgagtggcgtctatcccctgagcattccagccaccctctttgtttggtacttctggcagaagaagaagcagcggtctggggtgctgtgggacacgccttcacccccagaagtggagagagcggtccttgatgacggaatatataggatcatgcagcgtggtttactgggccgcagccaggtgggggttggagtattccaagaaaacgtgtttcatactatgtggcacgtcacccggggcgctgtgctcatgtaccagggtaaaagattggagccgagttgggccagcgttaagaaagacctgatttcctacgggggaggctggaggctccgaggctcttggaatacaggggaggaagtgcaggtcatcgcagtggagcctggaaagaaccccaaaaatgtacagaccgccccaggtacattcaagactcccgaaggcgaggtcggggctattgccctggattttaagcctggaacctcgggcagcccaatcgtgaaccgggaaggtaaaatagttgggctttatggaaatggcgtggtcacgacatcaggcacttacgtgtccgcaatcgctcaagccaaggcgagtcaggaggggcccctgcctgagattgaagacgaggttttccgcaaaagaaacttgaccatcatggatctacacccgggatctggtaagacaaggcggtatctgccagccattgtgcgagaagcaatcaaaagaaagctccgcaccttaatactggctcccactagggtcgtggccagcgagatggctgaagcacttaagggcatgcctattcgttaccagaccacagccgtaaaatccgagcatacggggaaggagatcgtggacctgatgtgccacgccacttttaccatgcggctcttgtcaccagttagagtccccaattataacatgatcattatggatgaagctcatttcacagacccttctagcatcgcggcaaggggatacataagtacccgcgtgggcatgggtgaggccgctgccatttttatgactgcaacaccgcccgggtccgtggaagccttcccacaaagcaatgctgtcatccaggatgaggaacgagacattcctgagagatcttggaactcaggatatgagtggatcaccgattttcccggcaaaacggtatggttcgtgccatccataaagagtggcaatgacattgcgaactgtctgcggaaaaatgggaagagggttatccagctcagccgcaagacttttgatacagaataccagaaaaccaagaacaacgactgggactacgtggtcaccactgatatctcggagatgggagccaatttccgtgcagacagagtgattgatcctcggaggtgcctgaaacccgttatccttaaggacggtccagaacgcgtgattctagctggcccgatgcctgtcacagtggcctctgcagcccaacgaagagggcggataggaaggaaccacaataaagagggcgatcagtatatctacatgggtcagcccctgaacaatgacgaggatcatgctcactggaccgaagccaagatgttgttagacaacattaatacaccagaggggatcatccccgcgctgttcgaacctgagcgcgaaaagtccgcagccgtagatggcgagtatagactcaggggagaggctcggaaaacttttgtggaactgatgcgtcgcggcgaccttccagtttggctgagctacaaggtcgcctcagaggggttccagtatagtgatcgaagatggtgctttgacggagaaaggaacaatcaagtgctcgaggaaaacatggatgtggagatttggacgaaagagggtgaacggaagaaattgcgccccagatggctggacgctaggacctactctgaccctctagcactgcgggagttcaaggaatttgccgctggccgaagatccgtcagcggggatctcatacttgagatcggaaaactgccgcagcacttaacacagcgcgcccagaatgcattggacaacctggttatgctccataattcagaacaaggcggtagggcgtatcggcacgccatggaggagctgccagatactattgaaacccttatgctgctcgctttgatcgccgtgctgacagggggcgtaaccttattctttctaagtggacgtggcctggggaagactagcattggactcctttgtgtgatggcatcctctgtcctgttgtggatggctagcgtggagccccattggatcgccgcatccataatcctggagttctttctcatggttctgcttattcctgagcccgacagacagaggacgccacaggataaccagctcgcctacgtggtcatcggtctgttgttcatgattctgaccgtagctgcgaatgagatgggcttactagaaacaactaagaaagacctggggatcggacacgtggccgttgagaaccaccatcacgcagctatgctcgatgtggaccttcatcctgcctcagcctggaccctgtacgcagtcgctacaaccataattactcccatgatgcgccacacaatcgaaaacacgaccgccaatatttctttgactgcgatcgctaaccaagccgcaatactgatgggcctcgataagggttggccaatcagtaaaatggacattggggtgcctctgcttgccttaggctgctattcgcaggtcaatccgctgacactcaccgctgcagtgttgatgctggttgcccattacgcgatcattggacccggcctacaggctaaggccacccgggaggcacaaaaacgaacagccgctgggatcatgaagaacccaactgtggatggaatagtagccattgacctggatcctgtggtctatgacgcaaagtttgaaaaacagctcggccagatcatgcttctgatcttgtgtacgagccagattctgctcatgagaaccacatgggctctgtgcgagtccatcactttagccaccggtccccttacaaccctgtgggaggggtctccaggaaagttctggaatactacgatagcggtttcaatggccaacatttttaggggcagctacctcgccggtgctggcctagccttctccctgatgaaaagtctagggggaggccgccgggggacaggagcacaaggcgaaaccctgggtgagaagtggaaaagacagctcaatcagctttctaagagcgagttcaacacttataagcgttcagggatcatggaggtggacaggtccgaagctaaagagggactgaagcggggcgagaccacaaaacacgccgtcagtcgcggtactgccaagttgcgatggtttgtggaaagaaatctggtaaaacctgagggcaaggtgattgatctcgggtgtggaaggggcgggtggagctactattgcgcgggattaaagaaagttaccgaagtgaagggctacacaaaaggtgggcccggacacgaggaaccgatcccaatggctacgtacggctggaacctggtcaaacttcattctggcaaagacgtgttctttatacctcccgagaagtgtgataccctgctatgcgacatcggggagtcctcaccaaatcccactattgaagagggacggacactccgcgtcctgaaaatggtggaaccttggttgagaggtaaccagttctgtatcaagattctgaatccgtatatgcccagcgttgtagagaccctcgagcaaatgcagaggaagcacggcgggatgcttgtgcgaaacccactgtcgagaaattctactcatgaaatgtactgggtcagttgcggaacaggcaacatcgtgtccgcagttaatatgaccagccgtatgttactgaacagatttacgatggcccaccgcaaacctacctatgagagggatgtggacttgggtacagggactcggcacgtcgctgtggaacccgaggtagccaacctcgatattatcggacagagaatagaaaatattaagcatgagcacaaatcaacctggcattacgacgaggataacccttataagacatgggcataccacggctcctatgaagtgaaaccatctggcagcgccagttccatggttaatggggtcgtgaagctgctaactaagccctgggacgtgatccctatggtcacccagatcgctatgacagataccactccattcggacaacagcgcgtttttaaagagaaggtggacacgaggacacccaaagcgaagcgaggtaccgcccagattatggaagtaactgcacggtggctttggggcttcctgagcagaaacaaaaagccgaggatatgtacccgcgaggaatttacacgtaaggtgcggtctaatgctgccatcggggcagtcttcgtggacgagaaccaatggaactcagccaaagaggctgttgaagatgagagattttgggacctcgtgcatagggaacgcgagctgcacaagcagggaaaatgcgccacgtgcgtctacaacatgatgggcaagcgagagaagaagttgggtgagttcgggaaggcgaaaggaagtcgggcaatttggtacatgtggctgggcgccagatttctcgagttcgaagctcttggcttcatgaatgaggatcactggttttccagggaaaacagcctgtctggggtggagggagagggtttacataagctgggctatatcttgcgcgacatttcgaaaatccctgggggaaatatgtacgccgatgacaccgcaggctgggatactagaataacagaagacgatctccagaacgaggctaagatcaccgacattatggaaccagagcacgccctgctagctaaagccatcttcaaacttacttatcagaataaagtagttcgggtgcaaaggcccgcaaagaacggtacagtcatggatgtgatttcacgtcgagaccagcgcgggagcggacaggtgggcacctacggcctgaatacatttactaacatggaagcgcagctcatcagacaaatggagtccgaggggatattcagtccttctgaactggagaccccaaacttggccgaacgggctttagattggctggagaagtatggagtcgaaaggctcaaacgcatggccattagcggtgacgactgtgttgtgaagcccatcgatgacagatttgcaacggctcttaccgccctgaatgatatgggcaaagtacggaaggacatcccgcagtgggagccttccaaagggtggaacgattggcaacaggtgcccttctgctcacatcactttcaccaactaattatgaaggacggaagggagatagtcgtgccatgtcgaaatcaggatgaactggttggccgtgcaagagtgagtcagggtgccgggtggtctctccgcgagacagcgtgcttgggaaagagctacgctcagatgtggcaactgatgtatttccatcggagggaccttagactggccgcaaacgccatctgttccgctgtccctgtggattgggtacccacttcacgcaccacatggagcattcacgcccatcaccagtggatgactaccgaagacatgctctctgtttggaatcgggtgtggatcgaggaaaacccatggatggaggataaaacgcatatttccagttgggaggacgtcccctacttaggcaagagggaagaccagtggtgcggcagcctgatcgggttgacagcacgagctacctgggccactaatatacaagtggcgatcaaccaggttagacggctgattggaaatgagaactacctcgattatatgacatcgatgaaaaggtttaagaatgaatccgaccctgagggtgctctttggtga

SEQ ID NO: 13737 - RNA, 9879 nt, synthetic construct
  misc_feature 1..9879: note = derived and/or modified CDS sequence (opt3) from DENV-1__FJ898373__SS-prME
  source 1..9879: mol_type = other RNA
agcgtgacaatgctgctcatgcttatgcccacagcactggctttccacttgactacgagaggaggggaacctcatatgatcgtctccaagcaggaaaggggaaaatctttactgtttaagacctcagccggtgttaacatgtgcacactaattgccatggacctcggagaactgtgtgaagatactatgacctacaaatgcccacggataacagaagtggaaccggacgatgtagactgttggtgcaataccactgatacatgggtgacctatgggacgtgtagtcaaactggagaacaccgccgagacaagcgtagcgtcgcgcttgctccccatgtgggcctgggtttggagaccagagccgaaacatggatgtcctctgagggggcatggaaacagatccagaaggttgaaacttgggccctcaggcaccctggattcaccgtgattgctctgtttctggcacatgccatcggcacatcgattacccagaagggcatcatattcatcctcttaatgctggtcacgccatcaatggctatgcggtgcgtggggattggaagccgcgattttgtagagggtcttagtggcgccacttgggttgacgtggtcttggagcacgggtcctgtgtgacaaccatggcgaaagataagcccactctggacatcgaactactcaaaacagaggtgaccaaccctgcagtcctgagaaaactttgcattgaagccaaaatctctaatacgaccacagatagcagatgtccaactcaaggagaggctaccctggttgaagaacaggacgccaacttcgtgtgccggcgcacatttgtagatcgaggctggggtaatgggtgtggattgttcggcaagggctccctcataacttgcgcaaagtttaaatgcgtgaccaagctggaggggaaaattgtccagtacgaaaacttaaagtattcagtgatcgttacagtgcacaccggagaccagcatcaagtcggtaatgagagtactgaacacggcacgattgctacaatcacaccccaggcccctactagcgagatccagctgaccgactacggggcgctcacacttgattgttctccaagaaccggactggacttcaacgaaatggtgttgctaactatgaaagagaagtcctggctggtacataaacagtggtttctcgatctgccgcttccctggacatcaggcgccagcacgagtcaagagacctggaataggcaggacctgttggttactttcaagacagcacacgctaagaaacaggaagtggtcgtgctcggttctcaagagggggccatgcacaccgctctgacaggcgccactgaaattcagaccacgggaaccacaactatatttgcaggccatttaaagtgccggctgaaaatggataagctaaccctcaaagggatgtcctatgtcatgtgtacaggcagcttcaagctggagaaggaagtggccgagactcagcacggtaccgttcttgtgcagatcaaatacgagggcacggacgctccttgcaagattccattctcgacacaagatgaaaaaggggtaacccagaacggacgtttgatcactgcgaatcccatagtcacagacaaggagaaacctgtgaacattgaagcagagccaccctttggcgagtcttatatcgttatcggtgccggggaaaaggctctgaagctctcctggttcaaaaagggctcaagtattggaaaaatgtttgaggccaccgcacgcggcgccagaaggatggctatcctgggggatactgcctgggacttcggaagcattggtggcgtgtttacctccgtcgggaaacttgtgcatcagatattcggaacagcatacggcgtactgttttctggtgtgagctggacgatgaaaatcgggattggcgttttgctcacctggctgggattaaattcacggagtacttccctgagcatgacatgtatcgcggtcggcctaatcaccctctacctgggggtgatggtgcaggctgattctggatgcgtcattaactggaagggccgagaacttaagtgtggttcagggatattcgttacaaatgaggtgcacacttggaccgaacaatataaatttcaggccgacagtccgaagcgcttgagcgcagccgtgggaaaggcttgggaggagggcgtatgcggtatcagatccgccacgaggctggaaaacattatgtggcggcagatctctaacgagctcaatcatattctgttagaaaacgacatgaagttcacagtcgtggttggcgatgtggtcgggatcctggcacagggcaagaagatggtgcgccctcaacccatggagcacaaatactcgtggaaaagctggggcaaggctaagataatcggggccgacgttcagaataccacttttattatcgatggaccaaacacccctgaatgtcccgacgatcagagagcgtggaatatttgggaggtggaggactatggcttcggtatctttacaactaacatatggcttaagttgagggattcctacacccaggtatgcgaccaccgtctcatgtcagccgctattaaagatagtaaggcagtccatgccgacatggggtattggatcgaatctgagaaaaatgaaacatggaagctggctcgggccagcttcattgaggtgaagacgtgtatctggccaaaatcccacaccctatggtcaaacggagtgctggaaagcgagatgataatccccaagatttacggcggtcctatctctcaacataattatcgaccaggctacttcactcagacagcagggccgtggcacctcggaaaactggagcttgattttgacttgtgcgaaggcaccactgtcgttgtggatgagcactgcgggaacagaggaccctccctgaggacaaccacggtaactggcaagattatccatgaatggtgttgccgcagttgtaccttacctccactccggttcaaaggtgaggacgggtgctggtacggaatggagataagacccgtgaaggaaaaggaggaaaatctggtcaaaagcatggtgtctgcgggctccggtgaggttgactcatttagtcttggcctgttgtgtattagcatcatgatcgaagaggtgatgaggtcgcgctggtcccgaaagatgctcatgacagggaccctggccgtcttctttctactgattatgggacagctcacttggaacgatctgatccggtcttgcattatggtgggcgctaatgccagcgaccgtatggggatgggaacaacctatcttgcattgatggctacattcaaaatgagacctatgtttgccgttggcctgttattcaggcgcctcacttcacgggaggtgctgcttctgaccataggtctaagtctcgtcgcatccgtagaactgccaaactctttggaggaactgggggatggattagccatgggcatcatgattctcaagctgcttacggactttcaaagctaccagctgtgggctacattgctctccctgaccttcatcaaaactaccttttcactacactatgcgtggaagacaatggccatggtgctgagcattgttagtcttctccccctgtgtttgtctactacctcccagaagacgacatggctgccggtgttactcggcagcctggggtgcaaacctcttaccatgttcctgatcgcagagaataagatatggggaagaaaatcgtggccattgaacgaaggtatcatggctgtcggcattgtgtcaatcctcctgtctagtctactgaagaacgatgtaccccttgccgggcctctcattgccggaggcatgctgatcgcttgttacgtgatatccggtagctctgcagacttgagcttagagaaagccgcggaggtctcctgggaagaggaagctgagcattcaggggccagtcacaatattctggttgaagtgcaggatgacggaactatgaagatcaaagatgaggagagggacgatacactcaccatcctgcttaaggcaactctgttggccgtgagcggcgtctatcccctatctattccagctacactgtttgtgtggtacttctggcaaaagaaaaagcagcgatccggcgttctctgggacaccccttcacccccagaagtagagcgcgcagtgctggatgacgggatatatcggatcatgcagagaggacttttaggtaggagtcaggtcggcgtgggggttttccaagaaaacgtgtttcatacgatgtggcacgtcactcgtggagccgtgctgatgtaccagggcaaacgcctcgagccgagctgggcgtccgtaaagaaagacttgatttcttacggtgggggatggcggctgcagggctcgtggaataccggcgaggaagtccaggtgatcgctgttgagcctgggaagaaccccaagaatgtgcaaacagccccaggaaccttcaaaacacccgaaggtgaggtcggcgcaattgccctcgattttaagcctgggactagcggatcaccaatcgtgaacagagaaggcaaaatagttggtctgtatgggaatggagtggtcaccacgtccggcacatacgtgagtgctatcgcccaggcaaaggcttctcaggagggcccccttcctgagattgaagacgaggtattcaggaaacgaaacctgactatcatggatttgcacccggggagcggaaagacccggcgctatctaccagccattgtgagagaagcgatcaagaggaaactgcggacactcatattagcccccacccgagttgtcgcatccgagatggctgaagccctgaagggtatgcctattagataccaaactaccgctgtgaaatcagagcatacaggccgcgagatcgtggaccttatgtgccacgcaacgtttactatgaggctgctctctccagtccgtgtacccaattataacatgatcattatggatgaagcccatttcaccgaccctagcagtatcgccgctcgggggtacatatccacaagagtgggaatgggcgaggcggcagccatttttatgaccgctactccgcccggtagcgttgaagccttcccacagtctaatgcagtgatccaggatgaggaaagggacattcctgagcgctcatggaactccgggtatgagtggatcacagattttcccggaaagaccgtctggttcgtgccaagtataaaaagcggcaatgacattgccaactgtttgcgaaagaatggcaagagagttatccagctgtcgcggaaaacgtttgatactgaataccaaaagaccaagaacaacgactgggactacgtggtcaccaccgatatctctgagatgggggctaatttcagggcggaccgcgtgattgatcctcgtagatgcctcaagcccgtaatcctgaaagacggaccagaacgggtgattcttgccggtccgatgcctgttactgtcgcatccgctgcccagaggcgcggccgaatagggagaaaccacaataaggagggagatcagtatatctacatgggccagcccctaaacaatgacgaggatcatgcacactggacagaagccaagatgctgttggacaacattaataccccagagggtatcatccccgctttattcgaacctgagcgggagaaaagcgccgcgattgatggggagtataggctgcgcggcgaggcaagaaagacatttgtggaactcatgaggcggggagacctgccagtgtggctttcatacaaagtcgccagtgagggcttccaatattctgatcgtcgctggtgctttgacggggaacgaaacaatcaggttctggaggaaaacatggatgtggagatatggactaaggagggagaaaggaaaaagctcaggccccggtggttggacgctcgcacgtactccgaccctctggccctaagagagttcaaagaatttgctgcaggtaggcggagcgtatcaggcgatctgatcctcgagattgggaaacttccgcagcacctgacccagcgagcccaaaatgctttagacaacttggtgatgctgcataatagtgaacagggaggcagagcctatcgccacgcaatggaggagctcccagatacaatcgaaactctgatgcttctggcgctcattgccgtcttgaccggtggggtgacactgttctttttaagcggcaggggactaggcaagacctccatcgggctgctctgtgttatggcttctagcgcccttctgtggatggcatccgtggagccccattggatagctgcctcaatcattttggagttctttctgatggtcctcctgatccctgagcccgaccggcagcgtactccacaggataaccaacttgcatacgtagtgattggactcctgttcatgatcttgacggttgccgctaatgagatgggtctgttagaaaccaccaaaaaggacctaggcatagggcacgtggcggtcgagaaccaccatcacgccactatgctggatgtggacctccatcctgcatctgcttggaccctttacgccgtcgccacaaccattatcactcccatgatgagacacacaattgaaaacacgaccgcaaatatcagtctgactgctatagccaaccaggcggctatcttgatgggactggataaaggctggccaatttcgaagatggacatcggtgtgcctctcctggcccttgggtgctatagccaggttaatccgttaacactgaccgcagccgtgctcatgttggtagctcattacgcaattatcggccccggactgcaagccaaagcgaccagggaggctcagaagcgcacagccgcaggcataatgaagaacccaactgtggatgggattgtcgccatcgacctagatcctgttgtgtatgacgctaaatttgaaaagcagctgggacagatcatgctccttattctgtgtacgtcccaaatcttgctgatgcggaccacatgggccctctgcgagtctataactctggcaaccggccccttaacaaccctttgggagggttcaccagggaaattctggaatactacgattgctgtcagcatggccaacatctttcgaggatcctacctggcgggcgccggtctcgcattcagtctaatgaagtctctgggcgggggaagaaggggcacaggggctcagggagaaaccttgggcgagaaatggaagcgccagctgaatcagctcagcaagtcagagttcaacacttataaacggtccggtattatggaggtggacagaagtgaagccaaggaggggcttcgtaggggagagaccacaaaacacgcagtaagccggggcactgctaagctgcgctggtttgtggaacgaaatttggttaaacctgagggtaaggtgatcgatctgggctgtgggagaggaggctggtcttactattgcgccgggctcaagaaagtcaccgaagtgaagggatacacaaaaggcggtcccgggcacgaggaaccgataccaatggccacgtacggatggaacttagtcaagctgcattccggcaaagacgtgttctttatccctcccgagaagtgtgatacccttctgtgcgacattggcgagtcaagcccaaatcccactatcgaagaggggaggacactacgggttctcaaaatggtagaaccttggctgcgcggaaaccaattctgtattaagatcttgaatccgtatatgccctcggtggtcgagaccctggagcacatgcagagaaagcatggtggcatgctcgtgaggaacccactttctcgaaatagtactcacgaaatgtactgggtttcctgcgggacaggaaacattgtgagcgcggtcaatatgacctcacggatgctgttaaaccgttttacgatggctcacagaaaacctacctatgagcgcgatgtggacctgggcgcaggtacaaggcatgtagccgtggaacccgaggttgctaacttggatatcatagggcagcggattgaaaatatcaagcacgagcataaatccacttggcactacgacgaggataacccttataagacctgggcctaccatggatcttatgaagtcaaaccaagcggcagtgcatccagcatggtgaatggcgtggtcaagctcctgacaaagccctgggacgttatccctatggtgactcagattgccatgaccgatacaaccccattcgggcaacagagagtatttaaagagaaggtggacactcgcacgcccaaagctaagaggggaacagcgcagataatggaagtcaccgcccgatggctatggggtttcctttctcggaacaaaaagccgagaatctgtactagggaggaatttacccgcaaggtgcgttcaaatgcagctattggcgccgttttcgtggacgagaaccaatggaatagtgcaaaagaggccgtcgaagatgagcggttttgggacctggtgcacagagaaagggagctccacaagcaggggaaatgcgctacatgcgtatacaacatgatgggaaagcgcgagaaaaagctgggcgagttcggtaaggccaaagggtcccgagcgatctggtacatgtggttgggagcacggtttctggagttcgaagccctcggcttcatgaatgaggatcattggtttagcagagaaaactctctttcgggcgttgagggggagggactgcacaagttaggttatattctgagggacatctcaaaaatacctggcgggaatatgtacgctgatgacacggccggatgggatacccgcatcactgaagacgatttgcagaacgaggcaaagattacagacatcatggaaccagagcatgctctcctggccaccagcattttcaaactaacttatcagaataaggtggtcagagtgcaacggcccgctaaaaacggcacagtgatggatgtcatctccaggcgtgaccagcgaggtagtgggcaggttggaacctacggccttaatacatttactaacatggaagcccagctgatacgccaaatggagtctgagggcattttcagcccttccgaactcgagaccccaaacctggcagaaagagtgttggattggttagagaagtatggggtagaacggctgaagaggatggcgatctcaggagacgactgtgtggtcaaacccatcgatgaccgctttgccacggctctcaccgcccttaatgatatgggtaaggtgagaaaagacattccgcagtgggagcctagtaagggctggaacgattggcagcaggttcccttctgctctcaccactttcatcaactgataatgaaagacgggcgggagatcgtggtcccatgtaggaatcaggatgagctagtgggacgagcacgtgtaagccagggcgctggttggtccctgagagagacagcctgcctcgggaagtcatacgcacagatgtggcaattgatgtatttccaccgccgggacctgaggcttgccgcgaacgctatttgtagcgccgttcctgtggattgggtccccacttctagaaccacatggtccatccatgcacaccatcagtggatgactaccgaagacatgctgagtgtgtggaatcgcgtttggattgaggaaaacccatggatggaggataagacgcacatcagctcgtggggagacgtgccctacctcggcaaacgggaggaccagtggtgcggctccttaatagggctgacagccagggctacctgggccactaatatccaagtcgcaattaaccaggtgcgaagattgatcggaaatgaaaactacctggattatatgacatctatgaagcggtttaaaaatgagtcagaccctgaaggtgctctctggtga

SEQ ID NO: 13738 - RNA, 9879 nt, synthetic construct
  misc_feature 1..9879: note = derived and/or modified CDS sequence (opt3) from DENV-1__FJ898374__SS-prME
  source 1..9879: mol_type = other RNA
tccgtgaccatgctgctcatgcttatgcccacagcactggctttccacttgactacgaggggaggggaacctcatatgatcgtcaccaagcaggaaaggggaaaatccttactgtttaagacatctgccggtgttaatatgtgcactctaattgccatggacctcggcgaactgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggttgacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggatcgttcaaactggagaaggaagtggctgagacccagcacggtacggtccttgtgcagataaagtacgagggcacagacgcgccttgcaaaatcccattctcgacccaagatgaaaagggggttattcagaacggacgcttgatcactgcaaatcccatagtgacagacaaagagaagcctgtaaacattgaagccgagccaccctttggcgagtcttatatcgtcatcggtgtgggggaaaaagctctgaagctctcctggttcaagaaaggctcaagtattggaaagatgtttgaggccaccgcaagaggcgccaggcggatggctatcctgggggatactgcctgggacttcggaagcattggtggcgtttttacctccgtggggaaacttgtccatcagatattcggaacagcatacggcgtgctgttttctggtgtaagctggacgatgaagatcgggattggcgtgttgctcacctggctgggattaaattcacgaagtacttccctgagcatgacatgtatcgcggttggcctagtcaccctctacctgggggtgatggtgcaggctgattctggatgcgtcatcaactggaaaggccgcgaacttaagtgtggttcagggattttcgttacaaatgaggtgcacacttggaccgaacaatataagtttcaggccgacagtccgaaaagattgagcgcagccataggaaaggcttgggaggagggcgtgtgcggtatcaggtccgtaacgcggctggaaaacattatgtggaaacagatctctaacgagctcaatcatattctgttagaaaacgacatgaagttcacagtcgtggttggcgatgtggtcgggatcctggcccagggcaaaaagatgatacgccctcaacccatggagcacaaatactcgtggaaaagctggggcaaggcaaagatcattggggctgacgtgcagaataccacttttatcattgatggaccaaacacccctgaatgtcccgacgatcagagagcctggaatatctgggaggttgaggactatggcttcggtatatttacaactaacatttggcttaagttgagggattcctacacccaggcgtgcgaccaccgtctcatgtcagccgctatcaaagatagtaaggcagtgcatgccgacatggggtattggattgaatctgagaaaaatgaaacatggaagctggctcgggccagcttcatcgaggtaaagacgtgtatatggccaaaatcccacaccctatggtcaaacggagtcctggaaagcgagatggtgatccccaagatttacggcggtcctatctctcaacataattatcgaccaggctacttcactcagacagcagggccgtggcacctcggaaaactggagcttgattttgacttgtgcgaaggcaccactgtggtcgttgatgagcactgcgggaacagaggaccctccctgaggacaaccacggtgactggcaagattatccatgaatggtgttgccgcagttgtaccttacctccactccggttcaaaggtgaggacgggtgctggtacggaatggagataagacccgtaaaggaaaaggaggaaaatctggtgaaaagcatggtctctgcgggctccggtgaggtggactcatttagtcttggcctgttgtgtattagcatcatgatcgaagaggttatgaggtcgcgctggtcccgaaagatgctcatgacagggaccctggccgtgttcctactgctcattatgggacagctgacttggaacgatcttatccggttgtgcattatggtcggcgctaatgcctctgaccgtatggggatgggaacaacctatctggcattaatggctacatttaaaatgagacctatgttcgccgtgggcctcctgtttaggcgccttactagccgggaggttctgctactcaccataggtctgtcattggtggcaagtgtcgaactgccaaactccttagaggaactcggggatggactggccatgggcatcatgattcttaagctgttgacggacttccaatctcaccagctctgggctacactgctaagcctgacctttatcaaaactaccctttccctccattacgcgtggaagacaatggccatggtactgtcaattgtgagcttgttccccctgtgtttaagtactacctctcagaagacgacatggctcccggttctgcttggctccctggggtgcaaacctttgaccatgtttctcatcgcagagaataagatatggggaagaaaaagctggccactgaacgaaggtatcatggctgtgggcgtcgtgtcgattctactgtcatctcttctcaagaacgatgtacccctggccgggcctttgatcgccggaggcatgttaattgcttgttatgtgatcagtggttccagcgcagacctgtctctcgagaaagccgcggaggtcagctgggaagaggaagctgagcactccggggcctcacataatatactggttgaagtgcaggatgacggaactatgaagattaaagatgaggagagggacgatacacttaccatcctgttgaaggcaactctactggccgtgagtggcgtctaccccctcagcatcccagctacactgttcgtgtggtatttttggcaaaagaaaaagcagcgatctggcgttctttgggacaccccttcacccccagaagtagagcgcgcagtgttagatgacgggatttaccggataatgcagagaggactgctcggtaggagccaggtcggcgtgggggttttccaagaaaacgtgttccacacgatgtggcacgtcactcgtggagccgtgttgatgtatcagggcaaacgcctggagccgagttgggcgagcgtaaagaaagacctcatctcctacggtgggggatggcggctgcagggctcttggaataccggcgaggaagtccaggtgattgctgttgagcctgggaagaaccccaagaatgtgcaaacagccccaggaacctttaaaacacccgaaggtgaggtcggcgcaatcgcccttgatttcaagcctgggacttcgggaagcccaattgtgaacagagaaggcaaaatcgttggtctgtacgggaatggagtggtcaccacgtcaggcacatatgtgtccgctatagcccaggcaaaggctagtcaggagggccccttgcctgagatcgaagacgaggtatttaggaaacgaaacctaactattatggatctgcatccggggtctggaaagacccggcgctacctcccagccatcgtgagagaagcgattaagaggaaattacggacactgatccttgcccccacccgagttgtcgcaagcgagatggctgaagccctgaagggtatgcctataagatatcaaactaccgctgtgaaatccgagcacacaggcaaggagattgtggacctcatgtgccatgcaacgttcactatgcgcttgctgtcaccagtcagggtacccaattacaacatgatcatcatggatgaagcccactttaccgacccttctagcattgccgctcgtgggtatatcagtacacgggtgggaatgggcgaggcggcagccatattcatgaccgctactccgcccggttccgttgaagcctttccacagagcaatgcagtgattcaggatgaggaaagagacatccctgagaggtcttggaactcagggtacgagtggattacagatttccccggaaaaaccgtctggtttgtgccatccatcaagagtggcaatgacatagccaactgtctccgcaagaatggcaaacgagttattcagctgagcagaaagacgttcgatactgaatatcagaaaaccaagaacaacgactgggactacgtggtcaccaccgatatctcggagatgggggctaattttcgggcggacagggtgatcgatcctcgccgttgccttaaacccgtaattctaaaggacggaccagaaagagtgatcctggccggtccgatgcctgttactgtcgcatctgctgcccagcggaggggccgcattgggcgaaaccataataaggagggagatcagtacatatatatgggccagcccttgaacaatgacgaggatcacgcacactggacagaagccaaaatgttactggacaacatcaataccccagagggtattatccccgctctcttcgaacctgagagagaaaagtccgccgcgatcgatggggagtaccggctgaggggcgaggcacgcaaaacattcgtggaacttatgagaaggggagacctgccagtgtggctcagctataaggtcgcctcagagggctttcaatacagtgatcggcgttggtgcttcgacggggaacgcaacaatcaggttttggaggaaaacatggatgtggagatttggactaaagagggagaacgaaagaaactgagacccaggtggctagacgctcggacgtattctgaccctctggccctccgcgagtttaaggagttcgctgcaggtagaaggtccgtaagcggcgatcttatactggagatcgggaagttaccgcagcatttgacccagcgggcccaaaatgctctggacaacctcgtgatgctgcacaattcagaacagggaggccgagcctacagacatgcaatggaggagcttccagatacaattgaaactctgatgctcttggcgctgatcgccgtcttaaccggtggggtgacactatttttcctgagtggccgcggactcggcaaaaccagcattgggcttctgtgtgttatggcttcctctgtgttgctgtggatggccagcgtcgagccccactggatcgcagcttccataatcctcgaatttttcctgatggtacttctcattcctgagcccgacaggcagcggactccacaggataaccaactggcctatgtggttatcggattgctgtttatgattttaacggtggcagccaatgagatgggtctactggaaaccacaaagaaagacctcggcatcgggcacgtcgctgtggagaaccatcaccatgcgactatgcttgatgtcgacctgcaccctgcctcagcatggaccttgtacgctgtggccacaaccataattactcccatgatgcgtcatacaatcgaaaacacgaccgccaatatttctctgactgcaatcgctaaccaggccgcgatactcatgggactggataagggctggccaatcagtaaaatggacattggtgttcctcttttagctctggggtgctacagccaggtgaatccgctcacattgaccgccgcagtactgatgctagtggcccactatgctatcattggccccggactgcaagcaaaggccaccagagaggcgcagaagaggacagctgccggcatcatgaaaaacccaactgtcgatgggatagttgcaattgacctcgatcctgtggtctacgacgccaagttcgaaaaacagcttggacagatcatgctgttgatcctgtgtacgagccaaattctcctgatgcgcaccacatgggctttatgcgagtccatcactcttgccaccggccccctgacaaccctctgggagggttctccagggaagttttggaatactacgatagcagtgtcaatggctaacattttccggggaagctatctagccggcgcgggtctggccttttccttgatgaaaagtctgggcgggggacgaagaggcacaggggcacagggagaaaccctcggcgagaagtggaagaggcagcttaatcagctgtctaaaagcgagttcaacatctacaagcgctcaggtattatggaggtagaccggtccgaagctaaagaggggttgaagagaggagagactacccgtcacgccgtgagtaggggcacagcaaaactgcggtggttcgttgaacgcaatctcgtgaagcctgagggtaaggtcatcgatttaggctgtgggcgaggaggctggagctattactgcgctgggctgaaaaaggtgactgaagtcaaaggatataccaagggcggtcccgggcatgaggaaccgataccaatggccacatacggatggaaccttgtgaaactgcactctggcaaggacgtatttttcacgcctcccgagaaatgtgataccctactctgcgacatcggcgagtcctcaccaaatcccactattgaagaggggagaacactgagggtattgaagatggtggaaccttggctgcggggaaaccaattttgtatcaagattctcaatccgtacatgcccagcgtcgtggagacccttgagcagatgcagcgcaaacatggtggcatgctggttagaaacccattatcgagaaattctactcacgaaatgtattgggtgagttgcgggacaggaaacatcgtctccgccgtgaatatgaccagccgaatgctgttgaaccggttcacgatggcgcaccgtaagcctacctacgagagagatgtagacctcggcgctggtacacgccatgtggcagttgaacccgaggtcgccaacctggatattatcgggcagaggatagaaaatattaaacacgagcataagtcaacttggcactatgacgaggataacccttacaaaacctgggcttatcatggatcctacgaagtgaagccatctggcagcgccagttccatggtgaatggcgtcgttaagctacttacaaaaccctgggacgtgatccctatggtaactcaaatcgcaatgaccgatacaaccccatttgggcagcagcgggtgttcaaggagaaagtcgacactagaacgcccaaggccaaacgcggaacagctcaaattatggaagtgaccgcgaggtggctgtggggttttctcagccgaaacaagaagccgcggatatgtactagagaggagttcaccaggaaagttcgctctaatgccgcaatcggcgctgtgtttgtcgacgagaaccagtggaactcagccaaggaggcagtggaagatgagcgtttctgggacctggtacagaaagaacgggagttgcacaagcaggggaaatgcgccacatgcgtttataacatgatgggaaagagagaaaagaaactgggcgagtttggtaaggctaaagggagtagggccatttggtacatgtggctcggagcgcgcttccttgagtttgaagcactgggcttcatgaatgaggatcactggttctcccgagaaaacagcttatctggcgtggagggggagggactgcataagttgggttacatcctccgggacatttcgaaaatccctggcgggaatatgtatgccgatgacacggctggatgggataccagaataactgaagacgatctgcaaaacgaggccaagatcacagacattatggaaccagagcacgcactacttgctacctcaatctttaaactgacttaccagaataaggtcgtgagggtgcagcgccccgccaagaacggcacagtcatggatgttattagcagacgggaccagaggggttccgggcaagtgggaacctatggcctcaatacattcactaacatggaagctcagctgatccgtcagatggagagtgagggcatatttttgccttctgaattagagaccccaaacctggccgaacgagtactcgattggcttgagaaacatggggtggaacgcctgaagagaatggcaattagcggagacgactgtgtcgtgaaacccatcgatgaccggttcgcgacggccctaaccgctctgaatgatatgggtaaggttaggaaagacatcccgcagtgggagccttccaagggctggaacgattggcaacaggtgcccttttgctcacaccacttccatcagctcattatgaaggacgggcgcgagatagtcgtgccatgtagaaatcaggatgaattggtaggacgggccagggttagtcaaggcgcaggttggtctctgcgagagacagcttgccttgggaaaagctacgcccagatgtggcagctgatgtattttcaccgtagagacctccgcttagcagccaacgcgatctgttccgctgtgcctgtcgattgggtgcccacttcacggaccacatggagcattcatgcccaccatcaatggatgactaccgaagacatgctgtctgtttggaatagggtgtggatcgaggaaaacccatggatggaggataagacgcacgtctccagttggggagacgtgccctacttgggcaaaagagaggaccagtggtgcggcagcctgattgggctcacagcacgcgccacctgggcttcgaatatccaggtagccataaaccaggtgcggaggcttatcggaaatgaaaactatctggattacatgacttccatgaagcgattcaaaaatgagggtgaccctgaaggcgcactatggtga

SEQ ID NO: 13739 - RNA, 9879 nt, synthetic construct
  misc_feature 1..9879: note = derived and/or modified CDS sequence (opt3) from DENV-1__FJ898375__SS-prME
  source 1..9879: mol_type = other RNA
agcgtgaccatgctgctaatgcttatgcccaccgcactggctttccacttgactacgagaggcggggaacctcatatgatcgtctccaagcaggaaagggggaaatctttactgtttaagacctcagccggtgttaacatgtgcacactaattgccatggacctcggcgagttctgtgaagatactatgacctacaaatgcccacggataacagaagcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttatggcactcttcctggcccatgctattggcacatcgatcacccagaagggcattatctttatactgctcatgttagtgacgccatcaatggccatgcgctgcgtcgggatcggaagcagagatttcgtggagggtctgagtggcgcgacttgggtagacgttgtgcttgagcacgggtcctgtgtcacaaccatggcaaaggataaacccactttggacattgaactgctaaagacagaggtgaccaaccctgccgtgctcaggaaactgtgcatcgaagctaagatttctaatacgaccacagatagccggtgtccaactcaaggagaggccacccttgtcgaagaacaggacgcaaactttgtttgccgccgaacattcgtggatagaggctggggtaatgggtgtggactgtttggcaaaggctccttgatcacttgcgctaagttcaagtgcgtaaccaaactcgaggggaagacagtgcagtacgaaaacctgaaatattcagtcatagtgaccgttcacactggagaccagcatcaagtgggtaatgagagtacggaacacggcacaaccgccactattacaccccaggcgcctagcacagagatccagttaaccgactacggggccctgactctcgattgttctccaaggacaggacttgactttaacgaaatggtcctgttgacgatgaaggagaaatcctggctagtgcataagcagtggttcctggatctcccgctgccctggacctcaggcgcaagcacaagtcaagagacatggaatcggaaagaccttctggtaacctttaagacagctcacgccaagaaacaggaagttgtggtcttgggttctcaggagggggctatgcacactgccctcaccggcgcaacggaaattcaaacctccggaacaactaccatcttcgccggccatctgaagtgccgtttaaaaatggataagctgacactaaaagggatgagctatgtgatgtgtactggatcgttcaagctcgagaaggaagtcgctgagacccagcacggtacggtgctggttcagatcaaatacgagggcacagacgcgccttgcaagattccattttctacccaggatgaaaaaggggtgactcaaaacggacgccttataacagcaaatcccatcgtaaccgacaaggagaaacctgtcaacattgaagccgagccacccttcggcgagtcctatatcgtgataggtgctggggaaaaggccttgaagctgtcatggtttaaaaagggcagtagcattggaaaaatgttcgaggcaactgccagaggcgctaggcggatggccatcctcggggataccgcatgggactttggatccatcggtggcgttttcacatctgtggggaagctggtccatcagatttttggaacggcgtacggcgtgcttttcagcggtgtatcatggaccatgaaaatcgggattggcgtgctgttgacttggctcggactgaatagtcgatccactagcttatctatgacctgtatagctgttggcctggtcacactatacctcggggtgatggtgcaggccgattcaggatgcgtcatcaactggaagggccgcgaactgaagtgtggtagtgggatttttgttactaatgaggtgcacacctggacggaacagtataaattccaagcagacagcccgaagagactttccgccgctatcggaaaagcctgggaggagggcgtgtgcggtatcaggtctgcaacacggttggaaaacattatgtggaagcagatatcgaacgagctgaatcatatcctcctggaaaacgacatgaaatttaccgtagtcgtgggcgatgttgctgggattttagcccagggaaagaaaatgatccgccctcagcccatggagtacaagtatagctggaagtcctggggcaaagcgaagattatcggggccgacgtgcaaaatactaccttcataatcgatggaccaaacacacctgaatgtcccgacgatcagagagcttggaatatttgggaggtcgaggactacggctttggtatcttcactaccaacatttggctgaaacttagggattcatatacacaggtgtgcgaccaccgtttgatgagtgcagccatcaaggattctaaagctgttcacgccgacatggggtactggatagaaagcgagaagaatgaaacgtggaagctcgcacgggcgtccttcattgaggtgaaaacctgtatctggccaaagtcacatactctgtggagcaacggagtactagaatctgagatgattatccccaaaatatatggcggtcctatctcccagcacaattaccgaccaggctactttacacaaaccgccgggccgtggcatctgggaaagctcgagctggatttcgacctttgcgaaggcactacagtcgtggtggatgagcactgcgggaacagaggacccagtttgaggaccacgactgtcaccggcaaaattatccacgaatggtgttgccgcagctgtacactgcctccattacggtttaagggtgaggacgggtgctggtatggaatggagattagacccgttaaggaaaaagaggaaaatctcgtgaagtctatggtatccgctggctcaggtgaggtggacagtttcagcctgggccttctgtgtatctcgataatgattgaagaggtcatgaggtcccgctggtctcgaaaaatgttgatgaccgggactctcgccgtgtttttcctgctaatcatgggacagctgacatggaacgatctcatccggctgtgcattatggttggcgcaaatgctagcgaccgtatggggatgggaaccacataccttgccttgatggcaacttttaagatgagacctatgttcgccgtgggcctgttatttaggcgcctcacctcacgggaggtcctgcttctgacgatcggtctaagtctcgtggcttccgttgaactgccaaactctttggaggaactgggggatggattagcgatgggcattatgatactcaaactgcttacagacttccagagccatcaactgtgggccaccttgctctccctgacttttatcaagaccacattctcactacactatgcatggaagactatggctatggtgctgagcattgtcagtctttttcccctctgtctgtctaccacgtcccagaaaacaacctggttgccggtactgttaggcagcctcgggtgcaagcctctgactatgttccttatcgccgagaataaaatttggggaagaaagtcgtggccactgaacgaaggtatcatggccgtgggcatagtttcaatcttgctctctagtctgctcaagaacgatgtgcccctggctgggcctcttattgcaggaggcatgctcatcgcctgttacgtcatttccggtagctctgcggacctgagcttggagaaggctgccgaggtgtcctgggaagaggaagcagagcattcaggggccagtcacaatatcttagtagaagtgcaggatgacggaacaatgaaaataaaggatgaggagagggacgataccctgactattctcctgaaggctacacttctggcagtcagcggcgtttatcccttgtctatcccagccaccctattcgtgtggtacttttggcagaaaaagaaacaacgatccggcgtgctgtgggacacgccttcacccccagaagtcgagcgcgcggtgctcgatgacgggatctatcggattatgcagagaggactgcttggtaggagtcaggttggcgtaggggtgttccaggaaaacgtctttcatactatgtggcacgtgacccgtggagctgttttaatgtaccaaggcaagcgcctggagccgagctgggcctccgtgaaaaaggacctcatatcttacggtgggggatggcggttgcagggctcgtggaatacaggcgaggaagtccaggtgatcgcagtagagcctgggaagaaccccaaaaatgtccagaccgccccaggaacattcaagactagcgaaggtgaggtgggcgctattgccctggattttaaacccgggacctcaggatcccctatcgttaacagagaaggcaagattgtgggtctctatgggaatggagtcgtgacgacaagtggcacttacgtttctgcaatcgctcaagccaaagcgagccaggagggcccactgcccgagatagaagacgaggtgttcaggaagcgaaaccttaccatcatggatctgcaccctgggtccggaaagacacggcgctatttgccggccattgtcagagaagcaatcaaaaggaagctacggaccctgattctcgctccaactcgagtggtagcctcagagatggctgaagcattaaaaggtatgcccatcagataccagaccacagccgtgaagtctgagcatacgggcaaagagatagttgacctgatgtgccacgccacttttaccatgcgccttctgagccctgtcagggtgccaaattataacatgattatcatggatgaagctcatttcacagaccccagttccatcgcggcacgtgggtacattagcacccgggtgggaatgggcgaggccgctgccatctttatgactgcaacacctccgggttctgtcgaagccttcccccaatcaaatgctgtaatacaggatgaggaaagagacattccagagaggtcctggaacagtgggtatgagtggatcaccgattttcctggaaagacggtgtggttcgttcccagcattaagtcgggcaatgacatcgcgaactgtctccgcaaaaatggcaagcgagtgatacagttgtctagaaaaactttcgatacagaataccagaagaccaaaaacaacgactgggactacgtcgtgaccactgatatttccgagatgggggccaattttcgggcagacagggttatcgatccacgccgttgcctgaagcctgtgatcctcaaggacggacccgaaagagtcattctggctggtccaatgccggtgacagtagccagcgcagcccaacggaggggccgcatcgggcgaaaccacaataaagagggagatcagtatatttacatgggccagcctcttaacaatgacgaggatcatgctcactggaccgaagccaagatgctactggacaacataaatacacccgagggtatcattccagcgttgttcgaacccgagagagaaaaatcagcagccatcgatggggagtatcggttaaggggcgaggctcgcaagacttttgtggaactgatgagaaggggagacctccctgtttggctgagtcacaaagtcgcctctgagggcttccagtactccgatcggcgttggtgctttgacggggaacgcaacaatcaagtgcttgaggaaaacatggatgtggagatctggacgaaggagggagaacgaaagaaactgagaccaaggtggctcgacgctcggacctatagcgaccccttggcactgcgcgagttcaaagaatttgccgctggtagaaggtcagtcagtggcgatctaattctggagatagggaaactccctcagcatcttacacagcgggcccagaatgcactggacaacttagttatgttgcacaatagcgaacaaggaggccgagcgtacagacatgccatggaggagctgccggatactatcgaaaccctcatgctgcttgctctgattgccgtgctcacaggtggggtaaccttgttctttctgtccggccgcggattaggcaagacttctatcgggctactgtgtgtgatggcaagctccgtcctcctttggatggcttcagtggagccacactggattgccgcatctatcatactggagttctttttgatggttctgctcatccccgagcctgacaggcagcggacgccccaggataaccagctggcctatgtggtcattggacttctcttcatgatcctgaccgtagctgcgaatgagatgggtttgctggaaacaactaaaaaggacttaggcattgggcacgtggccgttgagaaacatcaccatgcagctatgctagatgtggacctgcacccagccagtgcctggaccctctacgcagtcgctacaaccatcataactcctatgatgcgtcatacaattgaaaacacgaccgccaacatctcgcttactgcgattgctaatcaagccgcaatcctgatgggattggataagggctggcccataagcaagatggacatcggtgtgccactgctcgccctggggtgctactcccaggtcaaccctcttacattaaccgctgcagtgctgatgctcgttgcccactatgcgattatcggcccgggattgcaggctaaagccaccagagaggcacaaaagaggacagccgctggcattatgaaaaatcccactgtggatgggatcgtagccatagacctggatccagtggtctacgacgcaaagtttgaaaaacagctaggacagattatgctgctcatcctttgtacgtctcagatcctgttgatgcgcaccacatgggctctgtgcgagtcaattactctcgccaccggccctctgacaaccttatgggagggtagccccgggaagttctggaacactacgatcgcggtttccatggccaatatattccggggaagttatcttgcaggcgctggtctggccttttctctcatgaaaagcctaggcgggggacgaagaggcacaggggcacaaggagaaaccctgggcgagaaatggaagaggcagttgaaccagctgtcaaaatccgagttcaatacttacaagcgcagtggtattatggaggtggaccggagcgaagctaaagaggggctcaagagaggagagaccacaaagcacgccgtctctcgtggcactgccaaacttaggtggtttgtggaacggaacctggtaaagccagagggtaaagtgatcgatttgggctgtgggcgcggaggctggtcctattactgcgcggggctgaagaaagttaccgaagtgaagggatatacaaaaggcggtcctgggcatgaggaacccattccgatggctacgtacggatggaatctcgtcaagttacactcaggcaaggacgtgttctttatcccacctgagaaatgtgataccctgctttgcgacataggcgagagctcgcccaacccaactatcgaagaggggcgaacactgagagtcctaaagatggtggaaccctggctcaggggaaatcagttctgtattaaaatcctgaacccttacatgccgtctgttgtagagaccttggagcaaatgcagcggaagcatggtggcatgctggtgcgcaatcccctcagtagaaactccactcacgaaatgtattgggtcagctgcgggacaggaaatattgtgtcagcagttaacatgacctccaggatgcttctgaatcgatttacgatggcccaccggaaaccaacctacgagcgtgatgtggacttaggcgctggtacaagacatgtcgccgtggaacctgaggtagcaaacctggatatcattgggcagcgcatcgaaaacataaagcacgagcataagtctacttggcactatgacgaggataatccctacaaaacctgggcctatcatggaagctacgaagtgaagcctagtggctccgctagctctatggttaacggcgtcgtgaaattgctcacaaagccatgggacgtgattcccatggtcactcagatcgcgatgaccgatacaacccctttcgggcaacagagggtttttaaagagaaggtggacactcggacgccaaaggccaaaagaggaacagcacagatcatggaagtaaccgctaagtggctgtggggtttcctatcacgcaataaaaagcccaggatttgtactcgagaggaatttacccggaaagtgagaagtaacgccgcaataggcgccgtcttcgtggacgagaatcaatggaactccgctaaggaggccgttgaagatgagaggttttgggaccttgtgcaccgcgaacgtgagctgcacaagcaggggaaatgcgcgacatgcgtctataatatgatgggaaagcgggagaagaagctcggcgagttcggtaaagcaaaggggagcagagccatctggtacatgtggctgggagctaggttcttggagtttgaagccctgggcttcatgaacgaggatcattggttttctcgcgaaaattcgctctcaggcgtggagggggagggacttcacaaactgggttacattttacgagacatcagcaagattccgggcgggaacatgtatgcagatgacacggctggatgggatacccggatcactgaagacgatctgcagaatgaggccaagataacagacatcatggaacctgagcatgctttgctcgccaaatccattttcaagctgacctaccagaacaaagtagttagagtgcaaaggccagcaaagaatggcactgtcatggatgtgatcagtcgcagagaccagcggggttctggacaggtgggaacatatggcctaaacacctttacaaatatggaagcgcagcttattaggcaaatggagagcgagggcatcttctccccctcagaactggagactcctaacctcgccgggcgtgtcctggattggttggaaaaacacggagttgagcgattaaagcgcatggctataagtggtgacgactgtgtggtaaagccaattgatgacagatttgccaccgcactgacggctctcaacgatatgggcaaagtgcggaaggacatcccccagtgggaaccgtctaaagggtggaatgattggcagcaggtccctttctgcagccaccattttcaccaacttatcatgaaggacggaagggagattgtggttccctgtcgcaaccaggatgagctggtgggcagagcccgggtctcccagggtgcagggtggtcactaagggaaaccgcctgcctgggaaaaagctacgcgcagatgtggcaactcatgtatttccatcgacgtgacttgagactggctgccaatgcaatatgttctgccgtgccagtagattgggttcctacatcccgcactacctggagtatccacgctcatcaccagtggatgacaactgaggacatgcttagcgtgtggaaccgggtctggattgaagagaatccctggatggaagataagacccacatctcgtcctggggcgacgtgccatacctgggcaagagggaggaccagtggtgcgggtctctcattggattaacggccagagcaacatgggctaccaacatccaagttgccataaatcaggtgcgccggctgatcggtaacgagaattatttggattacatgacttcaatgaaaaggtttaagaacgaaagcgaccccgagggcgcgctgtggtga

SEQ ID NO: 13740 - RNA, 9879 nt, synthetic construct
  misc_feature 1..9879: note = derived and/or modified CDS sequence (opt3) from DENV-1__FJ898376__SS-prME
  source 1..9879: mol_type = other RNA
agcgtgaccatgctgctcatgcttatgcccacagcactggctttccacttgactacgaggggaggggaacctcatatgatcgtcaccaagcaggaaaggggaaaatccttactgtttaagacatctgccggtgttaatatgtgcactctaattgccatggacctcggcgaactgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgtgatcggcacctctattacgcagaagggcatcatattcatcctcttaatgctggtcactccatcgatggctatgcgctgcgtggggattggatcaagagattttgtagagggtcttagcggcgccacatgggttgacgtggtcttggagcacgggagttgtgtgaccactatggcgaaggataaacccacactggacatcgaactactcaagaccgaggtgacgaaccctgcagtcctgaggaaactttgcattgaagccaagatctccaataccacaactgattctcggtgtccaacccaaggagaggctacactgatggaagaacaagacgccaacttcgtttgccgccgaacttttgtggatagaggctggggtaatgggtgtggattgttcggcaaaggcagcctcataacctgcgcaaagtttaagtgcgtaacaaaactggaggggaagattgtgcagtacgaaaacttaaaatattccgtcatcgtgaccgttcacactggagaccagcatcaagtgggtaatgagtcaacggaacacggcacaaccgctactattacaccccaggcccctacaagtgagatccagctgaccgactacggggcgctcactcttgattgtagcccaaggacaggactggacttcaacgaaatggtcttgctaacgatgaaggagaaatcttggctggtgcataagcagtggtttctcgatctgccgcttccctggacctccggcgcctcaactagccaagagacatggaatcggcaggacctgttggtaaccttcaaaacagcacacgctaagaagcaggaagttgtggtcctcggtagtcaagagggggccatgcacactgctctgaccggcgccacggaaatccagacctctggaacaactaccatttttgcaggccatttaaaatgccgtctgaagatggataaactaacactcaaggggatgtcctatgtgatgtgtactggtagcttcaaactggagaaggaagtcgccgagacccagcacggaacggtgcttgttcagataaagtacgagggcacagacgctccttgcaaaatcccattctcgacccaagatgaaaagggggtgactcagaacggacgcttgattacagcgaatcccatcgtaaccgacaaagagaagcctgtcaacatagaagcagagccaccctttggcgagtcttatattgtgatcggtgccggggaaaaagctctgaagctctcctggttcaagaaaggctcaagtatcggaaagatgtttgaggccactgcaagaggcgccaggcggatggctattctgggggataccgcctgggacttcggaagcatcggtggcgtttttacatccgtggggaaacttgtccatcagattttcggaacggcatacggcgtgctgttttctggtgtaagctggaccatgaagatagggatcggcgtgttgctcacttggctgggattaaattcacgaagtacatccctgagcatgacctgtattgcggttggcctagtcacactctacctgggggtgatggtgcaggctgattctggatgcgtcatcaactggaaaggccgcgaacttaagtgtggttcagggatcttcgttactaatgaggtgcacacctggacggaacaatataagtttcaggccgacagtccgaaaagattgagcgcagccattggaaaggcttgggaggagggcgtgtgcggtataaggtccgccacacggctggaaaacatcatgtggaaacagatttctaacgagctcaatcatatcctgttagaaaacgacatgaagttcaccgtagtcgtgggcgatgttgtggggattctggcacagggcaaaaagatgatccgccctcaacccatggagcacaaatactcgtggaaaagctggggcaaggctaagataatcggggccgacgtccagaatactacctttattatcgatggaccaaacacacctgaatgtcccgacgatcagagagcgtggaatatttgggaggtggaggactatggcttcggtatctttactaccaacatatggcttaagttgagggattcccacacacaggtttgcgaccatcgtctcatgtcagccgctattaaagatagtaaggcagtgcacgccgacatggggtactggatcgaatctgagaaaaatgaaacgtggaagctggctcgggccagcttcattgaggtaaagacctgtatctggccaaaatcccatactctatggtcaaacggagtcctggaaagcgagatgataatccccaagatttatggcggtcctatctctcaacacaattaccgaccaggctatttcacacagaccgcagggccgtggcacctcggaaaactggagcttgattttgacttgtgcgaaggcactacagtggtggtcgatgagcattgcgggaacagaggaccctccctgaggaccacgactgttaccggcaagattatccacgaatggtgttgccgcagttgtacattacctccactccggttcaaaggtgaggacgggtgctggtacggaatggagataagacccgtgaaggaaaaggaggaaaatctggtaaaaagcatggtgtctgcgggctccggtgaggtcgactcatttagtcttggcctgttgtgtattagcatcatgatcgaagaggtgatgaggtcgcgctggtcccgaaagatgctcatgaccgggactctggccgttttcctactgctcattatgggacagctgacatggaacgatcttatccggttgtgcattatggtgggcgctaatgcctctgaccgtatggggatgggaaccacatacctggcattaatggctacttttaaaatgagacctatgttcgccgtcggcctcctgtttaggcgccttaccagccgggaggtgctgctactcacgataggtctgtcattggttgcaagtgtggaactgccaaactccttagaggaactcggggatggactggccatgggcatcatgattcttaagctgttgacagacttccaatctcatcagctctgggctaccctgctaagcctgacttttatcaaaaccacactttccctccactatgcgtggaagactatggccatggtcctgtcaattgtatccttgttccccctgtgtttaagtaccacgtctcagaagacaacctggctcccggtgctgcttggctccctggggtgcaaacctttggcaatgtttctcatcgctgagaataagatatggggaagaaaaagctggccactgaacgaaggtatcatggccgttggcgtggtctcgattctactgtcatctcttctcaagaacgatgtgcccctggccgggcctttgatcgctggaggcatgttaattgcatgttacgtaatcagtggttccagcgccgacctgtctctcgagaaagcggctgaggtgagctgggaagaggaagccgagcattccggggcatcacacaatatactggtcgaagttcaggatgacggaactatgaagattaaagatgaggagagggacgatacacttaccatcctgttgaaggccactctactggctgtgagtggcgtgtatcccctcagcatcccagcaacactgttcgtctggtacttttggcaaaagaaaaagcagcgatctggcgtgctttgggacaccccttcacccccagaagttgagcgcgccgtattagatgacgggatttatcggataatgcagagaggactgctcggtaggagccaggtgggcgtcggggtgttccaagaaaacgttttccacacgatgtggcatgtgactcgtggagcggtcttgatgtaccagggcaaacgcctggagccgagttgggctagcgtgaagaaagacctcatctcctatggtgggggatggcggctgcagggctcttggaataccggcgaggaagtacaggtcattgccgtggagcctgggaagaaccccaagaatgttcaaacagcaccaggaacctttaaaacacccgaaggtgaggtgggcgccatcgctcttgatttcaagcctgggacttcgggaagcccaattgtcaacagagaaggcaaaatcgtgggtctgtacgggaatggagttgtgaccacgtcaggcacatacgtctccgccatagcacaggctaaggccagtcaggagggccccttgcctgagatcgaagacgaggtgtttaggaaacgaaacctaactattatggatctgcacccggggtctggaaagacccggcgctatctcccagcgatcgtaagagaagccattaagaggaaattacggacactgatccttgcacccacccgagtggttgctagcgagatggccgaagctctgaagggtatgcctataagataccaaactaccgcagtcaaatccgagcatacaggcaaggagattgtggacctcatgtgccacgccacgttcactatgcgcttgctgtcaccagtgagggtccccaattataacatgatcatcatggatgaagcccattttaccgacccttctagcattgctgcgcgtgggtacatcagtacacgggtaggaatgggcgaggcagccgctatattcatgaccgccactccgcccggttccgtggaagcatttccacagagcaatgccgttattcaggatgaggaaagagacatccctgagaggtcttggaactcagggtatgagtggattacagatttccccggaaaaaccgtgtggtttgtcccatccatcaagagtggcaatgacatagctaactgtctccgcaagaatggcaaacgagtgattcagctgagcagaaagacgttcgatactgaataccagaaaaccaagaacaacgactgggactatgttgtgaccaccgatatctcggagatgggggcgaattttcgggccgacagggtcatcgatcctcgccgttgccttaaacccgtgattctaaaggacggaccagaaagagtaatcctggcaggtccgatgcctgtgactgttgcttctgccgcacagcggaggggccgcattgggcgaaaccacaataaggagggagatcagtacatatacatgggccagcccttgaacaatgacgaggatcacgcccattggacagaagctaaaatgttactggacaacatcaataccccagagggtattatccccgccctcttcgaacctgagagagaaaagtccgcggcaatcgatggggagtatcggctgaggggcgaggcccgcaaaacattcgtcgaacttatgagaaggggagacctgccagtgtggctcagctacaaggtggcttcagagggctttcaatatagtgatcggcgttggtgcttcgacggggaacgcaacaatcaggtcttggaggaaaacatggatgttgagatttggactaaagagggagaacgaaagaaactgagacccaggtggctagacgcccggacgtactctgaccctctggctctccgcgagtttaaggagttcgcagccggtagaaggtccgtgagcggcgatcttatactggagatcgggaagttaccgcagcacttgacccagcgggctcaaaatgccctggacaacctcgtaatgctgcataattcagaacagggaggccgagcatatagacacgcgatggaggagcttccagatacaattgaaactctgatgctcttggccctgatcgctgtgttaaccggtggggtcacactatttttcctgagtggccgcggactcggcaaaaccagcattgggcttctgtgtgtgatggcctcctctgttttgctgtggatggcaagcgtggagccccactggatcgctgcctccataatcctcgaatttttcctgatggtccttctcattcctgagcccgacaggcagcggactccacaggataaccaactggcatacgtagtgatcggattgctgtttatgattttaacggttgccgctaatgagatgggtctactggaaaccacaaagaaagacctcggcatcgggcatgtggcggtcgagaaccaccatcacgccactatgcttgatgtggacctgcatcctgcatcagcttggaccttgtatgccgtcgccacaaccataattactcccatgatgcgtcacacaatcgaaaacacgaccgcaaatatttctctgactgctatcgccaaccaggcggctatactcatgggactggataagggctggccaatcagtaaaatggacattggtgtgcctcttttagccctggggtgctactcgcaggttaatccgctcacattgaccgcagccgtgctgatgctagtagctcactacgcaatcattggccccggactgcaagccaaggcgaccagagaggctcagaagaggacagccgcaggcatcatgaaaaacccaactgtggatgggatagtcgccattgacctcgatcctgttgtgtatgacgctaagttcgaaaaacagcttggacagatcatgctgttgatcctgtgtacgagccaaattctcctgatgcgcaccacatgggccttatgcgagtccatcactcttgcaaccggccccctgacaaccctctgggagggttctccagggaagttttggaatactacgatagctgtctcaatggccaacattttccggggaagctacctagcgggcgccggtctggcattttccttgatgaaaagtctgggcgggggacgaagaggcacaggggctcagggagaaaccctcggcgagaagtggaagaggcagcttaatcagctgtctaaaagcgagttcaacatctataagcgctcaggtattatggaggtggaccggtccgaagccaaagaggggttgaagagaggagagactacccgtcatgcagtaagtaggggcacagctaaactgcggtggttcgtggaacgcaatctcgttaagcctgagggtaaggtgatcgatttaggctgtgggcgaggaggctggagctactattgcgccgggctgaaaaaggtcactgaagtgaaaggatacaccaagggcggtcccgggcacgaggaaccgataccaatggccacatatggatggaaccttgtcaaactgcattctggcaaggacgtgtttttcacgcctcccgagaaatgtgataccctactctgcgacatcggcgagtcctcaccaaatcccactattgaagaggggagaacactgagggttttgaagatggtagaaccttggctgcggggaaaccaattttgtatcaagattctcaatccgtacatgcccagcgtggtcgagacccttgagcagatgcagcgcaaacacggtggcatgctggtgagaaacccattatcgagaaattctactcacgaaatgtactgggttagttgcgggacaggaaacatcgtgtccgcggtcaatatgaccagccgaatgctgttgaaccggttcacgatggctcatcgtaagcctacctatgagagagatgtggacctcggcgcaggtacacgccacgtagccgtggaacccgaggttgctaacctggatattatcgggcagaggatagaaaatattaaacatgagcacaagtcaacttggcattacgacgaggataacccttataaaacctgggcctaccacggatcctatgaagtcaagccatctggcagcgcaagttccatggtgaatggcgtggtcaagctacttacaaaaccctgggacgttatccctatggtgactcaaatcgccatgaccgatacaaccccatttgggcagcagcgggtattcaaggagaaagtggacactagaacgcccaaggctaaacgcggaacagcgcaaattatggaagtcaccgccaggtggctgtggggttttctcagccgaaacaagaagccgcggatatgtactagagaggagttcaccaggaaagtgcgctctaatgcagctatcggcgccgtttttgtggacgagaaccagtggaactcagcaaaggaggccgtcgaagatgagcgtttctgggacctggtgcagaaagaacgggagttgcacaagcaggggaaatgcgctacatgcgtatacaacatgatgggaaagagagaaaagaaactgggcgagtttggtaaggccaaagggagtagggcgatttggtatatgtggctcggagcacgcttccttgagtttgaagccctgggcttcatgaatgaggatcattggttctcccgagaaaacagcttatctggcgttgagggggagggactgcacaagttgggttacatcctccgggacatttcgaaaatccctggcgggaatatgtacgctgatgacacggccggatgggataccagaataactgaagacgatctgcaaaacgaggcaaagatcacagacattatggaaccagagcatgctctacttgccacctcaatctttaaactgacttatcagaataaggtggtcagggtgcagcgccccgctaagaacggcacagtgatggatgtcattagcagacgggaccagaggggttccgggcaagttggaacctacggcctcaatacattcactaacatggaagcccagctgatccgtcagatggagagtgagggcatatttttgccttctgaattagagacccagaacctggcagaacgagtgctcgattggcttgagaaatatggggtagaacgcctgaagagaatggcgattagcggagacgactgtgtggtcaaaccaatcgatgaccggttcgccacggctctaaccgccctgaatgatatgggtaaggtgaggaaagacatcccccaatgggagccgtccaagggctggaacgattggcagcaggttcctttttgctcacaccacttccatcagctcattatgaaggacgggcgcgagatagtggtcccctgtagaaatcaagatgaattggtgggacgggcaagggtaagtcagggcgctggttggtctctgcgagagacagcctgccttgggaaaagctacgcacagatgtggcaactgatgtattttcaccgtagagacctccgcttagccgcgaacgctaattgttccgccgttccagtggattgggtccctacttcacggaccacatggagcatccatgcacaccatcagtggatgactaccgaagacatgctgtctgtgtggaacagggtttggattgaggaaaatccctggatggaggataagacgcacgtgtccagttggggagacgtcccatacttgggcaaaagagaggaccagtggtgcggcagcctgatcgggctcacagcccgcgctacctgggcctcgaacattcaggtggcaatcaatcaagtacggaggcttataggaaacgaaaattatctggattacatgacttccatgaagcgattcaaaaacgagggtgaccccgaaggcgctctatggtga

SEQ ID NO: 13741 - RNA, 9879 nt, synthetic construct
  misc_feature 1..9879: note = derived and/or modified CDS sequence (opt3) from DENV-1__FJ898379__SS-prME
  source 1..9879: mol_type = other RNA
agcgtgaccatgctgctcatgcttatgcccacggccctggctttccacttgactacgagaggaggggaacctcatatgatcgtctccaagcaggaaagaggaaaatctttactgtttaagacctcagccggtgttaatatgtgcacactaattgccatggacctcggcgaactgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgtgatcggcacctcgattacgcagaagggcatcatattcatcctcttaatgctggtcactccatcaatggccatgcgctgcgtggggattggaagcagagattttgtagagggtcttagtggcgctacatgggttgacgtggtcttggagcacgggtcctgtgtgaccactatggccaaggataaacccacactggacatcgaactactcaagaccgaggtgacgaaccctgcggtcctgaggaaactttgcattgaagcaaagatctctaataccacaactgatagccggtgtccaacccaaggagaggccacactggttgaagaacaagacgctaacttcgtgtgccgccgaacttttgtagatagaggctggggtaatgggtgtggattgttcggcaaaggctccctcataacctgcgccaagtttaagtgcgtgacaaaactggaggggaagattgtccagtacgaaaacttaaaatattcagtgatcgttaccgtgcacactggagaccagcatcaagtcggtaatgagagtacggaacacggcacaaccgcaactattacaccccaagctcctaccaccgagatccagctgactgactacggggccctcacacttgattgtagcccaaggacgggactggacttcaacgaaatggtgttgctaaccatgaaggagaaatcttggctggtacataagcagtggtttctcgatctgccgcttccctggacttccggcgcgtcaacaagccaagagacctggaatcggcaggacctgttggttacattcaaaactgcccacgcaaagaagcaggaagtggtcgtgctcggtagtcaagagggggctatgcacaccgccctgacgggcgctaccgaaatccagacatctggaactaccacaatttttgccggccatttaaaatgccgtctgaagatggataaactaactctcaaggggatgtcctatgtcatgtgtaccgggagcttcaaactggagaaggaagtggcagagacgcagcacggtacagttcttgtgcagataaagtacgagggcaccgacgccccttgcaaaatcccattctcgactcaagatgaaaagggggtaacacagaacggacgcttgattaccgctaatcccatcgtcactgacaaagagaagcctgtgaacatagaagcggagccaccctttggcgagtcttatattatcatcggtgcaggggaaaaagccctgaagctctcctggttcaagaaaggctcaagtattggaaagatgtttgaggctaccgccagaggcgcaaggcggatggccatcctgggggatacagcttgggacttcggaagcattggtggcgtttttacgtccgtggggaaacttgtccatcagatattcggaaccgcctacggcgtgctgttttctggtgtaagctggactatgaagatcgggattggcgtgttgctcacatggctgggattaaattcacgaagtacctccctgagcatgacatgtatcgcagttggcctagtcactctctacctgggggtgatggtgcaggcggattctggatgcgtcatcaactggaaaggccgcgaacttaagtgtggttcagggattttcgttaccaatgaggtgcacacgtggacagaacaatataagtttcaggctgacagtccgaaaagattgagcgccgcaataggaaaggcctgggaggagggcgtgtgcggtatcaggtccgctacccggctggaaaacattatgtggaaacagatctctaacgagctcaatcatattctgttagaaaacgacatgaagttcactgtagtcgtgggcgatgttgccgggatcctggcacagggcaaaaagatgatacgccctcaacccatggagtacaaatattcgtggaaaagctggggcaaggctaagatcattggggccgacgtgcagaataccacatttatcattgatggaccaaacactcctgaatgtcccgacgatcagagagcgtggaatatctgggaggtcgaggactacggcttcggtatatttaccacaaacatttggcttaagttgagggattcctatacacaggtgtgcgaccaccgtctcatgtcagccgctatcaaagatagtaaggcagttcacgccgacatggggtactggattgaatctgagaaaaatgaaacctggaagctggctcgggccagcttcatcgaggtgaagacttgtatatggccaaaatcccatacactatggtcaaacggagtactggaaagcgagatgatcattcccaagatctatggcggtcctatttctcaacacaattaccgaccaggctacttcacccagactgcagggccgtggcatctcggaaaactggagcttgattttgacttgtgcgaaggcacaaccgtcgtggtggatgagcactgcgggaacagaggaccctccctgaggacgactaccgtcacaggcaagatcatacacgaatggtgttgccgcagttgtaccttacctccactccggttcagaggtgaggacgggtgctggtatggaatggagattaggcccgttaaagaaaaggaggaaaatctggtgaagtccatggtatctgcgggctccggtgaggtggactcatttagtcttggcctgttgtgtatcagcatcatgattgaagaggtcatgcgctcgcgatggtcccggaaaatgctcatgactgggacactggccgtgttctttctactgatcatgggacagctcacctggaacgatctgattcgtctttgcataatggttggcgctaatgcctctgacagaatggggatgggaacaacttacttggcactgatggctaccttcaagatgaggcctatgtttgccgtgggcttactcttccgccggctgacgagcagagaggtccttctgctaacaatcggtctctcactggtggcaagtgttgaattgccaaactccctggaggaattaggggatggactcgccatgggcattatgatcctgaaacttctgaccgactttcaatctcatcagttgtgggctactctcctgagcctaaccttcattaagacaactttttccctgcactatgcgtggaaaaccatggccatggtgctttcaatcgtcagcctcttccccctgtgtttgagtacgacatctcagaagaccacttggctgccggtattactcggctccctggggtgcaagcctcttacaatgtttctgatagcagagaataaaatctggggaaggcgaagctggccattgaacgaaggtattatggctgtgggcatcgtttcgattctcctgtcatctctactgaagaacgatgtgccccttgccgggcctctcatcgccggaggcatgctgatagcttgttacgtcattagtggttccagcgcagacttgtctttagagaaagccgcggaggtgagctgggaagaggaagctgagcattccggggcctcacacaatatcctggtagaagtgcaggatgacggaaccatgaagatcaaagatgaggagcgcgacgatactctcacaattctgcttaaggcaaccctgttggccgtcagtggcgtttatcccctaagcataccagctacgctgttcgtgtggtacttctggcagaaaaagaagcagcggtctggcgtgctctgggacactccttcacccccagaagtcgagagagcagtgctggatgacgggatctataggattatgcagcgtggacttttaggtcgcagccaggttggcgtaggggtgtttcaagaaaacgtcttccataccatgtggcacgtgacacggggagccgttctgatgtaccagggcaaaagactcgagccgagttgggcgagcgtgaagaaagacttgatctcctacggtgggggatggaggctgcagggctcttggaataccggcgaggaagtccaggtgattgctgtagagcctgggaagaaccccaaaaatgtccaaacagccccaggaacttttaagacccccgaaggtgaggtgggcgcaatcgccctcgatttcaagcctgggacgtcgggaagcccaatagttaaccgagaaggcaaaatcgtgggtctgtatgggaatggagtcgtgacaacttcaggcacctacgtttccgctattgcccaggcaaaggctagtcaggagggcccccttcctgagatcgaagacgaggtgtttcggaaacgcaacctgacaattatggatttgcacccggggtctggaaagaccagaaggtatctaccagccatcgtccgggaagcgataaaacgaaagctgagaactctcattttagcccccacccgcgtggtagcaagcgagatggctgaagccctgaagggtatgcctatcaggtaccaaacaacggctgtgaaatccgagcatactggcaaggagatcgttgaccttatgtgccacgcaaccttcacaatgcgtctgctctcaccagtccgggtgcccaattataacatgattatcatggatgaagcccattttaccgacccttctagcatagccgctagagggtacattagtactagggtgggaatgggcgaggcggcagccatcttcatgacagctaccccgcccggttccgtcgaagcctttccacagagcaatgcagtaattcaggatgaggaacgcgacatccctgagcgatcttggaactcagggtatgagtggataacggatttccccggaaaaactgtgtggtttgttccatccattaagagtggcaatgacatcgccaactgtttgaggaaaaatggcaagcgggtgatccagctgagcaggaagacattcgataccgaataccagaaaaccaagaacaacgactgggactacgtcgtgactacagatatttcggagatgggggctaatttccgcgcggaccgtgttatcgatcctagacggtgcctcaaacccgtgattctgaaggacggaccagaaagggtcatacttgccggtccgatgcctgtgaccgtagcatctgctgcccagcgccgaggcagaatcgggcggaaccacaataaagagggagatcagtatatttacatgggccagcccctaaacaatgacgaggatcatgcacactggacagaagccaagatgctgttggacaacatcaatactccagagggtatcattcccgctttatttgaacctgagagggaaaagtccgccgcgatagatggggagtatcgcctgagaggcgaggcaaggaaaacgttcgtggaactcatgcggcgtggagacctgccagtttggcttagctacaaggtcgcctcagagggctttcaatatagtgatcgccgatggtgcttcgacggggaaagaaacaatcaggtgctggaggaaaacatggatgtggagatctggaccaaagagggagaaaggaagaaactccggccccgctggttggacgctagaacatactctgaccctctggccctaagggagtttaaggagttcgctgcaggtcggcgatccgtcagcggcgatctgattctcgagatcgggaaacttccgcagcacctgactcagagagcccaaaatgctttagacaacttggttatgctgcataattcagaacagggaggccgcgcctataggcacgcaatggaggagctcccagataccattgaaacactgatgcttctggcgctcatcgccgtgttgaccggtggggtaactctgtttttcttaagtggccggggactaggcaagacgagcatagggctgctctgtgtgatggcttcctctgtccttctgtggatggccagcgtggagccccattggatcgcagcttccattatcttggaatttttcctgatggttctcctgattcctgagcccgaccgtcagagaaccccacaggataaccaacttgcctacgtggtcatcggactcctgtttatgatattgacagtagcagccaatgagatgggtctgttagaaactaccaagaaagacctaggcattgggcacgtggctgttgagaaccaccatcacgcggccatgctggatgtggacctccatcctgcatcagcttggacactttacgccgtcgccaccactatcattacacccatgatgaggcacacgatcgaaaacaccactgcaaatatatctctgacagctatcgccaaccaggcggctattttgatgggactggataagggctggccaatcagtaaaatggacattggtgtgcctctcctggcccttgggtgctattcgcaggtcaatccgttaaccctgaccgcagccgtgctcatgttggttgctcattacgcaatcataggccccggactgcaagccaaggcgacacgcgaggctcagaaacggactgccgcaggcattatgaagaacccaacggtggatgggatcgtagccatcgacctagatcctgtggtctatgacgctaagttcgaaaaacagctgggacagattatgctccttatcctgtgtaccagccaaatattgctgatgcgaacaacttgggccctctgcgagtccattaccctggcaacaggccccttaaccactctttgggagggttctccagggaagttttggaatacgacaatcgctgtttcaatggccaacattttcagaggaagctacctggcgggcgccggtctcgcattctccctaatgaaaagtctgggcgggggaaggcgcggcaccggggctcagggagaaactttgggcgagaagtggaaacggcagctgaatcagctctctaagagcgaatttaacacctataagagatcaggtatcatggaggtggaccgttccgaagccaaagaggggcttaagaggggagagacaactaaacacgcagtcagtcggggcaccgctaagctgcgctggttcgtggaacgaaatttggtaaaacctgagggtaaggtgatagatctgggctgtgggagaggaggctggagctactattgcgccgggctcaagaaagttacagaagtgaagggatacacgaaaggcggtcccgggcacgaggaaccgatcccaatggccacctacggatggaacttagtcaagctgcattctggcaaagacgtgtttttcattcctcccgagaagtgtgatactcttctgtgcgacatcggcgagtcctcaccaaatcccacaattgaagaggggaggaccctacgggtcctcaaaatggtggaaccttggctgcgcggaaaccaattttgtatcaagattttgaatccgtatatgcccagcgttgtagagactctggagcagatgcagagaaagcacggtggcatgctcgtgaggaacccactttcgcgaaattctacacatgaaatgtactgggtcagttgcgggaccggaaacatcgtgtccgcggttaatatgacgagccggatgctgttaaaccgtttcaccatggctcacagaaaacctacatatgagcgcgatgtggacctgggcgcaggtactaggcacgtcgccgtggaacccgaggtagctaacttggatataattgggcagcggatcgaaaatatcaagcatgagcacaaatcaacctggcattacgacgaggataacccttataagacatgggcctaccacggatcctatgaagtgaaaccatctggcagcgcaagttccatggttaatggcgtcgtgaagctcctgactaagccctgggacgtgattcctatggtcacccaaatagccatgacagataccactccatttgggcagcagagagttttcaaagagaaggtggacacgcgcacacccaaagctaagaggggaaccgcgcaaatcatggaagtaactgccaaatggctatggggttttcttagccgaaacaagaagccgcggatttgtaccagagaggagttcacaaggaaagtgcgctctaatgcagctatcggcgccgtctttgtggacgagaaccagtggaactcagcaaaggaggccgttgaagatgagcgtttctgggacctggtgcatcgggaaagagagctccacaaacaggggaagtgcgctacgtgcgtctacaacatgatgggaaaaagggaaaagaagctgggcgagtttggtaaagccaaggggagtcgcgcgatttggtacatgtggttgggagcacgattcctggagttcgaagccctcggctttatgaatgaggatcactggttctcccgggaaaacagcctttctggcgtggagggggagggactgcataaattaggttatatcctgagagacatatcgaagatccctggcgggaatatgtacgctgatgacaccgccggatgggatactaggattacagaagacgatttgcagaacgaggcacgcatcaccgacattatggaaccagagcacgctctcctggccaaatcaatctttaagctaacttatcaaaataaagtagttagagtgcagcggcccgctaagaacggcacagtcatggatgtgataagcaggcgtgaccagcgaggttccggacaggtgggaacctacggccttaatacattcactaacatggaagcccaactgattcgccagatggagagtgagggcatcttttctcctagcgaactcgagaccccaaacctggcagaaagagtcttggattggttagagaagtatggggttgaacggctgaaaaggatggcgatctccggagacgactgtgtggtaaagcccattgatgaccgcttcgccacggctctcaccgcccttaatgatatgggtaaagtgagaaaggacataccgcagtgggagccttcaaaaggctggaacgattggcagcaagtccccttttgcagtcatcacttccaccagctgatcatgaaggacgggcgggagattgtggttccatgtaggaatcaggatgagctagtgggacgagcacgtgtctctcagggcgctggttggagcctgagagagacagcctgcctcgggaagtcctacgcacaaatgtggcagttgatgtattttcatcgccgggacctgaggcttgccgcgaacgctatctgttcagccgtgcctgtagattggattcccactagcagaaccacatggtctatccacgcacatcaccagtggatgactaccgaagacatgctgtccgtttggaatcgcgtgtggatagaggaaaacccatggatggaggataaaacgcatatcagtagctggggagacgtcccctacctcggcaagcgggaggaccaatggtgcggctcgttaattgggctgacagccagggctacctgggccactaatatccaggtggcaattaaccaggttcgaagattgatcggaaatgaaaactacctggattatatgacatccatgaaacggttcaagaatgagtctgaccctgaaggtgctctctggtga

SEQ ID NO: 13742 - RNA, 9879 nt, synthetic construct
  misc_feature 1..9879: note = derived and/or modified CDS sequence (opt3) from DENV-1__GQ199773__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagttctgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagagcaggacgcaaactttgtttgccgccgaacattcgtggatagaggctggggtaatgggtgtggactgtttggcaaaggctccttgataacttgcgctaagttcaagtgcgtaaccaaactcgaggggaagacagtgcagtacgaaaacctgaaatattcagtcaccgtgactgttcacacgggagaccagcatcaagtgggtaatgagagtacagaacacggcaccactgccaccattacaccccaggcgcctagcaccgagatccagttaactgactacggggccctgacactcgattgttctccaaggacgggacttgactttaacgaaatggtcctgttgaccatgaaggagaaatcctggctagtgcataagcagtggttcctggatctcccgctgccctggacttcaggcgcaagcacaagtcaagagacctggaatcggaaagaccttctggtaacatttaagactgctcacgccaagaaacaggaagttgtggtcttgggttctcaggagggggctatgcacaccgccctcacgggcgcaaccgaaattcaaacatccggaactaccacaatcttcgccggccatctgaagtgccgtttaaaaatggataagctgactctaaaagggatgagctatgtgatgtgtaccggatcgttcaagctcgagaaggaagtcgctgagacgcagcacggtacagtgctggttcagatcaaatacgagggcaccgacgcgccttgcaagattccattttctactcaggatgaaaaaggggtgacacaaaacggacgccttataaccgcaaatcccatcgtaactgacaaggagaaacctgtcaacattgaagccgagccacccttcggcgagtcctatatcgtgataggtgctggggaaaaggccttgaagctgtcatggtttaaaaagggcagtagcattggaaaaatgttcgaggcaaccgccagaggcgctaggcggatggccatcctcggggatacagcatgggactttggatccatcggtggcgttttcacgtctgtggggaagctggtccatcagatttttggaaccgcgtacggcgtgcttttcagcggtgtatcatggactatgaaaatcgggattggcgtgctgttgacatggctcggactgaatagtcgatccaccagcttatctatgacatgtatagctgttggcctggtcactctatacctcggggtgatggtgcaggccgattcaggatgcgtcatcaactggaagggccgcgaactgaagtgtggtagtgggatttttgttaccaatgaggtgcacacgtggacagaacagtataaattccaagcagacagcccgaagagactttccgccgctatcggaaaagcctgggaggagggcgtgtgcggtatcaggtctgcaacccggttggaaaacattatgtggaagcagatatcgaacgagctgaatcatatcctcctggaaaacgacatgaaatttactgtagtcgtgggcgatgttgctgggattttagcccagggaaagaaaatgatccgccctcagcccatggagtacaagtatagctggaagtcctggggcaaagcgaagattatcggggccgacgtgcaaaataccacattcataatcgatggaccaaacactcctgaatgtcccgacgatcagagagcttggaatatttgggaggtcgaggactacggctttggtatcttcaccacaaacatttggctgaaacttagggattcatatacgcaggtgtgcgaccaccgtttgatgagtgcagccatcaaggattctaaagctgttcacgccgacatggggtactggatagaaagcgagaagaatgaaacctggaagctcgcacgggcgtccttcattgaggtgaaaacttgtatctggccaaagtcacatacactgtggagcaacggagtactagaatctgagatgattatccccaaaatatatggcggtcctatctcccagcacaattaccgaccaggctactttacccaaactgccgggccgtggcatctgggaaagctcgagctggatttcgacctttgcgaaggcacaaccgtcgtggtggatgagcactgcgggaacagaggacccagtttgaggacgactaccgtcacaggcaaaattatccacgaatggtgttgccgcagctgtaccctgcctccattacggtttaagggtgaggacgggtgctggtatggaatggagattagacccgttaaggaaaaagaggaaaatctcgtgaagtctatggtatccgctggctcaggtgaggtggacagtttcagcctgggccttctgtgtatctcgataatgattgaagaggtcatgaggtcccgctggtctcgaaaaatgttgatgactgggacactcgccgtgtttttcctgctaatcatgggacagctgacctggaacgatctcatccggctgtgcattatggttggcgcaaatgctagcgaccgtatggggatgggaacaacttaccttgccttgatggcaacctttaagatgagacctatgttcgccgtgggcctgttatttaggcgcctcacgtcacgggaggtcctgcttctgacaatcggtctaagtctcgtggcttccgttgaactgccaaactctttggaggaactgggggatggattagcgatgggcattatgatactcaaactgcttaccgacttccagagccatcaactgtgggccactttgctctccctgacctttatcaagacaactttctcactacactatgcatggaagaccatggctatggtgctgagcattgtcagtctttttcccctctgtctgtctacgacatcccagaaaaccacttggttgccggtactgttaggcagcctcgggtgcaagcctctgacaatgttccttatcgccgagaataaaatttggggaagaaagtcgtggccactgaacgaaggtatcatggccgtgggcatagtttcaatcttgctctctagtctgctaaaaaacgatgtgcccctggctgggcctcttattgcaggaggcatgctcatcgcctgttacgtcatttccggtagctctgcggacctgagcttggagaaggctgccgaggtgtcctgggaagaggaagcagagcattcaggggccagtcacaatatcttagtagaagtgcaggatgacggaaccatgaaaataaaggatgaggagagggacgatactctgacaattctcctgaaggctacccttctggcagtcagcggcgtttatcccttgtctatcccagccacgctattcgtgtggtacttttggcagaaaaagaaacaacgatccggcgtgctgtgggacactccttcacccccagaagtcgagcgcgcggtgctcgatgacgggatctatcggattatgcagagaggactgcttggtaggagtcaggttggcgtaggggtgttccaggaaaacgtctttcataccatgtggcacgtgacacgtggagctgttttaatgtaccaaggcaagcgcctggagccgagctgggcctccgtgaaaaaggacctcatatcttacggtgggggatggcggttgcagggctcgtggaataccggcgaggaagtccaggtgatcgcagtagagcctgggaagaaccccaaaaatgtccagacagccccaggaactttcaagaccagcgaaggtgaggtgggcgctattgccctggattttaaacccgggacgtcaggatcccctatcgttaacagagaaggcaagattgtgggtctctatgggaatggagtcgtgacaactagtggcacctacgtttctgcaatcgctcaagccaaagcgagccaggagggcccactgcccgagatagaagacgaggtgttcaggaagcgaaaccttacaatcatggatctgcaccctgggtccggaaagacccggcgctatttgccggccattgtcagagaagcaatcaaaaggaagctacggactctgattctcgctccaacccgagtggtagcctcagagatggctgaagcattaaaaggtatgcccatcagataccagacaacggccgtgaagtctgagcatactggcaaagagatagttgacctgatgtgccacgccacctttacaatgcgccttctgagccctgtcagggtgccaaattataacatgattatcatggatgaagctcatttcaccgaccccagttccatcgcggcacgtgggtacattagcactcgggtgggaatgggcgaggccgctgccatctttatgacagcaacccctccgggttctgtcgaagccttcccccaatcaaatgctgtaatacaggatgaggaaagagacattccagagaggtcctggaacagtgggtatgagtggatcacggattttcctggaaagactgtgtggttcgttcccagcattaagtcgggcaatgacatcgcgaactgtctccgcaaaaatggcaagcgagtgatacagttgtctagaaaaacattcgataccgaataccagaagaccaaaaacaacgactgggactacgtcgtgactacagatatttccgagatgggggccaattttcgggcagacagggttatcgatccacgccgttgcctgaagcctgtgatcctcaaggacggacccgaaagagtcattctggctggtccaatgccggtgaccgtagccagcgcagcccaacggaggggccgcatcgggcgaaaccacaataaagagggagatcagtatatttacatgggccagcctcttaacaatgacgaggatcatgctcactggacagaagccaagatgctactggacaacataaatactcccgagggtatcattccagcgttgttcgaacccgagagagaaaaatcagcagccatcgatggggagtatcggttaaggggcgaggctcgcaagacgtttgtggaactgatgagaaggggagacctccctgtttggctgagttacaaagtcgcctctgagggcttccagtattccgatcggcgttggtgctttgacggggaacgcaacaatcaagtgcttgaggaaaacatggatgtggagatctggaccaaggagggagaacgaaaaaagctgagaccaaggtggctcgacgctcggacatacagcgaccccttggcactgcgcgagttcaaggaatttgccgctggtagaaggtcagtcagtggcgatctaattctggagatagggaaactccctcagcaccttactcagcgggcccagaatgcactggacaacttagttatgttgcataatagcgaacaaggaggccgagcgtatagacacgccatggaggagctgccggataccatcgaaacactcatgctgcttgctctgattgccgtgctcaccggtggggtaactttgttctttctgtccggccgcggattaggcaagacgtctatcgggctactgtgtgtgatggcaagctccgtcctcctttggatggcttcagtggagccacattggattgccgcatctatcatactggaattctttttgatggttctgctcatccccgagcctgacaggcagcggaccccccaggataaccagctggcctacgtggtcattggacttctcttcatgatcctgacagtagctgcgaatgagatgggtttgctggaaactaccaaaaaggacttaggcattgggcacgtggccgttgagaaccaccatcacgcagctatgctagatgtggacctgcatccagccagtgcctggacactctacgcagtcgctaccactatcataacacctatgatgcgtcacacgattgaaaacaccactgccaatatctcgcttacagcgattgctaaccaagccgcaatcctgatgggattggataaaggctggcccataagcaagatggacatcggtgtgccactgctcgccctggggtgctattcccaggtcaatcctcttaccttaaccgctgcagtgctgatgctcgttgcccattacgcgattatcggcccgggattgcaggctaaggccacaagagaggcacaaaaaaggactgccgctggcattatgaagaaccccacggtggatgggatcgtagccatagacctggatccagtggtctatgacgcaaaatttgaaaagcagctaggacagattatgctgctcatcctttgtacctctcagatcctgttgatgcgcacaacttgggctctgtgcgagtcaattaccctcgccacaggccctctgaccactttatgggagggtagccccgggaaattctggaatacgacaatcgcggtttccatggccaacatattccggggaagttaccttgcaggcgctggtctggccttttctctcatgaagagcctaggcgggggacgaagaggcaccggggcacaaggagaaactctgggcgagaagtggaaaaggcagttgaatcagctgtcaaagtccgaattcaacacctataaacgcagtggtattatggaggtggaccggagcgaagctaaggaggggctcaaaagaggagagacaactaagcacgccgtctctcgtggcaccgccaagcttaggtggtttgtggaacggaatctggtaaaaccagagggtaaggtgatcgatttgggctgtgggcgcggaggctggtcctactattgcgcggggctgaaaaaggttacagaagtgaaaggatacacgaagggcggtcctgggcacgaggaacccattccgatggctacctacggatggaacctcgtcaaattacattcaggcaaggacgtgttctttatcccacctgagaagtgtgatactctgctttgcgacataggcgagagctcgcccaatccaacaatcgaagaggggcgaaccctgagagtcctaaaaatggtggaaccctggctcaggggaaaccagttctgtattaagatcctgaatccttatatgccgtctgttgtagagactttggagcaaatgcagcggaaacacggtggcatgctggtgcgcaaccccctcagtagaaattccacacatgaaatgtactgggtcagctgcgggaccggaaacattgtgtcagcagttaatatgacgtccaggatgcttctgaaccgatttaccatggcccaccggaagccaacatatgagcgtgatgtggacttaggcgctggtactagacacgtcgccgtggaacctgaggtagcaaacctggatatcattgggcagcgcatcgaaaatataaaacatgagcacaagtctacctggcattacgacgaggataacccctataagacatgggcctaccacggaagctatgaagtgaaacctagtggctccgctagctctatggttaatggcgtcgtgaagttgctcactaaaccatgggacgtgattcccatggtcacccagatcgcgatgacagataccactcctttcgggcaacagagggtttttaaggagaaagtggacacgcggacaccaaaggccaagagaggaaccgcacagatcatggaagtaactgctaaatggctgtggggtttcctatcacgcaacaagaaacccaggatttgtacccgagaggaatttacacggaaggtgagaagtaatgccgcaataggcgccgtcttcgtggacgagaaccaatggaattccgctaaagaggccgttgaagatgagaggttttggaaccttgtgcatcgcgaacgtgagctgcacaagcaggggaagtgcgcgacgtgcgtctacaatatgatgggaaaacgggaaaagaaactcggcgagttcggtaaggcaaaagggagcagagccatctggtacatgtggctgggagctaggttcttggagtttgaagccctgggcttcatgaacgaggaccactggttttctcgcgaaaattcgctctcaggcgtggagggggagggacttcataagctgggttatattttacgagatatcagcaaaattccgggcgggaacatgtacgcagacgataccgctggatgggacactcggatcacagaagatgacctgcagaatgaggccaagataaccgatatcatggaacctgagcacgctttgctcgccaagtccattttcaaactgacttatcagaacaaggtagttagagtgcaaaggccagcaaaaaatggcacagtcatggacgtgatcagtcgcagagatcagcggggttctgggcaggtgggaacctacggcctaaacacatttactaacatggaagcgcagcttattaggcaaatggagagcgagggcatcttctccccctcagaactggagacccctaatctcgccgggcgtgtcctggactggttggaaaagcatggagttgagcgattaaaacgcatggctataagtggtgatgactgtgtggtaaagccaattgacgatagatttgccacggcactgaccgctctcaacgacatgggcaaggtgcggaaagatatcccccagtgggaaccgtctaaggggtggaatgactggcagcaggtccctttctgcagccaccactttcatcaacttatcatgaaagatggaagggagattgtggttccctgtcgcaaccaggacgagctggtgggcagagcccgggtctcccagggtgcagggtggtcactaagggaaacagcctgcctgggaaagagctatgcgcagatgtggcaactcatgtacttccaccgacgtgatttgagactggctgccaatgcaatatgttctgccgtgccagtagactgggttcctacttcccgcaccacatggagtatccatgctcaccatcagtggatgactaccgaggatatgcttagcgtgtggaaccgggtctggattgaagagaatccctggatggaagacaaaacgcacatctcgtcctggggcgatgtgccatatctgggcaagagggaggaccagtggtgcgggtctctcattggattaacagccagagcaacctgggctactaacatccaagttgccataaatcaggtgcgccggctgatcggtaacgagaattacttggactacatgacatcaatgaagaggtttaaaaacgaaagcgatcccgagggcgcgctgtggtga

SEQ ID NO: 13743 - RNA, 9879 nt, synthetic construct
  misc_feature 1..9879: note = derived and/or modified CDS sequence (opt3) from DENV-1__JF937596__SS-prME
  source 1..9879: mol_type = other RNA
agcgtgaccatgctgctcatgcttatgcccaccgcactggctttccacttgactacgaggggaggggaacctcatatgatcgtaaccaagcaggaaaggggaaaatccttactgtttaagacatctgccggtgttaatatgtgcactctaattgccatggacctcggcgaactgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggtagcttcaaactggagaaggaagtggctgagacccagcacggaacggtccttgtgcagataaagtacgagggcacagacgcgccttgcaaaatcccattctcgacccaagatgaaaagggggttattcagaacggacgcttgatcactgcaaatcccatagtgacagacaaagagaagcctgtaaacattgaagccgagccaccctttggcgagtcttatatcgtcatcggtgtgggggaaaaagctctgaagctctcctggttcaagaaaggctcaagtattggaaagatgtttgaggccaccgcaagaggcgccaggcggatggctatcctgggggatactgcctgggacttcggaagcattggtggcgtttttacctccgtggggaaacttgtccatcagatattcggaacagcatacggcgtgctgttttctggtgtaagctggacgatgaagatcgggattggcgtgttgctcacctggctgggattaaattcacgaagtacttccctgagcatgacatgtatcgcggttggcctagtcaccctctacctgggggtgatggtgcaggctgattctggatgcgtcatcaactggaaaggccgcgaacttaagtgtggttcagggattttcgttacaaatgaggtgcacacttggaccgaacaatataagtttcaggccgacagtccgaaaagattgagcgcagccataggaaaggcttgggaggagggcgtgtgcggtatcaggtccgccacgcggctggaaaacattatgtggaaacagatctctaacgagctcaatcatattctgttagaaaacgacatgaagttcacagtagtcgtgggcgatgttgtggggatcctggcacagggcaaaaagatgatacgccctcaacccatggagcacaaatactcgtggaaaagctggggcaaggctaagatcattggggccgacgtccagaataccacttttatcattgatggaccaaacacccctgaatgtcccgacgatcagagagcgtggaatatctgggaggtggaggactatggcttcggtatatttacaactaacatttggcttaagttgagggattcctacacccaggcctgcgaccaccgtctcatgtcagctgcaatcaaagatagtaaggccgttcatgctgacatggggtattggattgaatctgagaaaaatgaaacatggaagctggcccgggcatccttcatcgaggtgaagacgtgtatatggccaaaatcccacaccctatggtcaaacggagtactggaaagcgagatggtcatccccaagatttacggcggtcctatctctcaacataattatcgaccaggctacttcactcagacagcggggccgtggcacctcggaaaactggagcttgattttgacttgtgcgaaggcaccactgtggtggtcgatgagcactgcgggaacagaggaccctccctgaggacaaccacggttactggcaagattatccatgaatggtgttgccgcagttgtaccttacctccactccggttcaaaggtgaggacgggtgctggtacggaatggagataagacccgtgaaggaaaaggaggaaaatctggtaaaaagcatggtgtctgccggctccggtgaggtcgactcatttagtcttggcctgttgtgtattagcatcatgatcgaagaggtgatgaggtcgcgctggtcccgaaagatgctcatgacagggaccctggctgttttcctactgctcattatgggacagctgacttggaacgatcttatccggttgtgcattatggtgggcgccaatgcatctgaccgtatggggatgggaacaacctatctggctttaatggccacatttaaaatgagacctatgttcgcagtcggcctcctgtttaggcgccttactagccgggaggtgctgctactcaccataggtctgtcattggttgccagtgtggaactgccaaactccttagaggaactcggggatggactggctatgggcatcatgattcttaagctgttgacggacttccaatctcaccagctctgggcgacactgctaagcctgacctttatcaaaactaccctttccctccattacgcctggaagacaatggcaatggtcctgtcaattgtcagcttgttccccctgtgtttaagtactacctctcagaagacgacatggctcccggtgctgcttggctccctggggtgcaaacctttgaccatgtttctcatcgctgagaataagatatggggaagaaaaagctggccactgaacgaaggtatcatggccgttggcgtggtctcgattctactgtcatctcttctcaagaacgatgtgcccctggccgggcctttgatcgctggaggcatgttaattgcatgttatgtaatcagtggttccagcgccgacctgtctctcgagaaagcggctgaggtgagctgggaagaggaagccgagcactccggggcatcacataatatactggtcgaagttcaggatgacggaactatgaagattaaagatgaggagagggacgatacacttaccatcctgttgaaggccactctactggctgtgagtggcgtgtaccccctcagcatcccagcaacactgttcgtctggtatttttggcaaaagaaaaagcagcgatctggcgtgctttgggacaccccttcacccccagaagttgagcgcgccgtattagatgacgggatttaccggataatgcagagaggactgctcggtaggagccaggtgggcgtcggggtgttccaagaaaacgttttccacacgatgtggcacgtgactcgtggagcggtcttgatgtatcagggcaaacgcctggagccgagttgggctagcgtgaagaaagacctcatctcctacggtgggggatggcggctgcagggctcttggaataccggcgaggaagtacaggtcattgccgtggagcctgggaagaaccccaagaatgttcaaacagcaccaggaacctttaaaacacccgaaggtgaggtgggcgccatcgctcttgatttcaagcctgggacttcgggaagcccaattgtcaacagagaaggcaaaatcgtgggtctgtacgggaatggagttgtgaccacgtcaggcacatatgtctccgccatagcacagactaaggctagtcaggagggccccttgcctgagatcgaagacgaggtgtttaggaaacgaaacctaaccattatggatctgcatccggggtctggaaagacacggcgctacctcccagccatcgtaagagaagcgattaagaggaaattacggaccctgatccttgcccccactcgagtggttgcaagcgagatggctgaagccctgaagggtatgcctataagatatcaaaccacagctgtcaaatccgagcacacgggcaaggagattgtggacctcatgtgccatgcaactttcaccatgcgcttgctgtcaccagtgagggtccccaattacaacatgatcatcatggatgaagcccactttacagacccttctagcattgccgctcgtgggtatatcagtacccgggtaggaatgggcgaggcggcagccatattcatgactgctacaccgcccggttccgtggaagcctttccacagagcaatgcagttattcaggatgaggaaagagacatccctgagaggtcttggaactcagggcatgagtggattaccgatttccccggaaaaacggtgtggtttgtcccatccatcaagagtggcaatgacatagccaactgtctccgcaagaatggcaaacgagtgattcagctgagcagaaagactttcgatacagaataccagaaaaccaagaacaacgactgggactatgttgtgaccactgatatctcggagatgggggctaattttcgggcggacagggtcatcgatcctcgccgttgccttaaacccgtgattctaaaggacggaccagaaagagtaatcctggccggtccgatgcctgtgacagttgcatctgctgcccagcggaggggccgcattgggcgaaaccacaataaggagggagatcagtacatatacatgggccagcccttgaacaatgacgaggatcacgcacattggaccgaagccaaaatgttactggacaacatcaatacaccagagggtattatccccgctctcttcgaacctgagagagaaaagtccgccgcgatcgatggggagtatcggctgaggggcgaggcacgcaaaactttcgtcgaacttatgagaaggggagacctgccagtgtggctcagctacaaggtggcctcagagggctttcaatatagtgatcggcgttggtgcttcgacggggaacgcaacaatcaggtcttggaggaaaacatggatgttgagatttggacgaaagagggagaacgaaagaaactgagacccaggtggctagacgctcggacctactctgaccctctggccctccgcgagtttaaggagttcgctgcaggtagaaggtccgtgagcggcgatcttatactggagatcgggaagttaccgcagcacttgacacagcgggcccaaaatgctctggacaacctcgtaatgctgcataattcagaacagggaggccgagcctatagacacgcaatggaggagcttccagatactattgaaaccctgatgctcttggcgctgatcgccgtgttaacaggtggggtcaccctatttttcctgagtggccgcggactcggcaaaactagcattgggcttctgtgtgtgatggcttcctctgttttgctgtggatggccagcgtggagccccactggatcgcagcttccataatcctcgaatttttcctgatggtccttctcattcctgagcccgacaggcagcggacgccacaggataaccaactggcctacgtagtgatcggattgctgtttatgattttaaccgttgcagccaatgagatgggtctactggaaacaactaagaaagacctcggcatcgggcatgtggctgtcgagaaccaccatcacgcgaccatgcttgatgtggacctgcatcctgcctcagcatggacattgtatgctgtcgccaccactataattacacccatgatgcgtcacacgatcgaaaacaccactgccaatatttctctgacagcaatcgctaaccaggccgcgatactcatgggactggataagggctggccaatcagtaaaatggacattggtgtgcctcttttagctctggggtgctactcgcaggttaatccgctcaccttgaccgccgcagtgctgatgctagtagcccactacgctatcattggccccggactgcaagcaaaggccacaagagaggcgcagaagaggactgctgccggcatcatgaaaaacccaacggtggatgggatagtcgcaattgacctcgatcctgttgtgtatgacgccaagttcgaaaaacagcttggacagatcatgctgttgatcctgtgtaccagccaaattctcctgatgcgcacaacttgggctttatgcgagtccatcacccttgccacaggccccctgaccactctctgggagggttctccagggaagttttggaatacgacaatagcagtctcaatggctaacattttccggggaagctacctagccggcgcgggtctggccttttccttgatgaaaagtctgggcgggggacgaagaggcaccggggcacagggagaaactctcggcgagaagtggaagaggcagcttaatcagctgtctaaaagcgagttcaacatctataagcgctcaggtattatggaggtggaccggtccgaagctaaagaggggttgaagagaggagagaccacacgtcatgccgtaagtaggggcactgcaaaactgcggtggttcgtggaacgcaatctcgttaagcctgagggtaaggtgatcgatttaggctgtgggcgaggaggctggagctactattgcgctgggctgaaaaaggtcaccgaagtgaaaggatacacaaagggcggtcccgggcacgaggaaccgataccaatggccacgtatggatggaaccttgtcaaactgcattctggcaaggacgtgtttttcgcccctcccgagaaatgtgataccctactctgcgacatcggcgagtcctcaccaaatcccactattgaagaggggagaacactgagggttttgaagatggtagaaccttggctgcggggaaaccaattttgtatcaagattctcaatccgtacatgcccagcgtggtcgagacccttgagcagatgcagcgcaaacacggtggcatgctggtgagaaacccattatcgagaaattctactcacgaaatgtactgggttagttgcgggacaggaaacatcgtgtccgcggtcaatatgaccagccgaatgctgttgaaccggttcacgatggctcatcgtaagcctacctatgagagagatgtggacctcggcgcaggtacacgccacgtagccgtggaacccgaggttgctaacctggatattatcgggcagaggatagaaaatattaaacatgagcacaagtcaacttggcattacgacgaggataacccttataaaacctgggcctaccacggatcctatgaagtcaagccatctggcagcgcaagttccatggtgaatggcgtggtcaagctacttacaaaaccctgggacgttatccctatggtgactcaaatcgccatgaccgatacaaccccatttgggcagcagcgggtattcaaggagaaagtggacactagaacgcccaaggctaaacgcggaacagcgcaaattatggaagtcaccgccaggtggctgtggggttttctcagccgaaacaagaagccgcggatatgtactagagaggagttcaccaggaaagtgcgctctaatgcagctatcggcgccgtttttgtggacgagaaccagtggaactcagcaaaggaggccgtcgaagatgagcgtttctgggacctggtgcagaaagaacgggagttgcacaagcaggggaaatgcgctacatgcgtatacaacatgatgggaaagagagaaaagaaactgggcgagtttggtaaggccaaagggagtagggcgatttggtatatgtggctcggagcacgcttccttgagtttgaagccctgggcttcatgaatgaggatcattggttctcccgagaaaacagcttatctggcgttgagggggagggactgcacaagttgggttacatcctccgggacatttcgaaaatccctggcgggaatatgtacgctgatgacacggccggatgggataccagaataactgaagacgatctgcaaaacgaggcaaagatcacagacattatggaaccagagcatgctctacttgccacctcaatctttaaactgacttatcagaataaggtggtcagggtgcagcgccccgctaagaacggcacagtgatggatgtcattagcagacgggaccagaggggttccgggcaagttggaacctacggcctcaatacattcactaacatggaagcccagctgatccgtcagatggagagtgagggcatatttttgccttctgaattagagaccccaaacctggcagaacgagtgctcgattggcttgagaaacacggggtagaacgcctgaagagaatggcgattagcggagacgactgtgtggtcaaacccatcgatgaccggttcgccacggctctaaccgccctgaatgatatgggtaaggtgaggaaagacatcccgcagtgggagccttccaagggctggaacgattggcaacaggttcccttttgctcacaccatttccaccagctcattatgaaggacgggcgcgagatagtggtcccatgtagaaatcaggatgaattggtgggacgggcaagggtaagtcaaggcgctggttggtctctgcgagagacagcctgccttgggaaaagctatgcacagatgtggcagctgatgtactttcatcgtagagacctccgcttagccgcgaacgctatctgttccgccgttcctgtggattgggtccccacttcacggaccacatggagcattcacgcacatcaccaatggatgactaccgaagacatgctgtctgtgtggaatagggtttggatcgaggaaaacccatggatggaggataagacgcacgtgtccagttggggagacgtcccctatttgggcaaaagagaggaccagtggtgcggcagcctgattgggctcacagcccgcgctacctgggcctcgaatatccaggtggcaataaaccaggtacggaggcttatcggaaatgaaaactacctggattatatgacttccatgaagcgattcaaaaatgagggtgaccctgaaggcgctctatggtga

SEQ ID NO: 13744 - RNA, 9879 nt, synthetic construct
  misc_feature 1..9879: note = derived and/or modified CDS sequence (opt3) from DENV-1__FJ898380__SS-prME
  source 1..9879: mol_type = other RNA
agcgtgaccatgctgctcatgcttatgcccacggccctggctttccacttgactacgagaggaggggaacctcatatgatcgtctccaagcaggaaagaggaaaatctttactgtttaagacctcagccggtgttaatatgtgcacactaattgccatggacctcggcgaactgtgtgaagatactatgacctacaaatgcccacggattacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccgggagcttcaaactggagaaggaagtcgccgagacgcagcacggtacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattgtgatcggtgccggggaaaaagctctgaagctctcctggttcaagaaaggctcaagtatcggaaagatgtttgaggccaccgcaagaggcgccaggcggatggctattctgggggatacagcctgggacttcggaagcatcggtggcgtttttacgtccgtggggaaacttgtccatcagattttcggaaccgcatacggcgtgctgttttctggtgtaagctggactatgaagatagggatcggcgtgttgctcacatggctgggattaaattcacgaagtacctccctgagcatgacatgtattgcggttggcctagtcactctctacctgggggtgatggtgcaggctgattctggatgcgtcatcaactggaaaggccgcgaacttaagtgtggttcagggatcttcgttaccaatgaggtgcacacgtggacagaacaatataagtttcaggccgacagtccgaaaagattgagcgcagccattggaaaggcttgggaggagggcgtgtgcggtataaggtccgccacccggctggaaaacatcatgtggaaacagatttctaacgagctcaatcatatcctgttagaaaacgacatgaagttcactgtagtcgtgggcgatgttgcagggattctggctcagggcaaaaagatgatccgccctcaacccatggagtacaaatattcgtggaaaagctggggcaaggccaagataatcggggcggacgtgcagaataccacatttattatcgatggaccaaacactcctgaatgtcccgacgatcagagagcctggaatatttgggaggtcgaggactacggcttcggtatctttaccacaaacatatggcttaagttgagggattcctatacacaggtgtgcgaccaccgtctcatgtcagctgcaattaaagatagtaaggccgttcacgctgacatggggtactggatcgaatctgagaaaaatgaaacctggaagctggcccgggcatccttcattgaggtgaagacttgtatctggccaaaatcccatacactatggtcaaacggagtactggaaagcgagatgataatccccaagatttatggcggtcctatctctcaacacaattaccgaccaggctacttcacccaggcggccgggccgtggcatctcggaaaactggagcttgattttgacttgtgcgaaggcactacagtcgtggtggatgagcactgcgggaacagaggaccctccctgaggaccacgactgtcaccggcaagattatccacgaatggtgttgccgcagttgtacattacctccactccggttcaaaggtgaggacgggtgctggtatggaatggagataagacccgttaaggaaaaggaggaaaatctggtgaaaagcatggtatctgctggctccggtgaggtggactcatttagtcttggcctgttgtgtattagcatcatgatcgaagaggtcatgaggtcgcgctggtcccgacggatgctcatgaccgggactctggccgtgttctttctactgattatgggacagctcacatggaacgatctgatccgtctttgcattatggttggcgcaaatgcttctgacagaatggggatgggaaccacatacttggccctgatggcaactttcaagatgaggcctatgtttgccgtgggcttactcttccgccggctgaccagcagagaggtccttctgctaacgataggtctctcactggtggctagtgttgaattgccaaactccctggaggaattaggggatggactcgcgatgggcatcatgattctgaaacttctgacagactttcaatctcatcagttgtgggccaccctcctgagcctaactttcatcaagaccacattttccctgcactatgcatggaaaactatggctatggtgctttcaattgtcagcctcttccccctgtgtttgagtaccacgtctcagaagacaacctggctgccggtattactcggctccctggggtgcaagcctcttactatgtttctgatcgccgagaataaaatatggggaaggcgaagctggccattgaacgaaggtatcatggccgtgggcattgtttcgatcctcctgtcatctctactgaagaacgatgtgccccttgctgggcctctcattgcaggaggcatgctgatcgcctgttacgtcataagtggttccagcgcggacttgtctttagagaaagctgccgaggtgagctgggaagaggaagcagagcattccggggcctcacacaatattctggtagaagtgcaggatgacggaacaatgaagatcaaagatgaggagcgcgacgataccctcactatcctgcttaaggctacactgttggcagtcagtggcgtttatcccctaagcattccagccaccctgttcgtgtggtacttctggcagaaaaagaagcagcggtctggcgtgctctgggacacgccttcacccccagaagtcgagagagcggtgctggatgacgggatatataggatcatgcagcgtggacttttaggtcgcagccaggttggcgtaggggtgtttcaagaaaacgtcttccatactatgtggcacgtgacccggggagctgttctgatgtaccagggcaaaagactcgagccgagttgggccagcgtgaagaaagacttgatttcctacggtgggggatggaggctgcagggctcttggaatacaggcgaggaagtccaggtgatcgcagtagagcctgggaagaaccccaaaaatgtccaaaccgccccaggaacatttaagactcccgaaggtgaggtgggcgctattgccctcgatttcaagcctgggacctcgggaagcccaatcgttaaccgagaaggcaaaatagtgggtctgtatgggaatggagtcgtgacgacatcaggcacttacgtttccgcaatcgctcaggccaaggcgagtcaggagggcccccttcctgagattgaagacgaggtgtttcggaaacgcaacctgaccatcatggatttgcacccggggtctggaaagacaagaaggtatctaccagccattgtccgggaagcaatcaaacgaaagctgagaaccctcatattagctcccactcgcgtggtagccagcgagatggctgaagcactgaagggtatgcctattaggtaccaaaccacagccgtgaaatccgagcatacgggcaaggagatcgttgaccttatgtgccacgccactttcaccatgcgtctgctctcaccagtccgggtgcccaattataacatgatcattatggatgaagctcattttacagacccttctagcatcgcggcaagagggtacataagtaccagggtgggaatgggcgaggccgctgccattttcatgactgcaacaccgcccggttccgtcgaagcctttccacagagcaatgctgtaatccaggatgaggaacgcgacattcctgagcgatcttggaactcagggtatgagtggatcaccgatttccccggaaaaacggtgtggtttgttccatccataaagagtggcaatgacattgcgaactgtttgaggaaaaatggcaagcgggtgatccagctgagcaggaagactttcgatacagaataccagaaaaccaagaacaacgactgggactacgtcgtgaccactgatatctcggagatgggggccaatttccgcgcagaccgtgttattgatcctagacggtgcctcaaacccgtgatcctgaaggacggaccagaaagggtcattcttgctggtccgatgcctgtgacagtagcctctgcagcccagcgccgaggcagaatagggcggaaccacaataaagagggagatcagtatatctacatgggccagcccctaaacaatgacgaggatcatgctcactggaccgaagccaagatgctgttggacaacattaatacaccagagggtatcatccccgcgttatttgaacctgagagggaaaagtccgcagccattgatggggagtatcgcctgagaggcgaggctaggaaaactttcgtggaactcatgcggcgtggagacctgccagtttggcttagctacaaggtcgcctcagagggctttcaatatagtgatcgccgatggtgcttcgacggggaaagaaacaatcaggtgctggaggaaaacatggatgtggagatatggacgaaagagggagaaaggaagaaactccggccccgctggttggacgctagaacctactctgaccctctggcactaagggagtttaaggagttcgccgctggtcggcgatccgtcagcggcgatctgatcctcgagattgggaaacttccgcagcacctgacacagagagcccaaaatgcattagacaacttggttatgctgcataattcagaacagggaggccgcgcgtataggcacgccatggaggagctcccagatactatcgaaaccctgatgcttctggctctcattgccgtgttgacaggtggggtaaccctgtttttcttaagtggccggggactaggcaagactagcatcgggctgctctgtgtgatggcatcctctgtccttctgtggatggctagcgtggagccccattggatagccgcatccatcattttggaatttttcctgatggttctcctgatccctgagcccgaccgtcagagaacgccacaggataaccaacttgcctacgtggtcattggactcctgtttatgatcttgaccgtagctgcgaatgagatgggtctgttagaaacaactaagaaagacctaggcatagggcacgtggccgttgagaaccaccatcacgcagctatgctggatgtggacctccatcctgcctcagcctggaccctttacgcagtcgctacaaccattatcactcccatgatgaggcacacaattgaaaacacgaccgccaatatctctctgactgcgatagctaaccaggccgcaatcttgatgggactggataagggctggccaattagtaaaatggacatcggtgtgcctctcctggcccttgggtgctattcgcaggtcaatccgttaacactgaccgctgcagtgctcatgttggttgcccattacgcgattatcggccccggactgcaagctaaggccacccgcgaggcacagaaacggacagccgctggcataatgaagaacccaactgtggatgggattgtagccatcgacctagatcctgtggtctatgacgcaaagttcgaaaaacagctgggacagatcatgctccttattctgtgtacgagccaaatcttgctgatgcgaaccacatgggctctctgcgagtccataactctggccaccggccccttaacaaccctttgggagggttctccagggaagttttggaatactacgattgcggtttcaatggccaacatcttcagaggaagctacctggcaggcgctggtctcgccttctccctaatgaaaagtctgggcgggggaaggcgcggcacaggggcacagggagaaaccttgggcgagaagtggaaacggcagctgaatcagctctctaagagcgaatttaacacttataagagatcaggtattatggaggtggaccgttccgaagctaaagaggggcttaagaggggagagaccacaaaacacgccgtcagtcggggcactgccaagctgcgctggttcgtggaacgaaatttggtaaaacctgagggtaaggtgatcgatctgggctgtgggagaggaggctggagctactattgcgcggggctcaagaaagttaccgaagtgaagggatacacaaaaggcggtcccgggcacgaggaaccgataccaatggctacgtacggatggaacttagtcaagctgcattctggcaaagacgtgtttttcatccctcccgagaagtgtgatacccttctgtgcgacattggcgagtcctcaccaaatcccactatcgaagaggggaggacactacgggtcctcaaaatggtggaaccttggctgcgcggaaaccaattttgtattaagatcttgaatccgtatatgcccagcgttgtagagaccctggagcagatgcagagaaagcacggtggcatgctcgtgaggaacccactttcgcgaaattctactcatgaaatgtactgggtcagttgcgggacaggaaacattgtgtccgcagttaatatgaccagccggatgctgttaaaccgtttcacgatggcccacagaaaacctacctatgagcgcgatgtggacctgggcgctggtacaaggcacgtcgccgtggaacccgaggtagcaaacttggatatcatagggcagcggattgaaaatatcaagcatgagcacaaatcaacttggcattacgacgaggataacccttataagacctgggcctaccacggatcctatgaagtgaaaccatctggcagcgctagttccatggttaatggcgtcgtgaagctcctgacaaagccctgggacgtgatccctatggtcactcaaattgcgatgaccgatacaaccccatttgggcagcagagagttttcaaagagaaggtggacactcgcacgcccaaagccaagaggggaacagcacaaataatggaagtaaccgctaaatggctatggggttttcttagccgaaacaagaagccgcggatctgtactagagaggagttcaccaggaaagtgcgctctaatgccgcaattggcgccgtctttgtggacgagaaccagtggaactcagctaaggaggccgttgaagatgagcgtttctgggacctggtgcatcgggaaagagagctccacaaacaggggaagtgcgcgacatgcgtctacaacatgatgggaaaaagggaaaagaagctgggcgagtttggtaaagcaaaggggagtcgcgccatctggtacatgtggttgggagctcgattcctggagttcgaagccctcggctttatgaatgaggatcactggttctcccgggaaaacagcctttctggcgtggagggggagggactgcataaattaggttatattctgagagacatctcgaagatacctggcgggaatatgtacgcagatgacacggctggatgggataccaggatcactgaagacgatttgcagaacgaggcccgcattacagacatcatggaaccagagcacgctctcctggccaaatcaatttttaagctaacctatcaaaataaagtagttagagtgcagcggcccgcaaagaacggcactgtcatggatgtgatcagcaggcgtgaccagcgaggttccggacaggtgggaacatacggccttaataccttcacaaacatggaagcgcaactgatacgccagatggagagtgagggcatattttctcctagcgaactcgagactccaaacctggccgaaagagtcttggattggttagagaagtatggggttgaacggctgaaaaggatggctatctccggagacgactgtgtggtaaagcccatcgatgaccgcttcgccaccgcactcacggctcttaatgatatgggtaaagtgagaaaggacattccgcagtgggagccttcaaaaggctggaacgattggcagcaagtccccttttgcagtcatcacttccaccagctgataatgaaggacgggcgggagatcgtggttccatgtaggaatcaggatgagctagtgggacgagcccgtgtctctcagggcgcaggttggagcctgagagagaccgcctgcctcgggaagtcctacgcgcaaatgtggcagttgatgtattttcatcgccgggacctgaggcttgctgccaacgcaatttgttcagccgtgcctgtagattggatccccacaagcagaactacctggtctattcacgctcatcaccagtggatgacaactgaagacatgctgtccgtttggaatcgcgtgtggatcgaggaaaacccatggatggaggataaaacccatataagtagctggggagacgtcccctacctcggcaagcgggaggaccaatggtgcggctcgttaatcgggctgacggccagggcaacatgggctaccaatattcaggtggccatcaaccaggttcgaagattgattggaaatgaaaactacctggattatatgacttccatgaaacggttcaagaatgagtctgaccctgaaggtgcgctctggtga

SEQ ID NO: 13745 - RNA, 9879 nt, synthetic construct
  misc_feature 1..9879: note = derived and/or modified CDS sequence (opt3) from DENV-1__FJ898382__SS-prME
  source 1..9879: mol_type = other RNA
agcgtgaccatgctgctcatgcttatgcccaccgcactggctttccacttgactacgcggggaggggaacctcatatgatcgtctccaagcaggaaaggggaaaatctttactgtttaagacctcagccggtgttaacatgtgcacgctaattgccatggacctcggcgaactgtgtgaagatactatgacctacaaatgcccacggataacagagaccgaaccggacgatgtggactgttggtgcaatgcgactgatacatgggtgacctatgggacgtgtagtcagactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagggattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaggacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaggcccctacaaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccgggagcttcaaactggagaaggaagtcgccgagacgcagcacggtacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattgtgatcggtgccggggaaaaagctctgaagctctcctggttcaagaaaggctcaagtatcggaaagatgtttgaggccaccgcaagaggcgccaggcggatggctattctgggggatacagcctgggacttcggaagcatcggtggcgtttttacgtccgtggggaaacttgtccatcagattttcggaaccgcatacggcgtgctgttttctggtgtaagctggactatgaagatagggatcggcgtgttgctcacatggctgggattaaattcacgaagtacctccctgagcatgacatgtattgcggttggcctagtcactctctacctgggggtgatggtgcaggctgattctggatgcgtcatcaactggaaaggccgcgaacttaagtgtggttcagggatcttcgttaccaatgaggtgcacacgtggacagaacaatataagtttcaggccgacagtccgaaaagattgagcgcagccattggaaaggcttgggaggagggcgtgtgcggtataaggtccgccacccggctggaaaacatcatgtggaaacagatttctaacgagctcaatcatatcctgttagaaaacgacatgaagttcactgtagtcgtgggcgatgttgcagggattctggctcagggcaagaagatgatccgccctcaacccatggagtacaaatattcgtggaaaagctggggcaaggccaagataatcggggcggacgtgcagaataccacatttattatcgatggaccaaacactcctgaatgtcccgacgatcagagagcctggaatatttgggaggtcgaggactacggcttcggtatctttaccacaaacatatggcttaagttgagggattcctatacacaggtgtgcgaccaccgtctcatgtcagctgcaattaaagatagtaaggccgttcacgctgacatggggtactggatcgaatctgagaaaaatgaaacctggaagctggcccgggcatccttcattgaggtgaagacttgtatctggccaaaatcccatacactatggtcaaacggagtactggaaagcgagatgataatccccaagatttatggcggtcctatctctcaacacaattaccgaccaggctacttcacccaggcggccgggccgtggcatctcggaaaactggagcttgattttgacttgtgcgaaggcactacagtcgtggtggatgagcactgcgggaacagaggaccctccctgaggaccacgactgtcaccggcaagattatccacgaatggtgttgccgcagttgtacattacctccactccggttcagaggtgaggacgggtgctggtatggaatggagataaggcccgttaaagaaaaggaggaaaatctggtaaagagcatggtatctgctggctccggtgaggtggactcatttagtcttggcctgttgtgtattagcatcatgatcgaagaggtcatgcgctcgcgatggtcccggcgtatgctcatgaccgggactctggccgtgttctttctactgattatgggacagctcacatggaacgatctgatcagactttgcattatggttggcgcaaatgcttctgacaggatggggatgggaaccacatacttggccctgatggcaactttcaaaatgcgccctatgtttgccgtgggcttactcttccggagactgaccagcagggaggtccttctgctaacgataggtctctcactggtggctagtgttgaattgccaaactccctggaggaattaggggatggactcgcgatgggcatcatgattctgaaacttctgacagactttcaatctcatcagttgtgggccaccctcctgagcctaactttcatcaaaaccacattttccctgcactatgcatggaagactatggctatggtgctttcaattgtcagcctcttccccctgtgtttgagtaccacgtctcagaaaacaacctggctgccggtattactcggctccctggggtgcaagcctcttactatgtttctgatcgccgagaataagatatggggacgacgcagctggccattgaacgaaggtatcatggccgtgggcattgtttcgatcctcctgtcatctctactgaaaaacgatgtgccccttgctgggcctctcattgcaggaggcatgctgatcgcctgttacgtcataagtggttccagcgcggacttgtctttagagaaggctgccgaggtgagctgggaagaggaagcagagcattccggggcctcacacaatattctggtagaagtgcaggatgacggaacaatgaaaatcaaggatgaggagcgggacgataccctcactatcctgcttaaagctacactgttggcagtcagtggcgtttatcccctaagcattccagccaccctgttcgtgtggtacttctggcaaaagaaaaagcagagatctggcgtgctctgggacacgccttcacccccagaagtcgagagggcggtgctggatgacgggatatatcgtatcatgcagcgcggacttttaggtcggagccaggttggcgtaggggtgtttcaagaaaacgtcttccatactatgtggcacgtgaccagaggagctgttctgatgtaccagggcaagaggctcgagccgagttgggccagcgtgaaaaaggacttgatttcctacggtgggggatggcgactgcagggctcttggaatacaggcgaggaagtccaggtgatcgcagtagagcctgggaaaaaccccaagaatgtccaaaccgccccaggaacatttaaaactcccgaaggtgaggtgggcgctattgccctcgatttcaagcctgggacctcgggaagcccaatcgttaaccgggaaggcaagatagtgggtctgtatgggaatggagtcgtgacgacatcaggcacttacgtttccgcaatcgctcaggccaaagcgagtcaggagggcccccttcctgagattgaagacgaggtgtttcgcaagagaaacctgaccatcatggatttgcacccggggtctggaaaaacaaggcggtatctaccagccattgtccgagaagcaatcaagagaaaactgcgcaccctcatattagctcccactagggtggtagccagcgagatggctgaagcactgaagggtatgcctattcgttaccaaaccacagccgtgaagtccgagcatacgggcaaagagatcgttgaccttatgtgccacgccactttcaccatgcggctgctctcaccagtcagagtgcccaattataacatgatcattatggatgaagctcattttacagaccctttctctatcgcggcaagggggtacataagcacccgcgtgggaatgggcgaggccgctgccatttttatgactgcaacaccgcccggtagtgtcgaagccttcccacagtccaatgctgtaatccaggatgaggaacgagacattcctgagagaagctggaactctgggtatgagtggatcaccgattttcccggaaagacggtgtggttcgttccatcaataaaatccggcaatgacattgcgaactgtttgcggaagaatggcaaaagggtgatccagctgagtcgcaagactttcgatacagaataccaaaagaccaaaaacaacgactgggactacgtcgtgaccactgatatcagcgagatgggggccaattttcgtgcagacagagttattgatcctcggaggtgcctcaagcccgtgatcctgaaagacggaccagaacgcgtcattcttgctggtccgatgcctgtgacagtagcctcggcagcccagcgaagaggccggatagggaggaaccacaataaggagggagatcagtatatctacatgggccagcccctaaacaatgacgaggatcatgctcactggaccgaagccaaaatgctgttggacaacattaatacaccagagggtatcatccccgcgttattcgaacctgagcgcgaaaagtctgcagccattgatggggagtatagactgaggggcgaggctcggaagacttttgtggaactcatgcgtcgcggagacctgccagtttggctttcctacaaagtcgccagcgagggcttccaatattcagatcgaagatggtgctttgacggggaaaggaacaatcaggtgctggaggaaaacatggatgtggagatatggacgaaggagggagaacggaaaaagctccgccccagatggttggacgctaggacctacagtgaccctctggcactacgggagttcaaagaatttgccgctggtcgaagatctgtctccagcgatctgatcctcgagattggcaaacttccgcagcacctgacacagcgcgcccaaaatgcattagacaacttggttatgctgcataattcagaacaagggggaagggcgtatcggcacgccatggaggagctcccagatactatcgaaaccctgatgcttctggctctcattgccgtgttgacaggcggtgtaaccctgttctttttaagtgggcgtggcctaggaaaaactagcatcggcctgctctgtgtgatggcatcctctgtccttctgtggatggctagcgtggagccccattggatagccgcatccatcattttggagttctttctgatggttctcctgatccctgagcccgacagacagaggacgccacaggataaccaacttgcctacgtggtcattgggctcctgttcatgatcttgaccgtagctgcgaatgagatgggactgttagaaacaactaagaaggacctaggtataggccacgtggccgttgagaaccaccatcacgcagctatgctggatgtggacctccatcctgcctcagcctggaccctttacgcagtcgctacaaccattatcactcccatgatgcgccacacaattgaaaacacgaccgccaatatctctctgactgcgatagctaaccaggccgcaatcttgatggggctggataaaggatggccaattagtaagatggacatcggcgtgcctctcctggcccttggttgctattcgcaggtcaatccgttaacactgaccgctgcagtgctcatgttggttgcccattacgcgattatcgggcccggcctgcaagctaaagccacccgggaggcacagaagcgaacagccgctggaataatgaaaaacccaactgtggatggcattgtagccatcgacctagatcctgtggtctatgacgcaaagtttgaaaagcagctggggcagatcatgctccttattctgtgtacgagccaaatcttgctgatgagaaccacatgggctctctgcgagtccataactctggccaccggacccttaacaaccctttgggagggctctccaggtaaattctggaatactacgattgcggtttcaatggccaacatcttcagggggagctacctggcaggagctggcctcgccttttccctaatgaagagtctgggtggcgggcgccggggaacaggcgcacagggggaaaccttgggagagaaatggaagagacagctgaatcagctctctaaaagcgagttcaacacttataagcgttcaggcattatggaggtggacaggtccgaagctaaggagggtcttaaacgcggggaaaccacaaagcacgccgtcagtcggggaactgccaaactgcgatggtttgtggaaagaaatttggtaaagcctgagggcaaagtgatcgatctgggttgtggcagagggggatggagctactattgcgcgggcctcaagaaggttaccgaagtgaaagggtacacaaagggaggccccggtcacgaggaaccgataccaatggctacgtacgggtggaacttagtcaaactgcattctggaaaggacgtgttctttatccctcccgagaaatgtgatacccttctgtgcgacattggcgagtcctcaccaaatcccactatcgaagagggccggacactacgcgtcctcaagatggtggaaccttggctgagagggaaccaattctgtattaaaatcttgaatccgtatatgcccagcgttgtagagaccctggagcagatgcagaggaagcacggaggtatgctcgtgcgaaacccactttcgagaaattctactcatgaaatgtactgggtcagttgcggcacagggaacattgtgtccgcagttaatatgaccagccgtatgctgttaaacagatttacgatggcccaccgcaagcctacctatgagagggatgtggacctgggagctggcacacggcacgtcgccgtggaacccgaggtagcaaacttggatatcataggtcagagaattgaaaatatcaaacatgagcacaagtcaacttggcattacgacgaggataacccttataaaacctgggcctaccacgggtcctatgaagtgaagccatctggaagcgctagttccatggttaatggcgtcgtgaaactcctgacaaagccctgggacgtgatccctatggtcactcaaattgcgatgaccgatacaaccccattcggccagcagcgcgtttttaaggagaaagtggacactaggacgcccaaggccaaacgagggacagcacaaataatggaagtaaccgctaagtggctatggggattccttagccggaacaaaaagccgagaatctgtactagggaggaatttacccgcaaggtgcgttctaatgccgcaattggtgccgtcttcgtggacgagaaccagtggaactcagctaaagaggccgttgaagatgagcggttttgggacctggtgcatagagaaagggagctccacaagcagggcaaatgcgcgacatgcgtctacaacatgatggggaagcgcgagaagaagctgggagagttcggcaaggcaaaaggtagtcgagccatctggtacatgtggttgggggctcggttcctggagtttgaagccctcggattcatgaatgaggatcactggttttccagagaaaacagcctttctggcgtggagggcgaggggctgcataagttaggatatattctgagggacatctcgaaaatacctggtggcaatatgtacgcagatgacacggctgggtgggatacccgcatcactgaagacgatttgcagaacgaggccagaattacagacatcatggaaccagagcacgctctcctggccaagtcaattttcaaactaacctatcaaaataaggtagttcgggtgcagaggcccgccaaaaatggaactgtcatggatgtgatcagccgtcgagaccagcgcggctccggtcaggtggggacatacggacttaatacctttacaaacatggaagcgcaactgataagacagatggagagtgagggcattttctctcctagcgaactcgagactccaaacctggccgaacgggtcttggattggttagagaagtatggcgttgaaaggctgaagcgcatggctatctccggggacgactgtgtggtaaaacccatcgatgacagatttgccaccgcactcacggctcttaatgatatgggaaaggtgcggaaagacattccgcagtgggagccttcaaagggttggaacgattggcagcaagtccccttctgcagtcatcactttcaccagctgataatgaaagacggcagggagatcgtggttccatgtcgaaatcaggatgagctagtggggcgtgccagagtctctcagggagcaggctggagcctgcgcgagaccgcctgcctcggtaagtcctacgcgcaaatgtggcagttgatgtatttccatcggagggacctgagacttgctgccaacgcaatttgttcagccgtgcctgtagattggatccccacaagccgcactacctggtctattcacgctcatcaccagtggatgacaactgaagacatgctgtccgtttggaatcgggtgtggatcgaggaaaacccatggatggaggataagacccatataagtagctggggagacgtcccctacctcggaaaaagggaggaccaatggtgcggctcgttaatcggcctgacggcccgagcaacatgggctaccaatattcaggtggccatcaaccaggttagacggttgattgggaatgaaaactacctggattatatgacttccatgaagaggtttaaaaatgagtctgaccctgaaggagcgctctggtga

SEQ ID NO: 13746 - RNA, 9879 nt, synthetic construct
  misc_feature 1..9879: note = derived and/or modified CDS sequence (opt3) from DENV-1__FJ898383__SS-prME
  source 1..9879: mol_type = other RNA
agcgtgaccatgctgctcatgcttatgcccaccgcactggctttccacttgactacgcggggaggggaacctcatatgatcgtctccaagcaggaaaggggaaaatctttactgtttaagacctcagccggtgttaacatgtgcacactaattgccatggacctcggcgaactgtgtgaagatactatgacctacaaatgcccacggataacagaaaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaggacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaggcccctacaaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccgggtcgttcaaactggagaaggaagtcgccgagacgcagcacggtacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctataaacattgaagcagagccaccctttggcgagtcttatatcgtcatcggtgccggggaaaaagctctgaagctctcctggttcaagaaaggctcaagtattggaaagatgtttgaggccaccgcaagaggcgccaggcggatggctatcctgggggatacagcctgggacttcggaagcattggtggcgtgtttacgtccgttgggaaacttgtgcatcagatattcggaaccgcatacggcgtcctgttttctggtgtgagctggactatgaagatcgggattggcgtattgctcacatggctgggattaaattcacgaagtacctccctgagcatgacatgtatcgcggtgggcctagttactctctacctgggggtcatggtgcaggctgattctggatgcgtgatcaactggaaaggccgcgaacttaagtgtggttcagggattttcgtcaccaatgaggttcacacgtggacagaacaatataagtttcaggccgacagtccgaaaagattgagcgcagccataggaaaggcttgggaggagggcgtgtgcggtatcaggtccgccacccggctggaaaacattatgtggaaacagatctctaacgagctcaatcatattctgttagaaaacgacatgaagttcactgtggtagtcggcgatgtggcagggatcctggctcagggcaagaagatgatacgccctcaacccatggagtacaaatattcgtggaaaagctggggcaaggccaagatcattggggcggacgttcagaataccacatttatcattgatggaccaaacactcctgaatgtcccgacgatcagagagcctggaatatctgggaggtggaggactacggcttcggtatatttaccacaaacatttggcttaagttgagggattcctatacgcaggtctgcgaccaccgtctcatgtcagctgcaatcaaagatagtaaggccgtgcacgctgacatggggtactggattgaatctgagaaaaatgaaacctggaagctggcccgggcatccttcatcgaggttaagacttgtatatggccaaaatcccatacactatggtcaaacggagtgctggaaagcgagatgatcattcccaagatctatggcggtcctatttctcaacacaattaccgaccaggctacttcacccaggcggccgggccgtggcatctcggaaaactggagcttgattttgacttgtgcgaaggcactacagtagtcgtggatgagcactgcgggaacagaggaccctccctgaggaccacgactgtgaccggcaagatcatacacgaatggtgttgccgcagttgtacattacctccactccggttcagaggtgaggacgggtgctggtatggaatggagattaggcccgtcaaagaaaaggaggaaaatctggttaagagcatggtgtctgctggctccggtgaggtagactcatttagtcttggcctgttgtgtatcagcatcatgattgaagaggtgatgcgctcgcgatggtcccggcgtatgctcatgaccgggactctggccgtcttctttctactgatcatgggacagctcacatggaacgatctgattagactttgcataatggtgggcgcaaatgcttctgacaggatggggatgggaaccacatacttggccctgatggcaactttcaaaatgcgccctatgtttgccgttggcttactcttccggagactgaccagcagggaggtgcttctgctaacgatcggtctctcactggtcgctagtgtggaattgccaaactccctggaggaattaggggatggactcgcgatgggcattatgatcctgaaacttctgacagactttcaatctcatcagttgtgggccaccctcctgagcctaactttcattaaaaccacattttccctgcactatgcatggaagactatggctatggttctttcaatcgtgagcctcttccccctgtgtttgagtaccacgtctcagaaaacaacctggctgccggtcttactcggctccctggggtgcaagcctcttactatgtttctgatagccgagaataagatctggggacgacgcagctggccattgaacgaaggtattatggccgtaggcatcgtgtcgattctcctgtcatctctactgaaaaacgatgttccccttgctgggcctctcatcgcaggaggcatgctgatagcctgttacgtgattagtggttccagcgcggacttgtctttagagaaggctgccgaggtcagctgggaagaggaagcagagcattccggggcctcacacaatatcctggtggaagtacaggatgacggaacaatgaaaatcaaggatgaggagcgggacgataccctcactattctgcttaaagctacactgttggcagtgagtggcgtctatcccctaagcataccagccaccctgttcgtttggtacttctggcaaaagaaaaagcagagatctggcgtgctctgggacacgccttcacccccagaagtggagagggcggtcctggatgacgggatctatcgtattatgcagcgcggacttttaggtcggagccaggtgggcgttggggtatttcaagaaaacgtgttccatactatgtggcacgtcaccagaggagctgtgctgatgtaccagggcaagaggctcgagccgagttgggccagcgttaaaaaggacttgatctcctacggtgggggatggcgactgcagggctcttggaatacaggcgaggaagtgcaggtcattgcagtggagcctgggaaaaaccccaagaatgtacaaaccgccccaggaacatttaaaactcccgaaggtgaggtcggcgctatcgccctcgatttcaagcctgggacctcgggaagcccaatagtgaaccgggaaggcaagatcgttggtctgtatgggaatggagtggtcacgacatcaggcacttacgtgtccgcaattgctcaggccaaagcgagtcaggagggcccccttcctgagatcgaagacgaggtttttcgcaagagaaacctgaccattatggatttgcacccggggtctggaaaaacaaggcggtatctaccagccatcgtgcgagaagcaataaagagaaaactgcgcaccctcattttagctcccactagggtcgtggccagcgagatggctgaagcactgaagggtatgcctatccgttaccaaaccacagccgtaaagtccgagcatacgggcaaagagatcgtggaccttatgtgccacgccactttcaccatgcggctgctctcaccagttagagtccccaattataacatgattatcatggatgaagctcattttacagacccttctagcatagcggcaagggggtacattagtacccgcgtgggaatgggcgaggccgctgccatcttcatgactgcaacaccgcccggttccgtggaagcctttccacagagcaatgctgtcattcaggatgaggaacgagacatccctgagagatcttggaactcagggtatgagtggataaccgatttccccggaaagacggtatggtttgtgccatccattaaaagtggcaatgacatcgcgaactgtttgcggaagaatggcaaaagggttatccagctgagccgcaagactttcgatacagaataccaaaagaccaaaaacaacgactgggactacgtggtcaccactgatatttcggagatgggggccaatttccgtgcagacagagtgatcgatcctcggaggtgcctcaagcccgttattctgaaagacggaccagaacgcgtgatacttgctggtccgatgcctgtcacagtggcctctgcagcccagcgaagaggccggatcgggaggaaccacaataaggagggagatcagtatatttacatgggccagcccctaaacaatgacgaggatcatgctcactggaccgaagccaaaatgctgttggacaacatcaatacaccagagggtatcattcccgcgttatttgaacctgagcgcgaaaagtccgcagccatagatggggagtatagactgaggggcgaggctcggaagactttcgtagaactcatgcgtcgcggagacctgccagtgtggcttagctacaaagttgcctcagagggctttcaatatagtgatcgaagatggtgcttcgacggggaaaggaacaatcaggtcctggaggaaaacatggatgtggagatctggacgaaggagggagaacggaaaaagctccgccccagatggttggacgctaggacctactctgaccctctggcactacgggagtttaaagagttcgccgctggtcgaagatccgtgagcggcgatctgattctcgagatcgggaaacttccgcagcacctgacacagcgcgcccaaaatgcattagacaacttggtcatgctgcataattcagaacagggaggcagggcgtatcggcacgccatggaggagctcccagatactattgaaaccctgatgcttctggctctcatcgccgttttgacaggtggggtgaccctgtttttcttaagtggccgtggactaggcaaaactagcatagggctgctctgtgtaatggcatcctctgtgcttctgtggatggctagcgtcgagccccattggatcgccgcatccattatcttggaatttttcctgatggtgctcctgattcctgagcccgacagacagaggacgccacaggataaccaacttgcctacgttgtgatcggactcctgtttatgatattgaccgtcgctgcgaatgagatgggtctgttagaaacaactaagaaggacctaggcattgggcacgtagccgtggagaaccaccatcacgcagctatgctggatgttgacctccatcctgcctcagcctggaccctttacgcagtggctacaaccatcattactcccatgatgcgccacacaatcgaaaacacgaccgccaatatatctctgactgcgatcgctaaccaggccgcaattttgatgggactggataaaggctggccaatcagtaagatggacattggtgtccctctcctggcccttgggtgctatagccaggtgaatccgttaacactgaccgctgcagtcctcatgttggtggcccattacgcgatcataggccccggactgcaagctaaagccacccgggaggcacagaagcgaacagccgctggcattatgaaaaacccaactgttgatgggatcgtggccatcgacctagatcctgtagtgtatgacgcaaagttcgaaaagcagctgggacagattatgctccttatcctgtgtacgagccaaatattgctgatgagaaccacatgggctctctgcgagtccattactctggccaccggccccttaacaaccctttgggagggttctccagggaaattttggaatactacgatcgcggtctcaatggccaacattttcaggggaagctacctggcaggcgctggtctcgccttctccctaatgaagagtctgggcgggggacgccggggcacaggggcacagggagaaaccttgggcgagaaatggaagagacagctgaatcagctctctaaaagcgaatttaacacttataagcgttcaggtatcatggaggttgacaggtccgaagctaaggaggggcttaaacggggagagaccacaaagcacgccgtgagtcgcggcactgccaaactgcgatggttcgtcgaaagaaatttggtgaagcctgagggtaaagtaatagatctgggctgtgggaggggaggctggagctactattgcgcggggctcaagaaggtgaccgaagttaaaggatacacaaagggcggtcccgggcacgaggaaccgatcccaatggctacgtacggatggaacttagtgaaactgcattctggcaaggacgtctttttcattcctcccgagaaatgtgatacccttctgtgcgacatcggcgagtcctcaccaaatcccactattgaagaggggcggacactacgcgtgctcaagatggtcgaaccttggctgagaggaaaccaattttgtatcaaaattttgaatccgtatatgcccagcgtggttgagaccctggagcagatgcagaggaagcacggtggcatgctcgtacgaaacccactttcgagaaattctactcatgaaatgtactgggtgagttgcgggacaggaaacatcgtctccgcagtgaatatgaccagccgtatgctgttaaacagattcacgatggcccaccgcaagcctacctatgagagggatgttgacctgggcgctggtacacggcacgtggccgtcgaacccgaggtggcaaacttggatataattgggcagagaatcgaaaatatcaaacatgagcacaagtcaacttggcattacgacgaggataacccttataaaacctgggcctaccacggatcctatgaagtaaagccatctggcagcgctagttccatggtgaatggcgttgtcaaactcctgacaaagccctgggacgtgattcctatggtgactcaaatagcgatgaccgatacaaccccatttgggcagcagcgcgtcttcaaggagaaagttgacactaggacgcccaaggccaaacgaggaacagcacaaatcatggaagtgaccgctaagtggctatggggttttcttagccggaacaaaaagccgagaatttgtactagggaggagttcacccgcaaggtacgttctaatgccgcaatcggcgccgtgtttgtcgacgagaaccagtggaactcagctaaagaggccgtggaagatgagcggttctgggacctggttcatagagaaagggagctccacaagcaggggaaatgcgcgacatgcgtgtacaacatgatgggaaagcgcgagaagaagctgggcgagtttggtaaggcaaaagggagtcgagccatttggtacatgtggttgggagctcggttcctggagttcgaagccctcggctttatgaatgaggatcactggttctccagagaaaacagcctttctggcgtcgagggggagggactgcataagttaggttatatcctgagggacatatcgaaaatccctggcgggaatatgtacgcagatgacacggctggatgggatacccgcattactgaagacgatttgcagaacgaggccagaatcacagacattatggaaccagagcacgctctcctggccaagtcaatctttaaactaacctatcaaaataaggtggtacgggttcagaggcccgccaaaaatggcactgtgatggatgtcataagccgtcgagaccagcgcggttccggacaggtgggaacatacggccttaataccttcacaaacatggaagcgcaactgattagacagatggagagtgagggcatcttttctcctagcgaactcgagactccaaacctggccgaacgggtgttggattggttagagaagtatggggtcgaaaggctgaagcgcatggctatctccggagacgactgtgttgtgaaacccattgatgacagattcgccaccgcactcacggctcttaatgatatgggtaaggtacggaaagacataccgcagtgggagccttcaaagggctggaacgattggcagcaagtgcccttttgcagtcatcacttccaccagctgatcatgaaagacgggagggagattgtcgtgccatgtcgaaatcaggatgagctagttggacgtgccagagtgtctcagggcgcaggttggagcctgcgcgagaccgcctgcctcgggaagtcctacgcgcaaatgtggcagttgatgtattttcatcggagggacctgagacttgctgccaacgcaatctgttcagccgtccctgtggattggattcccacaagccgcactacctggtctatccacgctcatcaccagtggatgacaactgaagacatgctgtccgtatggaatcgggtttggatagaggaaaacccatggatggaggataagacccatatcagtagctggggagacgtgccctacctcggcaaaagggaggaccaatggtgcggctcgttaattgggctgacggcccgagcaacatgggctaccaatatccaggtcgccattaaccaggtgagacggttgatcggaaatgaaaactacctggattatatgacttccatgaagaggttcaaaaatgagtctgaccctgaaggtgcgctctggtga

SEQ ID NO: 13747 - RNA, 9879 nt, synthetic construct
  misc_feature 1..9879: note = derived and/or modified CDS sequence (opt3) from DENV-1__FJ898384__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagttctgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcaatcttcctcgcccatgctattggcacatcgatcacccagaagggcataatctttattctgctgatgctcgtgacgccatcaatggccatgcgctgcgtcgggatcggaagcagagatttcgtggagggtttaagtggcgcgacttgggtagacgttgtgctggagcacgggtcctgtgtcacaaccatggcaaaggataaacccactcttgacattgaattgctgaagacagaggtgaccaaccctgccgtgctaaggaaactctgcatcgaagctaagatatctaatacgaccacagatagccggtgtccaactcaaggagaggccaccctggtcgaagagcaggacgcaaactttgtttgccgccgaacattcgtggatagaggctggggtaatgggtgtggactttttggcaaaggctccctgattacttgcgctaagttcaagtgcgtaaccaaattggaggggaagatcgtgcagtacgaaaacctcaaatattcagtcattgtgacagttcacaccggagaccagcatcaagtgggtaatgagagtactgaacacggcacgacagccaccatcactccccaggcgcctagcaccgagatccagctgacagactacggggccttaaccctggattgttctccaaggactggactcgactttaacgaaatggtccttctgacaatgaaggagaaatcctggttggtgcataagcagtggttcctagatctgccgctcccctggacgtcaggcgcaagcaccagtcaagagacttggaatcggcaggacctgcttgtaacatttaaaaccgctcacgccaagaagcaggaagttgtggtcctgggttctcaagagggggctatgcacacagccttgactggcgcaaccgaaattcagacgtccggaaccacaactatattcgccggccatctcaaatgccgtctgaagatggataaattaaccctgaaggggatgagctatgtgatgtgtacaggatcgttcaaactagagaaggaagtcgctgagactcagcacggtaccgtgctcgttcagatcaagtacgagggcacggacgcgccttgcaaaattccattttctacacaagatgaaaagggggtgacccagaacggacgcctgatcactgcaaatcccatagtaacagacaaagagaagcctgtcaacattgaagccgagccacccttcggcgagtcctatatcgtgatcggtgctggggaaaaagcccttaagttgtcatggtttaagaaaggcagtagcattggaaagatgttcgaggcaaccgccagaggcgctaggcggatggccatcctgggggatactgcatgggactttggatccattggtggcgttttcacctctgtggggaaactcgtccatcagatatttggaacagcgtacggcgtgctgttcagcggtgtatcatggacgatgaagatcgggattggcgtgcttctgacctggttgggactcaatagtcgatccactagcctgtctatgacatgtatcgctgttggcttagtcaccctgtacctaggggtgatggtgcaggccgattcaggatgcgtcatcaactggaaaggccgcgaactcaagtgtggtagtgggatttttgttacaaatgaggtgcacacttggaccgaacaatataagttccaggcagacagcccgaaaagactgtccgccgctataggaaaggcctgggaggagggcgtgtgcggtatcaggtctgcaacgcggcttgaaaacattatgtggaaacagatctcgaacgagttgaatcatattctgctcgaaaacgacatgaagctgacagtagtcgtgggcgatgttgctgggatcttagcccagggaaaaaagatgatacgccctcaacccatggagtacaaatatagctggaagtcctggggcaaggcgaaaatcattggggccgacgtgcagaataccacttttatcattgatggaccaaacacccctgaatgtcccgacgatcagagagcttggaatatctgggaggtcgaggactacggcttcggtatatttacaactaacatttggctgaagcttagggattcatatacccaggtgtgcgaccaccgtttgatgagtgcagccatcaaagattctaaggctgttcacgccgacatggggtactggattgaaagcgagaaaaatgaaacatggaagctcgcacgggcgtccttcatcgaggtgaagacgtgtatatggccaaaatcacataccctgtggagcaacggagtactagaatctgagatgatcattcccaagatctatggcggtcctatttcccaacacaattaccgaccaggctacttcactcagacagccgggccgtggcatctgggaaaactcgagctggattttgacctttgcgaaggcaccactgtcgtggtggatgagcactgcgggaacagaggacccagtttgaggacaaccacggtcactggcaagatcatacacgaatggtgttgccgcagctgtaccctgcctccattacggttcaaaggtgaggacgggtgctggtatggaatggagattagacccgttaaggaaaaggaggaaaatctcgtgaaatctatggtatccgctggctcaggtgaggtggacagttttagcctgggccttctgtgtatctcgatcatgattgaagaggtcatgaggtcccgctggtctcgaaagatgttgatgacagggaccctcgccgtgttctttctgctaatcatgggacagctgacttggaacgatctcattcggctgtgcataatggttggcgcaaatgctagcgaccgtatggggatgggaacaacctaccttgccttgatggcaacattcaaaatgagacctatgtttgccgtgggcctgttattcaggcgcctcacttcacgggaggtcctgcttctgaccatcggtctaagtctcgtggcttccgttgaactgccaaactctttggaggaactgggggatggattagcgatgggcattatgatcctcaagctgcttacggactttcaaagccatcagctgtgggccacattgctctccctgaccttcattagaactaccttttcactacactatgcatggaaaacaatggctatggtgctgagcatcgtcagtcttttccccctctgtctgtctactacctcccagaagacgacatggttgccggtactgttaggcagcctcgggtgcaagcctctgaccatgtttcttatagccgagaataaaatctggggaaggaagtcgtggccactgaacgaaggtattatggccgtgggcatcgtttcaattttgctctctagtctgctaaaaaacgatgtgcccctggctgggcctcttatcgcaggaggcatgctcatagcctgttacgtcatttccggtagctctgcggacctgagcttggagaaggctgccgaggtgtcctgggaagaggaagcagagcattcaggggccagtcacaatatcttagtagaagtgcaggatgacggaactatgaaaatcaaggatgaggagcgagacgatacactgaccattctcctgaaagctactcttctggcagtcagcggcgtttatcccttgtctataccagccacactattcgtgtggtacttctggcaaaagaagaaacagcgctccggcgtgctgtgggacaccccttcacccccagaagtcgagcgggcggtgctcgatgacgggatctatagaattatgcagaggggactgcttggtcgtagtcaggttggcgtaggggtgtttcaagaaaacgtcttccatacgatgtggcacgtgactcgcggagctgttttaatgtaccagggcaagcggctggagccgagctgggcctccgtgaaaaaggacctcatctcttacggtgggggatggagattgcagggctcgtggaataccggcgaggaagtccaggtgattgcagtagagcctgggaaaaaccccaagaatgtccaaacagccccaggaacctttaagacaagcgaaggtgaggtgggcgctatcgccctggatttcaaacccgggacttcaggatcccctatagttaacagggaaggcaagatcgtgggtctctatgggaatggagtcgtgaccacgagtggcacatacgtttctgcaattgctcaggccaaagcgagccaggagggcccactgcccgagatcgaagacgaggtgtttcgaaagcggaaccttactattatggatctgcaccctgggtccggaaaaacccgcagatatttgccggccatcgtcagggaagcaataaagcggcgactaagaacactgattctcgctccaacccgcgtggtagcctcagagatggctgaagcattaaagggtatgcccatcaggtaccaaactaccgccgtgaaatctgagcatacaggcaaggagatcgttgacctgatgtgccacgccacgttcactatgcgtcttctgagccctgtccgggtgccaaattataacatgattatcatggatgaagctcattttaccgaccccagttccatagcggcaagagggtacattagcacaagggtgggaatgggcgaggccgctgccatcttcatgaccgcaactcctccgggttctgtcgaagcctttccccagtcaaatgctgtaattcaggatgaggaacgcgacatcccagagcgatcctggaacagtgggtatgagtggataacagatttccctggaaaaaccgtgtggtttgttcccagcattaagtcgggcaatgacatcgcgaactgtctcagaaaaaatggcaagcgggtgatccagttgtctaggaagacgttcgatactgaataccaaaaaacaaagaacaacgactgggactacgtcgtgaccaccgatatttccgagatgggggccaatttccgcgcagaccgtgttatcgatccaagacggtgcctgaaacctgtgattctcaaggacggacccgaaagggtcatactggctggtccaatgccggtgactgtagccagcgcagcccagcgccgaggcagaatcgggcggaaccacaataaagagggagatcagtatatttacatgggccagcctcttaacaatgacgaggatcatgctcactggacagaagccaagatgctactggacaacatcaatacccccgagggtatcattccagcgttgtttgaacccgagagggaaaagtcagcagccatagatggggagtatcgcttaagaggcgaggctaggaaaacattcgtggaactgatgcggcgtggagacctccctgtttggctgagttacaaggtcgcctctgagggctttcaatattccgatcgccgatggtgcttcgacggggaaagaaacaatcaggtgcttgaggaaaacatggatgtggagatctggactaaagagggagaaaggaagaaactgcggccacgctggctcgacgctagaacgtacagcgaccccttggcactgagggagtttaaggaattcgccgctggtcggcgatcagtcagtggcgatctaattctggagatcgggaaactccctcagcaccttacccagagagcccaaaatgcactggacaacttagttatgttgcataatagcgaacagggaggccgcgcgtataggcacgccatggaggagctgccggatacaattgaaactctcatgctgcttgctctgatcgccgtgctcaccggtggggtaacattgtttttcctgtccggccggggattaggcaagacctctatagggctactgtgtgtgatggcaagctccgtcctcctttggatggcttcagtggagccacattggatcgccgcatctattatcctggaatttttcttgatggttctgctcattcccgagcctgaccgtcagagaactccccaggataaccaactggcctacgtggtcatcggacttctctttatgatactgacggtagctgcgaatgagatgggtttgctggaaaccacaaagaaagacttaggcattgggcacgtggccgttgagaaccaccatcacgcagctatgctagatgtggacctgcatccagccagtgcctggactctctacgcagtcgctaccacaatcattacccctatgatgaggcacactatcgaaaacacaacggccaatatatcgcttaccgcgatcgctaaccaggccgcaattctgatgggattggataagggctggcccatcagcaaaatggacattggtgtgccactgctcgccctggggtgctattcccaggtcaatcctcttactttaacagctgcagtgctgatgctcgttgcccattacgcgatcataggcccgggattgcaagctaaggccacccgcgaggcacagaaacggaccgccgctggcattatgaagaaccccacagtggatgggatcgtagccatcgacctggatccagtggtctatgacgcaaagttcgaaaaacagctaggacagattatgctgctcatcctttgtacttctcaaatactgttgatgcgaacgacctgggctctgtgcgagtcaattacactcgccactggccctctgaccacattatgggagggtagccccgggaagttttggaataccactatcgcggtttccatggccaacattttcagaggaagttaccttgcaggcgctggtctggccttctctctcatgaaaagcctaggcgggggaaggcgcggcacgggggcacagggagaaacactgggcgagaagtggaaacggcagttgaatcagctgtcaaagtccgaatttaacacctataagagaagtggtatcatggaggtggaccgtagcgaagctaaagaggggctcaagaggggagagactaccaaacacgccgtctctcggggcacagccaagcttcgctggttcgtggaacgaaatctggtaaaaccagagggtaaggtgatagatttgggctgtgggagaggaggctggtcctactattgcgcggggctgaagaaagttactgaagtgaagggatacaccaaaggcggtcctgggcacgaggaacccatcccgatggctacatacggatggaacctcgtcaagttacattcaggcaaagacgtgtttttcattccacctgagaagtgtgatacgctgctttgcgacatcggcgagagctcgcccaatccaaccattgaagaggggaggactctgcgggtcctaaaaatggtggaaccctggctccgcggaaaccaattttgtatcaagattctgaatccttatatgccgtctgttgtagagacattggagcagatgcagagaaagcacggtggcatgctggtgaggaaccccctcagtcgaaattccacccatgaaatgtactgggtcagctgcgggactggaaacatcgtgtcagcagttaatatgacatcccggatgcttctgaaccgtttcaccatggcccacagaaaaccaacgtatgagcgcgatgtggacttaggcgctggtaccaggcacgtcgccgtggaacctgaggtagcaaacctggatataattgggcagcggatcgaaaatatcaagcatgagcacaaatctacatggcattacgacgaggataacccctataagacttgggcctaccacggaagctatgaagtgaaacctagtggctccgctagctctatggttaatggcgtcgtgaagttgctcaccaagccatgggacgtgattcccatggtcacacaaatagcgatgactgataccacaccttttgggcagcagagagttttcaaagagaaggtggacacccgcactccaaaagccaagaggggaacggcacaaatcatggaagtaacagctaaatggctgtggggttttctatcacgaaacaagaagccccggatttgtaccagagaggaattcactaggaaagtgcgcagtaatgccgcaatcggcgccgtctttgtggacgagaaccagtggaattccgctaaggaggccgttgaagatgagcgtttctgggaccttgtgcatcgggaaagagagctgcacaaacaggggaagtgcgcgacctgcgtctacaacatgatgggaaaaagggaaaagaagctcggcgagtttggtaaagcaaaggggagccgcgccatttggtacatgtggctgggagctcgattcttggagttcgaagccctgggctttatgaatgaggatcactggttctctcgggaaaactcgctctcaggcgtggagggggagggacttcataaactgggttatatcttaagagacataagcaagatcccgggcgggaatatgtacgcagatgacacagctggatgggatacgaggattaccgaagacgatctgcagaacgaggccaaaatcactgacattatggaacctgagcacgctttgctcgccaagtccatctttaaactgacatatcaaaataaggtagttcgcgtgcagagaccagcaaagaacggcaccgtcatggatgtgataagtcggagggaccagcgtggttctgggcaggtgggaacttacggcctaaatacattcaccaacatggaagcgcaacttattcgacagatggagagcgagggcatcttttccccctcagaactggagacacctaacctcgccgggcgcgtcctggattggttggaaaaacatggagttgagagattaaagcggatggctatcagtggtgacgactgtgtggtaaaaccaattgatgacaggttcgccactgcactgaccgctctcaatgatatgggcaaggtgcgcaaagacataccccagtgggaaccgtctaaggggtggaacgattggcagcaagtccctttttgcagccaccacttccatcagcttatcatgaaggacggaagagagattgtggttccctgtcggaatcaggatgagctggtgggcagggcccgagtctcccagggtgcagggtggtcactacgtgaaacggcctgcctgggaaaaagctatgcgcaaatgtggcagctcatgtactttcacagacgcgacttgcggctggctgccaacgcaatctgttctgccgtgccagtagattgggttcctacctccaggacaacttggagtattcatgctcaccatcagtggatgaccacagaggacatgcttagcgtgtggaatagagtctggatcgaagagaacccctggatggaagataagactcacgtgtcgtcctggggcgacgttccatatctgggcaaacgcgaggaccaatggtgcgggtctctcataggattaaccgcccgggcaacgtgggctacaaatatccaggtggccattaaccaggtcaggcgactgttgggtaatgagaactacctggattacatgacctcaatgaagagattcaaaaatgaaagcgaccccgagggcgcgctctggtga

SEQ ID NO: 13748 - RNA, 9879 nt, synthetic construct
  misc_feature 1..9879: note = derived and/or modified CDS sequence (opt3) from DENV-1__FJ898385__SS-prME
  source 1..9879: mol_type = other RNA
agcgtgaccatgctgctcatgcttatgcccacagcactggctttccacttgactacgaggggaggggaacctcatatgatcgtcaccaagcaggaaaggggaaaatccttactgtttaagacatctgccggtgttaatatgtgcactctgattgccatggacctcggcgaactgtgtgaagataccatgacatacaaatgcccacggattaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggtagcttcaaactggagaaggaagtggctgagacccagcacggaacggtccttgtgcagataaagtacgagggcacagacgcgccttgcaaaatcccattctcgacccaagatgaaaagggggttactcagaacggacgcttgattacagcaaatcccatcgtgaccgacaaagagaagcctgtaaacatagaagccgagccaccctttggcgagtcttatattgtcatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtgtttacatccgttgggaaacttgtgcatcagattttcggaacggcgtacggcgtcctgttttctggtgtgagctggaccatgaagatagggatcggcgtattgctcacttggctgggattaaattcacgaagtacatccctgagcatgacctgtattgctgtgggcctagttacactctacctgggggtcatggtgcaggccgattctggatgcgtgatcaactggaaaggccgcgaacttaagtgtggttcagggatcttcgtcactaatgaggttcacacctggacggaacaatataagtttcaggcagacagtccgaaaagattgagcgccgctattggaaaggcctgggaggagggcgtgtgcggtataaggtccgcaacacggctggaaaacatcatgtggaaacagatttctaacgagctcaatcatatcctgttagaaaacgacatgaagttcaccgtggtagtcggcggggtggttggcattctggctcagggcaaaaagatgatccgccctcaacccatggagcacaaatactcgtggaaaagctgggggaaggccaagataatcggagcggatgtgcagaatactacctttattatcgacggcccaaacacacctgaatgtcccgatgaccagagagcctggaatatttgggaggtcgaggattatggtttcgggatctttactaccaacatatggcttaagttgagggactcctacacacaggtgtgcgatcaccgtctcatgtcagctgcaattaaagacagtaaggccgttcatgctgatatgggatattggatcgaatctgagaaaaatgaaacgtggaagctggcccgggcatccttcattgaggtgaagacctgtatctggccaaaatcccacactctatggtcaaacggcgtactggaaagcgagatgataatccccaagatttacggtggccctatctctcaacataattatcgaccagggtacttcacacagaccgcgggaccgtggcacctcggcaaactggagcttgactttgatttgtgcgaagggactacagtcgtggtggacgagcactgcggaaacagaggcccctccctgaggaccacgactgtcaccggtaagattatccatgaatggtgttgccgcagttgtacattacctccactccggttcaaaggggaggatggatgctggtacggcatggagataagacccgttaaggaaaaggaggaaaatctggtgaaaagcatggtatctgccggttccggcgaggtggactcatttagtcttgggctgttgtgtattagcatcatgatcgaagaggtcatgaggtcgcgctggtcccgaaagatgctcatgaccggaactctggctgtgttcctactgctcattatgggccagctgacatggaacgaccttatccggttgtgcattatggttggggccaatgcatctgatcgtatgggaatgggcaccacatatctggctttaatggccacttttaaaatgagacctatgttcgcagtgggtctcctgtttaggcgccttaccagccgggaggtcctgctactcacgatagggctgtcattggtggccagtgttgaactgccaaactccttagaggaactcggagacggcctggctatgggcatcatgattcttaagctgttgacagatttccaatctcaccagctctgggcgaccctgctaagcctgacttttatcaaaaccacactttccctccattacgcctggaagactatggcaatgattctgtcaatcgtgagcttgttccccctgtgtttaagtaccacgtctcagaagacaacctggctcccggtcctgcttgggtccctgggatgcaaacctttgactatgtttctcatagctgagaataagatctggggtagaaaaagctggccactgaacgaaggcattatggccgtaggggtggtttcgatcctactgtcatctcttctcaagaacgacgtgcccctggccggacctttgattgctggcggtatgttaatcgcatgttatgtcataagtgggtccagcgccgatctgtctctcgagaaagcggctgaggtgagctgggaagaggaagccgagcactccggagcatcacataatattctggtagaagtgcaggacgatggcacaatgaagatcaaagacgaggagagggatgacacccttactatcctgttgaaggccacactactggctgtcagtggcgtttaccccctcagcattccagcaaccctgttcgtgtggtatttttggcaaaagaaaaagcagcgatctggggtgctttgggatacgccttcacccccagaagtcgagcgcgccgtgttagacgatggaatataccggatcatgcagagaggtctgctcggcaggagccaggttggggtaggagtgttccaagaaaacgtcttccacactatgtggcacgtgacccgtggcgcggttttgatgtatcagggtaaacgcctggagccgagttgggctagcgtgaagaaagacctcatttcctacgggggaggctggcggctgcagggctcttggaatatgggggaggaagtccaggtgatcgccgtagagcctggaaagaaccccaagaatgtccaaacagcaccaggtacctttaaaacacccgaaggcgaggtgggggccattgctcttgacttcaagcctggaacttcgggcagcccaatcgttaacagagaaggtaaaatagtggggctgtacggaaatggcgtcgtgaccacgtcaggcacatatgtttccgccatcgcacaggctaaggccagtcaggaggggcccttgcctgagattgaagatgaggtgtttaggaaacgaaacctaactatcatggacctgcatccgggatctggtaagacccggcgctacctcccagcgattgtcagagaagccatcaagaggaaattacggacactgatacttgcacccacccgagtggtagctagcgagatggccgaagctctgaagggcatgcctattagatatcaaactaccgcagtgaaatccgagcacacagggaaggagatcgttgatctcatgtgccatgccacgttcactatgcgcttgctgtcaccagtcagggtgcccaattacaacatgatcattatggacgaagcccactttaccgatccttctagcatcgctgcgcgtggatatataagtacacgggtgggcatgggtgaggcagccgctattttcatgaccgccactccgcccgggtccgtcgaagcatttccacagagcaatgccgtaatccaggacgaggaaagagatattcctgagaggtcttggaactcaggatacgagtggatcacagacttccccggcaaaaccgtgtggtttgttccatccataaagagtggcaatgatattgctaactgtctccgcaagaatgggaaacgagtgatccagctgagcagaaagacgttcgacactgaatatcagaaaaccaagaacaacgattgggactacgtcgtgaccaccgacatctcggagatgggagcgaattttcgggccgatagggttattgaccctcgccgttgccttaaacccgtgatcctaaaggatggtccagaaagagtcattctggcaggcccgatgcctgtgactgtagcttctgccgcacagcggagggggcgcataggacgaaaccataataaggagggcgaccagtacatctatatgggtcagcccttgaacaatgatgaggaccacgcccactggacagaagctaaaatgttactggataacattaataccccagaggggatcatccccgccctcttcgaacctgagagagaaaagtccgcggcaattgacggcgagtaccggctgaggggagaggcccgcaaaacattcgtggaacttatgagaaggggcgatctgccagtttggctcagctataaggtcgcttcagaggggtttcaatacagtgaccggcgttggtgcttcgatggagaacgcaacaatcaggtgttggaggaaaacatggacgtggagatatggactaaagagggtgaacgaaagaaactgagacccaggtggctagatgcccggacgtattctgaccctctggctctccgcgagtttaaggagttcgcagccggcagaaggtccgtcagcggggaccttatcctggagattggaaagttaccgcagcatttgacccagcgggctcaaaatgccctggataacctcgttatgctgcacaattcagaacagggcggtcgagcatacagacatgcgatggaggagcttccagacacaatcgaaactctgatgctcttggccctgattgctgtgttaaccgggggcgtaacactatttttcctgagtggacgcggcctcgggaaaaccagcatcggacttctgtgtgtgatggcctcctctgtcttgctgtggatggcaagcgtggagccccactggatagctgcctccatcattctcgaatttttcctgatggttcttctcatccctgagcccgataggcagcggactccacaggacaaccaactggcatatgtggtcattggtttgctgtttatgatcttaacggtagccgctaatgagatgggcctactggaaaccacaaagaaagatctcgggataggacacgtggcggttgagaaccatcaccatgccactatgcttgacgtggatctgcaccctgcatcagcttggaccttgtacgccgtcgccacaaccattatcactcccatgatgcgtcatacaattgaaaacacgaccgcaaatatctctctgactgctatagccaaccaggcggctatcctcatgggcctggacaagggttggccaattagtaaaatggatatcggggtgcctcttttagccctgggctgctactcgcaggtcaatccgctcacattgaccgcagccgtgctgatgctagttgctcactatgcaattatcggacccggcctgcaagccaaggcgaccagagaggctcagaagaggacagccgcagggataatgaaaaacccaactgtggacggaattgtagccatcgatctcgaccctgtggtctacgatgctaagttcgaaaaacagcttggccagatcatgctgttgattctgtgtacgagccaaatcctcctgatgcgcaccacatgggccttatgcgagtccataactcttgcaaccggtcccctgacaaccctctgggaggggtctccaggaaagttttggaatactacgattgctgtttcaatggccaacatcttccggggcagctatctagcgggtgccggcctggcattttccttgatgaaaagtctagggggaggccgaagagggacaggagctcagggcgaaaccctcggtgagaagtggaagaggcagcttaatcagctgtctaaaagcgagttcaacatttacaagcgctcagggatcatggaggtggaccggtccgaagccaaagagggattgaagagaggcgagactacccgtcacgcagtcagtaggggtacagctaaactgcggtggttcgtggaacgcaatctcgtaaagcctgagggcaaggtgatagacttagggtgtggacgaggcgggtggagctattactgcgccggactgaaaaaggttactgaagtgaaaggctataccaagggtgggcccggacatgaggaaccgatcccaatggccacatacggctggaaccttgtcaaactgcactctggcaaggatgtgtttttcacgcctcccgagaaatgtgacaccctactctgcgatattggggagtcctcaccaaatcccactatcgaagagggaagaacactgagggtcttgaagatggtggaaccttggctgcggggtaaccaattttgtattaagatcctcaatccgtacatgcccagcgttgtagagacccttgagcagatgcagcgcaaacatggcgggatgctggtgagaaacccattatcgagaaattctactcacgaaatgtattgggtcagttgcggaacaggcaacattgtgtccgcggttaatatgaccagccgaatgctgttgaaccggttcacgatggctcaccgtaagcctacctacgagagagacgtggatctcggtgcagggacacgccatgtcgccgtggaacccgaggtagctaacctggacatcataggacagaggattgaaaatatcaaacacgagcataagtcaacttggcactatgatgaggacaacccttacaaaacctgggcctatcatggctcctacgaagtgaagccatctggcagcgcaagttccatggttaatggggtcgtgaagctacttacaaaaccctgggatgtgatccctatggtcactcaaattgccatgaccgacacaaccccatttggacagcagcgggttttcaaggagaaagtggatactagaacgcccaaggctaaacgcggtacagcgcaaataatggaagtaaccgccaggtggctgtggggctttctcagccgaaacaagaagccgcggatctgtactagagaggagttcaccaggaaagtgcgctctaatgcagctattggggccgtctttgtggacgagaaccagtggaactcagcaaaggaggccgttgaagacgagcgtttctgggatctggtgcagaaagaacgggagttgcacaagcagggaaaatgcgctacatgcgtctataacatgatgggcaagagagaaaagaaactgggtgagtttgggaaggccaaaggaagtagggcgatctggtacatgtggctcggcgcacgcttccttgagtttgaagccctgggcttcatgaatgaggaccactggttctcccgagaaaacagcttatctggggtggagggagagggtctgcataagttgggctacattctccgggatatctcgaaaatacctgggggaaatatgtatgctgacgatacggccggctgggacaccagaatcactgaagatgacctgcaaaacgaggcaaagattacagatatcatggaaccagagcacgctctacttgccacctcaatttttaaactgacttaccagaataaggtagttagggtgcagcgccccgctaagaacggtacagtcatggacgtgatcagcagacgggatcagagggggtccggacaagtgggcacctatggcctcaatacattcactaacatggaagcccagctgatacgtcagatggagagtgaggggatattttctcctagcgaattggagatcccaaacttagcagaacgagtcctggactggctcgagaaatacggagttgaacgccttaagagaatggcgatctccggtgatgactgtgtggtaaaacccattgacgatcggttcgccaccgctctgacggccctaaatgacatgggcaaggtgaggaaagatgtcccgcagtgggagccttcaaaggggtggaacgactggcaacaggtgcccttttgcagtcatcacttccaccagctgataatgaaggatggacgcgagatcgttgtgccatgtagaaatcaggacgaactcgtcggccgggcaagggtgtctcaaggtgctgggtggagcttgcgagagaccgcctgcctgggaaaatcctatgcacagatgtggcagcttatgtactttcatcgtagagatctgcgcctcgccgcgaacgctatttgttcagccgtacctgttgactgggtgcccacaagccggactacctggtctatccacgcacatcaccaatggatgacaactgaagatatgttatccgtctggaatagggtgtggattgaggaaaacccatggatggaggacaagacccatgttagtagctggggcgatgtgccctatctgggcaaaagagaggaccagtggtgcgggtcgttgatcggactgacggcccgcgctacatgggcctccaatatacaggtcgcaatcaaccaggtgcggaggctcattggtaatgaaaactaccttgactacatgacctctatgaagcgattcaaaaatgagggcgatcctgaaggggctctgtggtga

SEQ ID NO: 13749 - RNA, 9879 nt, synthetic construct
  misc_feature 1..9879: note = derived and/or modified CDS sequence (opt3) from DENV-1__GQ868608__SS-prME
  source 1..9879: mol_type = other RNA
agcgtgaccatgctgctcatgcttatgcccaccgcactggctttccacttgactacgagaggaggggagcctcatatgatcgtctccaagcaggaaaggggaaaatctttactgtttaagacctcagccggtgttaacatgtgcaccctgattgccatggacctcggcgagttctgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaggacgcaaactttgtttgccgccgaacattcgtggatagaggctggggtaatgggtgtggactgtttggcaaaggctccttgataacttgcgctaagttcaagtgcgtaaccaaactcgaggggaagacagtgcagtacgaaaacctgaaatattcagtcattgtgaccgttcacactggagaccagcatcaagtgggtaatgagagtacggaacacggcacaaccgccactatcacaccccaggcgcctagcacagagattcagttaaccgactacggggccctgactctcgattgttctccaaggacaggacttgactttaacgaaatggtcctgttgacgatgaaggagaaagcatggctagtgcataagcagtggttcctggatctcccgctgccctggacctccggcgcttcaactagccaagagacatggaatcggaaagaccttctggtaacctttaagacagcccacgctaagaaacaggaagttgtggtcttgggtagtcaggagggggccatgcacactgcactcaccggcgccacggaaatccaaacctctggaacaactaccatcttcgctggccatctgaagtgccgtttaaaaatggataagctgacactaaaagggatgtcctatgtgatgtgtactgggagcttcaagctcgagaaggaagtcgcggagacccagcacggtacggtgctggttcagattaaatacgagggcacagacgcaccttgcaagataccattttcgacccaggatgaaaaaggggtgactcaaaacggacgccttatcacagccaatcccattgtaaccgacaaggagaaacctgtcaacatcgaagctgagccacccttcggcgagtcttatatagtgattggtgccggggaaaaggcattgaagctgtcctggtttaaaaagggctcaagtatcggaaaaatgttcgaggccactgctagaggcgccaggcggatggcaatcctcggggataccgcgtgggactttggaagcattggtggcgttttcacatccgtggggaagctggtccatcagatctttggaacggcttacggcgtgcttttctctggtgtaagctggaccatgaaaattgggataggcgtgctgttgacttggctcggactaaattcacgaagtacatccttaagcatgacctgtatcgccgttggcctggtcacactatacctcggggtgatggtgcaggcagattctggatgcgtcattaactggaagggccgcgaactgaagtgtggttcagggatctttgttactaatgaggtgcacacctggacggaacagtataaattccaagccgacagtccgaagagacttagcgctgccatcggaaaagcatggaaggagggcgtgtgcggtattaggtccgctacacggttggagaacataatgtggaaacagatctctaacgaactgaatcatattctcctggagaacgacatgaagtttaccgtagtcgtgggcgatgttgccgggatcttagcgcagggcaagaagatgattcgccctcagcccatggaatacaagtattcgtggaaaagctggggcaaggccaaaatcataggggctgacgtgcaaaatgcaactttcatcattgatggaccaaacacccctgagtgtcccgacgatcagagagcctggaatatctgggaagtcgaggactacggctttggtattttcacaactaacatctggctgaaacttagggattcctatacccaggtgtgcgaccaccgtttgatgtcagctgccataaaagatagtaaggcagttcacgcggacatggggtactggattgagtctgaaaagaatgagacatggaaactcgcccgggctagcttcatcgaagtgaagacgtgtatttggccaaaatcccataccctgtggtcaaacggagtactagagagcgaaatgatcatacccaagatctatggcggtcctatttctcagcacaattaccgaccaggctactttactcaaacagccgggccgtggcatctgggaaaactcgagctggatttcgacctttgcgagggcaccactgtcgtggtggatgaacactgcgggaacagaggaccctccttgaggacaaccacggtcactggcaagatcattcacgagtggtgttgccgcagttgtaccctgcctccattacggtttaagggtgaagacgggtgctggtatggaatggagatcagacccgttaaagagaaggaagagaatctcgtgaaaagcatggtatctgcaggctccggtgaagtggactcattcagtctgggccttctgtgtataagcattatgatcgaggaagtcatgaggtcgcgctggtcccgaaagatgttgatgacagggaccctcgctgtgtttttcctgctaatcatgggacagctgacttggaacgatctcattcggctgtgcatcatggttggcgccaatgcatctgaccgtatggggatgggaacaacctaccttgccttgatggctacatttaaaatgagacctatgttcgcggtgggcctgttatttaggcgcctcactagccgggaggtcctgcttctgaccattggtctatcactcgtggccagtgttgagctgccaaactccttggaagaactgggggatggattagcaatgggcataatgatcctcaagctgcttacggacttccagtctcatcaactgtgggctacattgctcagcctgacctttattaagactaccttctccctacactatgcctggaaaacaatggccatggtgctgtcaatcgtcagcctttttcccctctgtctgagtactacctctcagaagacgacatggttgccggtactgttaggctccctcgggtgcaaacctctgaccatgttccttattgctgaaaataagatctggggaagaaaaagctggccactgaacgagggtataatggcagtgggcatcgtttcgattttgctctcatctctgctaaagaacgatgtgcccctggccgggcctcttatcgcgggaggcatgctcattgcttgttacgtcatcagtggttccagcgccgacctgtctttggaaaaagcagccgaggtgagctgggaggaagaggctgaacattccggggcatcacacaatatattagtagaggtgcaggatgacggaactatgaagattaaggatgaagagagggacgatatgctgacaatcctcctgaaagccacccttctggcggtcagtggcgtttatcccttgagcatcccagctactctattcgtgtggtacttttggcagaagaaaaagcaacgatctggcgtgctgtgggacacaccttcacccccagaggtcgaacgcgccgtgctcgatgacgggatttatcggataatgcagagaggactgcttggtaggagccaggttggcgtaggggtgttccaggagaacgtctttcataccatgtggcacgtgacgcgtggagcagttttaatgtaccaaggcaaacgcctggaaccgagttgggccagcgtgaagaaggacctcatctcctacggtgggggatggcggttgcagggctcttggaatactggcgaggaggtccaggtgattgctgtagaacctgggaaaaaccccaagaatgtccagaccgccccaggaacattcaaaacctcggagggtgaagtgggcgcaatcgctctggattttaagcccgggacaagcggatcacctattgttaacagagagggcaaaatcgtgggtctctatgggaatggagtcgtgactacctccggcacgtacgttagtgccatagcgcaagccaaggcatctcaggaaggcccactgcccgagatcgaggacgaagtgttcaggaagcgaaaccttacaattatggatctgcaccctgggagcggaaaaactcggcgctatttgccggctatcgtcagagaggccattaagaggaaactacggaccctgatcctcgctccaacacgagtggtagcatccgaaatggccgaggccttaaagggtatgcccataagataccagaccactgctgtgaaatcagaacataccggcaaggagattgttgacctgatgtgccacgcgacatttacgatgcgccttctgtctcctgtcagggtgccaaattataacatgatcatcatggatgaggcacatttcactgaccccagcagtattgccgctcgtgggtacatctccacccgggtgggaatgggcgaagccgcagccatatttatgacagctacccctccgggtagcgtcgaggcgttcccccaatctaatgccgtaattcaggatgaagagagagacatcccagaaaggtcatggaactccgggtatgagtggattactgattttcctggaaagacagtgtggttcgttcccagtatcaaaagcggcaatgacatagcaaactgtctccgcaagaatggcaaacgagtgattcagttgtcgagaaagaccttcgatacggagtaccagaaaactaagaacaacgactgggactacgtcgtgacaaccgatatctctgaaatgggggctaattttcgggccgacagggttatcgatccacgccgttgcctgaagcctgtgattctcaaagacggacccgagagagtcatcctggcaggtccaatgccggtgaccgtagcctccgctgcccaacggaggggccgcattgggcgaaaccacaataaggaaggagatcagtatatatacatgggccagcctcttaacaatgacgaggatcatgcgcactggactgaggcaaaaatgctactggacaacatcaatacacccgaaggtattatcccagccttgttcgagcccgaaagagaaaagtccgctgccatcgatggggaatatcggttaaggggcgaggctcgcaaaacctttgtggagctgatgagaaggggagacctccctgtttggctgtcatacaaggtcgcaagtgaaggcttccagtattctgatcggcgttggtgctttgacggggagcgcaacaatcaagtgcttgaagagaacatggatgtggaaatttggacaaaagagggagagcgaaagaagctgagaccaaggtggctcgacgcccggacttactccgaccccttggctctgcgcgagttcaaagagtttgccgcaggtagaaggagcgtctcaggcgatctaatactggaaatcgggaagctccctcagcaccttacgcagcgggcgcagaatgccctggacaacttagttatgttgcataatagtgagcaaggaggccgagcttatagacacgccatggaggaactgccggataccattgagacactcatgctgcttgcactgatcgctgtgctcactggtggggtaaccttgttctttctgagcggccgcggattaggcaaaacatccattgggctactgtgtgtgatggcctctagcgtcctcctttggatggcatccgtggaaccacattggatcgccgcttcaataatcctggagttctttttgatggttctgctcattcccgaacctgacaggcagcggacaccccaggataaccagctggcgtacgtggtcatcggacttctcttcatgattctgactgtagccgcaaatgagatgggtttgctggagacgaccaagaaagacttaggcatcgggcacgtggctgttgaaaaccaccatcacgccgccatgctagatgtggacctgcatccagcatctgcttggacactctacgccgtcgcgactaccataattacacctatgatgcgtcacaccatcgagaacactacagctaatattagtcttacggccatcgcaaaccaagccgctatactgatgggattggataagggctggcccatctcgaagatggacattggtgtgccactgctcgcactggggtgctatagccaggtcaatcctcttaccttaactgccgcggtgctgatgctcgttgctcattacgccatcattggcccgggattgcaggcaaaagccacaagagaagctcaaaagaggaccgccgcaggcatcatgaaaaaccccaccgtggatgggatagtagctattgacctggatccagtggtctatgacacaaagtttgagaaacagctaggacagatcatgctgctcatcctttgtacttcccagattctgttgatgcgcacgacctgggccctgtgcgaatctatcacactcgcgactggccctctgaccacattatgggagggttcacccgggaagttctggaataccactatagccgttagcatggcaaacattttccggggatcctaccttgctggcgccggtctggcatttagtctcatgaagtctctaggcgggggacgaagaggcacgggggctcaaggagagacactgggcgaaaaatggaagaggcagttgaatcagctgagcaaatcagagttcaacacctataagcgctccggtatcatggaagtggaccggagtgaggccaaagaagggctcaagagaggagagactaccaagcacgccgtcagccgtggcacagcgaaacttaggtggtttgtggagcggaatctggtaaagccagaaggtaaagtgattgatttgggctgtgggcgcggaggctggtcttactattgcgctgggctgaagaaagttactgaggtgaagggatacaccaaaggcggtcctgggcacgaggagcccatcccgatggcaacatacggatggaacctcgtcaagttacattccggcaaggacgtgttctttataccacctgaaaaatgtgatacgctgctttgcgacatcggcgagtcaagccccaatccaaccattgaggaagggcgaactctgagagtcctaaagatggtggagccctggctcaggggaaaccagttctgtatcaaaattctgaatccttatatgccgtcggttgtagaaacattggagcaaatgcagcggaagcacggtggcatgctggtgcgcaaccccctctctagaaatagtacccatgagatgtactgggtctcctgcgggactggaaacatcgtgagcgccgttaatatgacatcaaggatgcttctgaaccgatttaccatggctcaccggaaaccaacgtatgaacgtgatgtggacttaggcgccggtaccagacacgtcgcagtggagcctgaagtagccaacctggatattatcgggcagcgcatagagaatattaagcatgaacacaagtccacatggcattacgacgaggataacccctataaaacttgggcttaccacggatcttatgaggtgaagcctagcggcagtgcgtccagcatggttaatggcgtcgtgaaattgctcaccaagccatgggacgtgatccccatggtcacacagatcgccatgactgataccacacctttcgggcaacagagggtttttaaagaaaaggtggacacccggactccaaaggcaaaaagaggaacggctcagattatggaggtaacagccaagtggctgtggggtttcctatctcgcaacaaaaagcccaggatatgtacccgagaagagtttactcggaaagtgagatcaaatgcagccatcggcgctgtcttcgtggacgaaaaccaatggaatagtgccaaggaggcggttgaggatgaaaggttttgggaccttgtgcatcgcgagcgtgaactgcacaagcaggggaaatgcgcaacctgcgtctacaacatgatgggaaagcgggagaaaaagctcggcgagttcggtaaagccaaggggtccagagctatttggtacatgtggctgggagccaggttcttggagtttgaggcactgggcttcatgaatgaagatcactggtttagccgcgagaactctctctcgggcgtggaaggggagggacttcataaactgggttatatcttacgagacatttcaaagatcccgggcgggaatatgtacgctgatgacacagccggatgggatacgcggataaccgaggacgatctgcagaacgaagctaagatcactgacattatggagcctgaacacgccttgctcgcaaaaagcatcttcaagctgacatatcagaataaagtagttagagtgcaaaggccagcgaagaacggcaccgtcatggatgtgatttcccgcagagaccagcggggtagtggacaggtgggaacttacggcctaaatacatttaccaacatggaggcccagcttatcaggcaaatggaatctgagggcatattcagcccctccgagctggaaacacctaacctcgctgggcgtgtcctggattggttggagaaacatggagttgaacgattaaagcgcatggccatttcaggtgacgactgtgtggtaaagccaatcgatgacagatttgcaactgctctgaccgccctcaatgatatgggcaaagtgcggaaggacatcccccagtgggagccgagtaaagggtggaacgattggcagcaggtccctttctgctctcaccactttcatcaacttattatgaaggacggaagggaaatagtggttccctgtcgcaatcaggatgagctggtgggcagagcacgggtcagccagggtgccgggtggtccctaagggagacggcgtgcctgggaaaatcatatgctcagatgtggcaactcatgtacttccaccgacgtgacttgagactggccgcaaacgccatctgtagcgctgtgccagtagattgggttcctacctctcgcacaacttggtccattcatgcccaccatcagtggatgaccacagaagacatgcttagtgtgtggaatcgggtctggatcgaggaaaacccctggatggaggataagactcacattagctcgtggggcgacgtgccatatctgggcaagagggaagaccagtggtgcgggtccctcatcggattaaccgcaagagctacgtgggccacaaatatacaagttgcgatcaaccaggtgcgccggctgattggtaatgagaactacttggattacatgacctctatgaaaaggtttaagaatgagatcgaccccgaaggcgctctgtggtga

SEQ ID NO: 13750 - RNA, 9879 nt, synthetic construct
  misc_feature 1..9879: note = derived and/or modified CDS sequence (opt3) from DENV-1__GQ199774__SS-prME
  source 1..9879: mol_type = other RNA
agcgtgaccatgctgctcatgcttatgcccacagcactggctttccacttgactacgagaggaggggaacctcatatgatcgtctccaagcaggaaaggggaaaatctttactgtttaagacctcagccggtgttaacatgtgcacactaattgccatggacctcggagaactgtgtgaagatactatgacctacaaatgcccacggataacagaggtggaaccggacgatgtggactgttggtgcaataccactgatacatgggtgacctatgggacgtgtagtcagactggagagcaccgccgagacaagcgtagcgtcgcgcttgctccccatgtgggcctgggtttggagaccagagccgaaacatggatgtcctctgagggggcatggaaacagatccagaaggttgaaacttgggccctcaggcaccctggattcaccgtgattgctctgtttctggcacatgccatcggcacatcgattacccagaagggcatcatattcatcctcttaatgctggtcacgccatcaatggctatgcggtgcgtggggattggaagccgcgattttgtagagggtcttagtggcgccacttgggttgacgtggtcttggagcacgggtcctgtgtgacaaccatggcgaaagataagcccactctggacatcgaactactcaaaacagaggtgaccaaccctgcagtcctgagaaaactttgcattgaagccaaaatctctaatacgaccacagatagcagatgtccaactcaaggagaggctaccctggttgaagaacaagacgccaacttcgtgtgccggcgcacatttgtagatcgaggctggggtaatgggtgtggattgttcggcaagggctccctcataacttgcgcaaagtttaaatgcgtgaccaagctggaggggaaaattgtccagtacgaaaacttaaagtattcagtgatcgttacagtgcacaccggagaccagcatcaagtcggtaatgagagtactgaacacggcacgattgctacaatcacaccccaggcccctactagcgagatccagctgaccgactacggggcgctcacacttgattgttctccaagaaccggactggacttcaacgaaatggtgttgctaactatgaaagagaagtcctggctggtacataaacagtggtttctcgatctgccgcttccctggacatcaggcgccagcacgagtcaagagacctggaataggcaggacctgttggttactttcaagacagcacacgctaagaaacaggaagtggtcgtgctcggttctcaagagggggccatgcacaccgctctgacaggcgccactgaaattcagaccacgggaaccacaactatatttgcaggccatttaaagtgccggctgaaaatggataagctaaccctcaaagggatgtcctatgtcatgtgtacaggcagcttcaagctggagaaggaagtggccgagactcagcacggtaccgttcttgtgcagatcaaatacgagggcacggacgctccttgcaagattccattctcgacacaagatgaaaaaggggtaacccagaacggacgtttgatcactgcgaatcccatagtcacagacaaggagaaacctgtgaacattgaagcagagccaccctttggcgagtcttatatcgttatcggtgccggggaaaaggctctgaagctctcctggttcaaaaagggctcaagtattggaaaaatgtttgaggccaccgcacgcggcgccagaaggatggctatcctgggggatactgcctgggacttcggaagcattggtggcgtgtttacctccgtcgggaaacttgtgcatcagatattcggaacagcatacggcgtactgttttctggtgtgagctggacgatgaaaatcgggattggcgttttgctcacctggctgggattaaattcacggagtacttccctgagcatgacatgtatcgcggtcggcctaatcaccctctacctgggggtgatggtgcaggctgattctggatgcgtcattaactggaagggccgagaacttaagtgtggttcagggatattcgttacaaatgaggtgcacacttggaccgaacaatataaatttcaggccgacagtccgaagcgcttgagcgcagccatcggaaaggcttgggaggagggcgtgtgcggtattagatccgccacgaggctggaaaacatcatgtggcggcagatttctaacgagctcaatcatatcctgttagaaaacgacatgaagttcacagtagtcgtgggcgatgttgtggggatactggcacagggcaagaaaatggtccgccctcaacccatggagcacaaatactcgtggaaaagctggggcaaggctaagatcattggggccgacgtgcagaataccacttttatcattgatggaccaaacacccctgaatgtcccgacgatcagagagcgtggaatatctgggaggttgaggactatggcttcggtatatttacaactaacatttggcttaagttgagggattcctacacccaggtgtgcgaccaccgtctcatgtcagccgctatcaaagatagtaaggcagtacatgccgacatggggtattggattgaatctgagaaaaatgaaacatggaagctggctcgggccagcttcatcgaggtcaagacgtgtatatggccaaaatcccacaccctatggtcaaacggagtgctggaaagcgagatgatcattcccaagatctacggcggtcctatttctcaacataattatcgaccaggctacttcactcagacagcagggccgtggcacctcggaaaactggagcttgattttgacttgtgcgaaggcaccactgtggtcgttgatgagcactgcgggaacagaggaccctccctgaggacaaccacggtgactggcaagatcatacatgaatggtgttgccgcagttgtaccttacctccactccggttcaaaggtgaggacgggtgctggtacggaatggagattagacccgtaagggaaaaggaggaaaatctggtaaagagcatggtctctgcgggctccggtgaggtggactcatttagtcttggcctgttgtgtatcagcatcatgattgaagaggttatgcgctcgcgatggtcccggaaaatgctcatgacagggaccctggccgtgttctttctactgatcatgggacagctcacttggaacgatctgattcgttcttgcataatggtcggcgctaatgccagcgacagaatggggatgggaacaacctatcttgcattgatggctacattcaagatgaggcctatgtttgccgtgggcctgttattccgccggctcacttcaagagaggttctgcttctgaccatcggtctaagtctcgtggcatccgtcgaactgccaaactctttggaggaactgggggatggattagccatgggcattatgatcctcaaactgcttacggactttcaaagctaccagctgtgggctacattgctctccctgaccttcattaagactaccttttcactacactatgcgtggaaaacaatggccatggtactgagcatcgtgagtcttctccccctgtgtttgtctactacctcccagaagacgacatggctgccggttttactcggcagcctggggtgcaagcctcttaccatgttcctgatagcagagaataaaatctggggaaggaagtcgtggccattgaacgaaggtattatggctgtgggcatcgtctcaattctcctgtctagtctactgaaaaacgatgtgccccttgccgggcctctcatcgccggaggcatgctgatagcttgttacgtaatttccggtagctctgcagacttgagcttagagaaggccgcggaggtgtcctgggaagaggaagctgagcattcaggggccagtcacaatatcctggtcgaagttcaggatgacggaactatgaaaatcaaggatgaggagcgagacgatacactcaccattctgcttaaagcaactctgttggccgtgagcggcgtgtatcccctatctataccagctacactgtttgtctggtacttctggcaaaagaagaaacagcgctccggcgtgctctgggacaccccttcacccccagaagttgagcgggcagtactggatgacgggatctatagaattatgcagaggggacttttaggtcgtagtcaggtgggcgtcggggtgttccaagaaaacgtttttcatacgatgtggcacgtgactcgcggagccgtcctgatgtaccagggcaagcggctcgagccgagctgggcgtccgtgaaaaaggacttgatctcttacggtgggggatggagactgcagggctcgtggaataccggcgaggaagtacaggtcattgctgtggagcctgggaaaaaccccaagaatgttcaaacagccccaggaaccttcaagacacccgaaggtgaggtgggcgcaatcgccctcgattttaaacctgggactagcggatcaccaatagtcaacagggaaggcaagatcgtgggtctgtatgggaatggagttgtgaccacgtccggcacatacgtcagtgctattgcccaggcaaaggcttctcaggagggcccccttcctgagatcgaagacgaggtgttccgaaagcggaacctgactattatggatttgcacccggggagcggaaaaacccgcagatatctaccagccatcgtaagggaagcgataaagcggaagctgcgaacactcattttagcccccaccagagtggttgcatccgagatggctgaagccctgaaaggtatgcctatccgctaccaaactaccgctgtcaagtcagagcatacaggcagggagatcgtggaccttatgtgccacgcaacgtttactatgcgtctgctctctccagtgcgggtccccaattataacatgattatcatggatgaagcccatttcaccgaccctagcagtatagccgctagagggtacatttccacaagggtaggaatgggcgaggcggcagccatctttatgaccgctactccgcccggtagcgtggaagccttcccacagtctaatgcagttattcaggatgaggaacgcgacatccctgagcgatcatggaactccgggtatgagtggataacagattttcccggaaaaaccgtgtggttcgtcccaagtattaagagcggcaatgacatcgccaactgtttgaggaaaaatggcaagcgggtgatccagctgtcgaggaagacgtttgatactgaataccagaaaaccaagaacaacgactgggactacgttgtgaccaccgatatttctgagatgggggctaatttccgcgcggaccgtgtcatcgatcctagacggtgcctcaaacccgtgattctgaaggacggaccagaaagggtaatacttgccggtccgatgcctgtgactgttgcatccgctgcccagcgccgaggcagaatcgggcggaaccacaataaagagggagatcagtatatttacatgggccagcccctaaacaatgacgaggatcatgcacactggacagaagccaagatgctgttggacaacatcaataccccagagggtatcattcccgctttattcgaacctgagagggaaaagagcgccgcgatagatggggagtatcgcctgagaggcgaggcaaggaaaacatttgtcgaactcatgcggcgtggagacctgccagtgtggctttcatacaaggtggccagtgagggcttccaatattctgatcgccgatggtgctttgacggggaaagaaacaatcaggtcctggaggaaaacatggatgttgagatctggactaaagagggagaaaggaagaaactccggccccgctggttggacgctagaacgtactccgaccctctggccctaagggagttcaaggaatttgctgcaggtcggcgaagcgtgtcaggcgatctgattctcgagatcgggaaacttccgcagcacctgacccagagagcccaaaatgctttagacaacttggtaatgctgcataatagtgaacagggaggccgcgcctataggcacgcaatggaggagctcccagatacaattgaaactctgatgcttctggcgctcatcgccgtgttgaccggtggggtcacactgttctttttaagcggccggggactaggcaagacctccatagggctgctctgtgtgatggcttctagcgcccttctgtggatggcatccgttgagccccattggatcgctgcctcaattatcttggagttctttctgatggtgctcctgattcctgagcccgaccgtcagagaactccacaggataaccaacttgcatacgtcgtaatcggactcctgttcatgatattgacggtggccgctaatgagatgggtctgttagaaaccacaaagaaagacctaggcattgggcacgttgcggtggagaaccaccatcacgccactatgctggatgtcgacctccatcctgcatctgcttggaccctttacgccgtggccacaaccatcattactcccatgatgaggcacacaatcgaaaacacgaccgcaaatataagtctgactgctatcgccaaccaggcggctattttgatgggactggataagggctggccaatctcgaaaatggacattggtgtccctctcctggcccttgggtgctatagccaggtgaatccgttaacactgaccgcagccgttctcatgttggtggctcattacgcaatcataggccccggactgcaagccaaggcgacccgcgaggctcagaaacggacagccgcaggcattatgaagaacccaactgtagatgggatcgtggccatcgacctagatcctgtcgtttatgacgctaagtttgaaaaacagctgggacagattatgctccttatcctgtgtacgtcccaaatattgctgatgcgaaccacatgggccctctgcgagtctattactctggcaaccggccccttaacaaccctttgggagggttcaccagggaagttctggaatactacgatcgctgtgagcatggccaacatttttagaggatcctacctggcgggcgccggtctcgcattcagtctaatgaaatctctgggcgggggaaggcgcggcacaggggctcagggagaaaccttgggcgagaagtggaaacggcagctgaatcagctcagcaagtcagagttcaacacttataagagatccggtatcatggaggtcgaccgtagtgaagccaaagaggggcttaggcggggagagaccacaaagcacgcagtgagccgcggcactgctaaactgcgatggtttgtagaaagaaatttggtgaagcctgagggtaaagttatagatctgggctgtgggaggggaggctggtcttactattgcgccgggctcaagaaggtgaccgaagtcaaaggatacacaaagggcggtcccgggcacgaggaaccgatcccaatggccacgtacggatggaacttagtgaaactgcattccggcaaggacgtcttctttattcctcccgagaaatgtgatacccttctgtgcgacatcggcgagtcaagcccaaatcccactattgaagaggggcggacactacgcgtgctcaagatggttgaaccttggctgagaggaaaccaattctgtatcaaaattttgaatccgtatatgccctcggtagtggagaccctggagcacatgcagaggaagcatggtggcatgctcgtccgaaacccactttctcggaatagtactcacgaaatgtactgggtgtcctgcgggacaggaaacatcgttagcgcggtgaatatgacctcacgtatgctgttaaacagatttacgatggctcaccgcaagcctacctatgagagggatgtcgacctgggcgcaggtacacggcatgtggccgtagaacccgaggtggctaacttggatataattgggcagagaatcgaaaatatcaaacacgagcataagtccacttggcactacgacgaggataacccttataaaacctgggcctaccatggatcttatgaagttaagccaagcggcagtgcatccagcatggtcaatggcgtggtgaaactcctgacaaagccctgggacgtcattcctatggttactcagatagccatgaccgatacaaccccattcgggcaacagcgcgtgtttaaggagaaagtagacactaggacgcccaaggctaaacgaggaacagcgcagatcatggaagtgaccgcccggtggctatggggtttcctttctagaaacaagaaaccgaggatttgtactcgcgaggaatttacccgtaaggtccggtcaaatgcagctatcggcgccgtgttcgttgacgagaaccaatggaatagtgcaaaggaggccgtggaagatgagagattttgggacctggtccacagggaacgcgagctccacaaacaggggaagtgcgctacatgcgtgtacaacatgatgggaaaacgagaaaagaaactgggcgagttcggtaaggccaaggggtcccgggcgatttggtacatgtggttgggagcaagatttctggagttcgaagccctcggcttcatgaatgaggatcattggtttagcagggaaaactctctttcgggcgtagagggggagggactgcacaaattaggttatatcctgcgcgacatatcaaagatccctggcgggaatatgtacgctgatgacacggccggatgggataccagaattactgaagacgatttgcagaacgaggcaaaaatcacagacattatggaaccagagcatgctctcctggccaccagcatcttcaagctaacttatcagaataaagttgtgcgggtccaaaggcccgctaagaacggcacagtgatggatgtgatatcccgtcgagaccagcgcggtagtgggcaggtcggaacctacggccttaatacatttactaacatggaagcccagctgattagacaaatggagtctgagggcatcttcagcccttccgaactcgagaccccaaacctggcagaacgggttttggattggttagagaaatatggggtggaaaggctgaagcgcatggcgatctcaggagacgactgtgtagtgaagcccattgatgacagatttgccacggctctcaccgcccttaatgatatgggtaaagtccggaaggacataccgcagtgggagcctagtaaaggctggaacgattggcaacaggtgcccttctgctctcaccactttcatcaactgatcatgaaggacgggagggagattgttgtgccatgtcgaaatcaggatgagctagtcggacgtgcaagagtgagccagggcgctggttggtccctgcgcgagacagcctgcctcgggaaatcatacgcacagatgtggcaattgatgtatttccaccggagggacctgagacttgccgcgaacgctatctgtagcgccgtacctgttgattgggtgcccacttctcgcaccacatggtccattcatgcacaccatcagtggatgactaccgaagacatgctgagtgtctggaatcgggtgtggatcgaggaaaacccatggatggaggataagacgcacataagctcgtggggagacgttccctacctcggcaagagggaggaccagtggtgcggctccttaatcgggctgacagcccgagctacctgggccactaatattcaagtggcaatcaaccaggtcagacggttgattggaaatgaaaactacctggattatatgacatctatgaaaaggtttaagaatgagtcagaccctgaaggtgctctctggtga

SEQ ID NO: 13751 - RNA, 9879 nt, synthetic construct
  misc_feature 1..9879: note = derived and/or modified CDS sequence (opt3) from DENV-1__GQ199775__SS-prME
  source 1..9879: mol_type = other RNA
agcgtgaccatgctgctcatgcttatgcccacagcactggctttccacttgactacgagaggaggggaacctcatatgatcgtctccaagcaggaaaggggaaaatctttactgtttaagacctcagccggtgttaacatgtgcacactaattgccatggacctcggagaactgtgtgaagatactatgacctacaaatgcccacggataacagaggtggaaccggacgatgtggactgttggtgcaataccactgatacatgggtgacctatgggacgtgtagtcagactggagagcaccgccgagacaagcgtagcgtcgcgcttgctccccatgtgggcctgggtttggagaccagagccgaaacatggatgtcctctgagggggcatggaaacagatccagaaggttgaaacttgggccctcaggcaccctggattcaccgtgattgctctgtttctggcacatgccatcggcacatcgattacccagaagggcatcatattcatcctcttaatgctggtcacgccatcaatggctatgcggtgcgtggggattggaagccgcgattttgtagagggtcttagtggcgccacttgggttgacgtggtcttggagcacgggtcctgtgtgacaaccatggcgaaagataagcccactctggacatcgaactactcaaaacagaggtgaccaaccctgcagtcctgagaaaactttgcattgaagccaaaatctctaatacgaccacagatagcagatgtccaactcaaggagaggctaccctggttgaagaacaagacgccaacttcgtgtgccggcgcacatttgtagatcgaggctggggtaatgggtgtggattgttcggcaagggctccctcataacttgcgcaaagtttaaatgcgtgaccaagctggaggggaaaattgtccagtacgaaaacttaaagtattcagtgatcgttacagtgcacaccggagaccagcatcaagtcggtaatgagagtactgaacacggcacgattgctacaatcacaccccaggcccctactagcgagatccagctgaccgactacggggcgctcacacttgattgttctccaagaaccggactggacttcaacgaaatggtgttgctaactatgaaagagaagtcctggctggtacataaacagtggtttctcgatctgccgcttccctggacatcaggcgccagcacgagtcaagagacctggaataggcaggacctgttggttactttcaagacagcacacgctaagaaacaggaagtggtcgtgctcggttctcaagagggggccatgcacaccgctctgacaggcgccactgaaattcagaccacgggaaccacaactatatttgcaggccatttaaagtgccggctgaaaatggataagctaaccctcaaagggatgtcctatgtcatgtgtacaggcagcttcaagctggagaaggaagtggccgagactcagcacggtaccgttcttgtgcagatcaaatacgagggcacggacgctccttgcaagattccattctcgacacaagatgaaaaaggggtaacccagaacggacgtttgatcactgcgaatcccatagtcacagacaaggagaaacctgtgaacattgaagcagagccaccctttggcgagtcttatatcgttatcggtgccggggaaaaggctctgaagctctcctggttcaaaaagggctcaagtattggaaaaatgtttgaggccaccgcacgcggcgccagaaggatggctatcctgggggatactgcctgggacttcggaagcattggtggcgtgtttacctccgtcgggaaacttgtgcatcagatattcggaacagcatacggcgtactgttttctggtgtgagctggacgatgaaaatcgggattggcgttttgctcacctggctgggattaaattcacggagtacttccctgagcatgacatgtatcgcggtcggcctaatcaccctctacctgggggtgatggtgcaggctgattctggatgcgtcattaactggaagggccgagaacttaagtgtggttcagggatattcgttacaaatgaggtgcacacttggaccgaacaatataaatttcaggccgacagtccgaagcgcttgagcgcagccatcggaaaggcttgggaggagggcgtgtgcggtattagatccgccacgaggctggaaaacatcatgtggcggcagatttctaacgagctcaatcatatcctgttagaaaacgacatgaagttcacagtagtcgtgggcgatgttgtggggatactggcacagggcaagaaaatggtccgccctcaacccatggagcacaaatactcgtggaaaagctggggcaaggctaagatcattggggccgacgtgcagaataccacttttatcattgatggaccaaacacccctgaatgtcccgacgatcagagagcgtggaatatctgggaggttgaggactatggcttcggtatatttacaactaacatttggcttaagttgagggattcctacacccaggtgtgcgaccaccgtctcatgtcagccgctatcaaagatagtaaggcagtacatgccgacatggggtattggattgaatctgagaaaaatgaaacatggaagctggctcgggccagcttcatcgaggtcaagacgtgtatatggccaaaatcccacaccctatggtcaaacggagtgctggaaagcgagatgatcattcccaagatctacggcggtcctatttctcaacataattatcgaccaggctacttcactcagacagcagggccgtggcacctcggaaaactggagcttgattttgacttgtgcgaaggcaccactgtggtcgttgatgagcactgcgggaacagaggaccctccctgaggacaaccacggtgactggcaagatcatacatgaatggtgttgccgcagttgtaccttacctccactccggttcaaaggtgaggacgggtgctggtacggaatggagattagacccgtaagggaaaaggaggaaaatctggtaaagagcatggtctctgcgggctccggtgaggtggactcatttagtcttggcctgttgtgtatcagcatcatgattgaagaggttatgcgctcgcgatggtcccggaaaatgctcatgacagggaccctggccgtgttctttctactgatcatgggacagctcacttggaacgatctgattcgttcttgcataatggtcggcgctaatgccagcgacagaatggggatgggaacaacctatcttgcattgatggctacattcaagatgaggcctatgtttgccgtgggcctgttattccgccggctcacttcaagagaggttctgcttctgaccatcggtctaagtctcgtggcatccgtcgaactgccaaactctttggaggaactgggggatggattagccatgggcattatgatcctcaaactgcttacggactttcaaagctaccagctgtgggctacattgctctccctgaccttcattaagactaccttttcactacactatgcgtggaaaacaatggccatggtactgagcatcgtgagtcttctccccctgtgtttgtctactacctcccagaagacgacatggctgccggttttactcggcagcctggggtgcaagcctcttaccatgttcctgatagcagagaataaaatctggggaaggaagtcgtggccattgaacgaaggtattatggctgtgggcatcgtctcaattctcctgtctagtctactgaaaaacgatgtgccccttgccgggcctctcatcgccggaggcatgctgatagcttgttacgtaatttccggtagctctgcagacttgagcttagagaaggccgcggaggtgtcctgggaagaggaagctgagcattcaggggccagtcacaatatcctggtcgaagttcaggatgacggaactatgaaaatcaaggatgaggagcgagacgatacactcaccattctgcttaaagcaactctgttggccgtgagcggcgtgtatcccctatctataccagctacactgtttgtctggtacttctggcaaaagaagaaacagcgctccggcgtgctctgggacaccccttcacccccagaagttgagcgggcagtactggatgacgggatctatagaattatgcagaggggacttttaggtcgtagtcaggtgggcgtcggggtgttccaagaaaacgtttttcatacgatgtggcacgtgactcgcggagccgtcctgatgtaccagggcaagcggctcgagccgagctgggcgtccgtgaaaaaggacttgatctcttacggtgggggatggagactgcagggctcgtggaataccggcgaggaagtacaggtcattgctgtggagcctgggaaaaaccccaagaatgttcaaacagccccaggaaccttcaagacacccgaaggtgaggtgggcgcaatcgccctcgattttaaacctgggactagcggatcaccaatagtcaacagggaaggcaagatcgtgggtctgtatgggaatggagttgtgaccacgtccggcacatacgtcagtgctattgcccaggcaaaggcttctcaggagggcccccttcctgagatcgaagacgaggtgttccgaaagcggaacctgactattatggatttgcacccggggagcggaaaaacccgcagatatctaccagccatcgtaagggaagcgataaagcggaagctgcgaacactcattttagcccccaccagagtggttgcatccgagatggctgaagccctgaaaggtatgcctatccgctaccaaactaccgctgtcaagtcagagcatacaggcagggagatcgtggaccttatgtgccacgcaacgtttactatgcgtctgctctctccagtgcgggtccccaattataacatgattatcatggatgaagcccatttcaccgaccctagcagtatagccgctagagggtacatttccacaagggtaggaatgggcgaggcggcagccatctttatgaccgctactccgcccggtagcgtggaagccttcccacagtctaatgcagttattcaggatgaggaacgcgacatccctgagcgatcatggaactccgggtatgagtggataacagattttcccggaaaaaccgtgtggttcgtcccaagtattaagagcggcaatgacatcgccaactgtttgaggaaaaatggcaagcgggtgatccagctgtcgaggaagacgtttgatactgaataccagaaaaccaagaacaacgactgggactacgttgtgaccaccgatatttctgagatgggggctaatttccgcgcggaccgtgtcatcgatcctagacggtgcctcaaacccgtgattctgaaggacggaccagaaagggtaatacttgccggtccgatgcctgtgactgttgcatccgctgcccagcgccgaggcagaatcgggcggaaccacaataaagagggagatcagtatatttacatgggccagcccctaaacaatgacgaggatcatgcacactggacagaagccaagatgctgttggacaacatcaataccccagagggtatcattcccgctttattcgaacctgagagggaaaagagcgccgcgatagatggggagtatcgcctgagaggcgaggcaaggaaaacatttgtcgaactcatgcggcgtggagacctgccagtgtggctttcatacaaggtggccagtgagggcttccaatattctgatcgccgatggtgctttgacggggaaagaaacaatcaggtcctggaggaaaacatggatgttgagatctggactaaagagggagaaaggaagaaactccggccccgctggttggacgctagaacgtactccgaccctctggccctaagggagttcaaggaatttgctgcaggtcggcgaagcgtgtcaggcgatctgattctcgagatcgggaaacttccgcagcacctgacccagagagcccaaaatgctttagacaacttggtaatgctgcataatagtgaacagggaggccgcgcctataggcacgcaatggaggagctcccagatacaattgaaactctgatgcttctggcgctcatcgccgtgttgaccggtggggtcacactgttctttttaagcggccggggactaggcaagacctccatagggctgctctgtgtgatggcttctagcgcccttctgtggatggcatccgttgagccccattggatcgctgcctcaattatcttggagttctttctgatggtgctcctgattcctgagcccgaccgtcagagaactccacaggataaccaacttgcatacgtcgtaatcggactcctgttcatgatattgacggtggccgctaatgagatgggtctgttagaaaccacaaagaaagacctaggcattgggcacgttgcggtggagaaccaccatcacgccactatgctggatgtcgacctccatcctgcatctgcttggaccctttacgccgtggccacaaccatcattactcccatgatgaggcacacaatcgaaaacacgaccgcaaatataagtctgactgctatcgccaaccaggcggctattttgatgggactggataagggctggccaatctcgaaaatggacattggtgtccctctcctggcccttgggtgctatagccaggtgaatccgttaacactgaccgcagccgttctcatgttggtggctcattacgcaatcataggccccggactgcaagccaaggcgacccgcgaggctcagaaacggacagccgcaggcattatgaagaacccaactgtagatgggatcgtggccatcgacctagatcctgtcgtttatgacgctaagtttgaaaaacagctgggacagattatgctccttatcctgtgtacgtcccaaatattgctgatgcgaaccacatgggccctctgcgagtctattactctggcaaccggccccttaacaaccctttgggagggttcaccagggaagttctggaatactacgatcgctgtgagcatggccaacatttttagaggatcctacctggcgggcgccggtctcgcattcagtctaatgaaatctctgggcgggggaaggcgcggcacaggggctcagggagaaaccttgggcgagaagtggaaacggcagctgaatcagctcagcaagtcagagttcaacacttataagagatccggtatcatggaggtcgaccgtagtgaagccaaagaggggcttaggcggggagagaccacaaagcacgcagtgagccgcggcactgctaaactgcgatggtttgtagaaagaaatttggtgaagcctgagggtaaagttatagatctgggctgtgggaggggaggctggtcttactattgcgccgggctcaagaaggtgaccgaagtcaaaggatacacaaagggcggtcccgggcacgaggaaccgatcccaatggccacgtacggatggaacttagtgaaactgcattccggcaaggacgtcttctttattcctcccgagaaatgtgatacccttctgtgcgacatcggcgagtcaagcccaaatcccactattgaagaggggcggacactacgcgtgctcaagatggttgaaccttggctgagaggaaaccaattctgtatcaaaattttgaatccgtatatgccctcggtagtggagaccctggagcacatgcagaggaagcatggtggcatgctcgtccgaaacccactttctcggaatagtactcacgaaatgtactgggtgtcctgcgggacaggaaacatcgttagcgcggtgaatatgacctcacgtatgctgttaaacagatttacgatggctcaccgcaagcctacctatgagagggatgtcgacctgggcgcaggtacacggcatgtggccgtagaacccgaggtggctaacttggatataattgggcagagaatcgaaaatatcaaacacgagcataagtccacttggcactacgacgaggataacccttataaaacctgggcctaccatggatcttatgaagttaagccaagcggcagtgcatccagcatggtcaatggcgtggtgaaactcctgacaaagccctgggacgtcattcctatggttactcagatagccatgaccgatacaaccccattcgggcaacagcgcgtgtttaaggagaaagtagacactaggacgcccaaggctaaacgaggaacagcgcagatcatggaagtgaccgcccggtggctatggggtttcctttctagaaacaagaaaccgaggatttggactcgcgaggaagtcacccgtaaggtgcggtcaaatgcaggcatcggggctggagttggcgacgagaaccaatggaatagtgccaagaaaggtgtggaggatgaaagattttgggacctggtccacagggagcgcgaactccacaagcaggggaaatgtgcaacatgcgtgtacaacatgatgggaaagcgagagaaaaagctgggcgagttcggcaaggccaaagggtcccgggctatttggtacatgtggttgggagccagatttctggagttcgaggcgctcggttttatgaatgaagatcattggttcagcagggagaactctctttcgggcgtagaaggggagggactgcacaagttaggctatatcctgcgcgacatatcaaaaatccctggtgggaatatgtacgcagatgacacggccggatgggataccagaattactgaggacgatttgcagaacgaagctaagatcacagacattatggagccagaacatgccctcctggcaaccagcatcttcaaactaacttatcagaataaggttgtgcgggtccaaaggcccgctaaaaacggcacagtgatggatgtgatatcccgtcgagaccagcgcggcagtgggcaggtcggaacctacggtcttaatacatttactaacatggaggcccagctgattagacaaatggaatctgagggcatcttcagcccttccgagctcgaaaccccaaacctggctgagcgggttttggattggttagaaaagtatggggtggagaggctgaagcgcatggccatctcaggagacgactgcgtagtgaaacccattgatgacagatttgcaacggcgctcaccgcccttaatgatatgggcaaggtccggaaagacataccgcagtgggaacctagtaagggttggaacgattggcaacaggtgcccttctgttctcaccactttcatcaactgatcatgaaagacgggagggagattgttgtgccatgccgaaatcaggatgagctagtcggacgtgctagagtgagccagggcgccggctggtccctgcgcgaaacagcatgtctcgggaagtcatacgctcagatgtggcaattgatgtatttccaccggagggacctgagacttgccgcaaacgccatctgcagcgcggtacctgttgattgggtgcccacttctcgcaccacatggtccattcatgctcaccatcagtggatgactaccgaggacatgctgagtgtctggaatcgggtgtggatcgaagagaacccatggatggaagataagacgcacataagctcgtggggagacgttccctacctcggtaaaagggaggaccagtggtgtggctccttaatcgggctgacagcccgagcaacctgggccactaatattcaagtggctatcaaccaggtcagacggttgattggaaatgagaactacctggattatatgacatctatgaagaggtttaaaaatgaatcagaccctgagggcgccctctggtga

SEQ ID NO: 13752 - RNA, 9876 nt, synthetic construct
  misc_feature 1..9876: note = derived and/or modified CDS sequence (opt3) from DENV-1__FJ882546__SS-prME
  source 1..9876: mol_type = other RNA
agcgtgaccatgctgctcatgcttatgcccacagccctggctttccacttgactacgaggggaggggaacctcatatgatcgtctccaagcaggaaaggggaaaatctttactgtttaagacctcagccggtgttaacatgtgcacattgattgccatggacctcggcgagctgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccgtgctgaggaaactttgcattgaagctaagatctctaatacgaccacagatagccggtgtccaactcaaggagaggccaccctggtcgaagaacaggacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatgtgtactgggagcttcaaactggagaaggaagtcgctgagacccagcacggtacggtgcttgttcagataaagtacgagggcacagacgcgccttgcaaaatcccattctcgacccaagatgaaaagggggtgactcagaacggacgcttgattacagcaaatcccatcgtaaccgacaaagagaagcctgtcaacatagaagccgagccaccctttggcgagtcttatattgtgatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtttttacatccgtggggaaacttgtccatcagattttcggaacggcgtacggcgtgctgttttctggtgtaagctggaccatgaagatagggatcggcgtgttgctcacttggctgggattaaattcacgaagtacatccctgagcatgacctgtattgctgttggcctagtcacactctacctgggggtgatggtgcaggccgattctggatgcgtcatcaactggaaaggccgcgaacttaagtgtggttcagggatcttcgttactaatgaggtgcacacctggacggaacaatataagtttcaggcagacagtccgaaaagattgagcgccgctattggaaaggcctgggaggagggcgtgtgcggtataaggtccgcaacacggctggaaaacatcatgtggaaacagatttctaacgagctcaatcatatcctgttagaaaacgacatgaagctgaccgtagtcgtgggcgatgttgctgggattcttggacagggcaaaaagatgatccgccctcaacccatggagtacaaatattcgtggaaaagctgggggaaggccaagataatcggagcggacgcccagaatactaccttcattatcgatggcccaaacacacctgaatgtcccgacgatcagagagcttggaatatttgggaggtggaggactacggttttgggatcttcactaccaacatatggttgaagctcagggattcctatacacaggtctgcgaccaccgtctgatgtcagcagccattaaagatagtaaggctgtgcacgccgacatgggatactggatcgaatctgagaaaaatgaaacgtggaagctagcacgggcgagctttattgaggttaagacctgtatctggccaaaatcccatactctgtggtcaaacggcgtgctcgaaagcgagatgataatccccaagatttatggtggccctatctctcaacacaattaccgaccagggtacttcacacagaccgccggaccgtggcatctgggcaaacttgagttggatttcgacctgtgcgaagggactacagtagtcgtggatgagcactgcggaaacagaggcccctccttaaggaccacgactgtgaccggtaagattatccacgaatggtgttgccgcagttgtacactccctccactgcggtttagaggggaggacggatgctggtatggcatggagataaggcccgtcaaagaaaaggaggaaaatcttgttaagagcatggtgtctgctggttccggcgaggtagactcattcagtctggggttgctctgtattagcatcatgatcgaagaggtgatgcgctcgcgatggtcccggaaaatgctgatgaccggaactctagccgtctttttcctgctcattatgggccagctgacatggaacgatcttatccgtttgtgcattatggtgggggcaaatgcttctgacagaatgggaatgggcaccacatacctggccttaatggcaacttttaagatgaggcctatgttcgccgttggtctcctgtttcgccggcttaccagcagagaggtgctgctactcacgatagggctgtcattggtcgctagtgtggaactgccaaactccttagaggaactcggagatggcctggcgatgggcatcatgattcttaaactgttgacagacttccaatctcatcagctctgggccaccctgctaagcctgacttttatcaagaccacattctcccttcactatgcatggaaaactatggctatggttctctcaattgtgagcctgtttcccttgtgtctgagtaccacgtctcagaagacaacctggttaccggtcctcctggggtcccttggatgcaagcctctgactatgttcttgatcgccgagaataaaatatggggtaggaagtcctggccactcaacgaaggcatcatggccgtagggattgtgtcgatcctgctatcatctctgcttaaaaacgatgttcccctcgctggacctctgattgcaggcggtatgttgatcgcctgttacgtgataagtgggtccagcgcggacttatctctggagaaggctgccgaggtcagctgggaagaggaagcagagcattccggagcctcacacaatattctcgtggaagtacaggatgacggcacaatgaaaatcaaggatgaggagcgagacgataccctgactatccttctgaaagctacattgctagcagtgagtggcgtctatcccctgagcattccagccaccctctttgtttggtacttctggcaaaagaagaaacagcgctctggggtgctgtgggacacgccttcacccccggaagtggagcgggcggtccttgatgacggaatatatagaatcatgcagaggggtttactgggccgtagccaggtgggggttggagtattccaagaaaacgtgtttcatactatgtggcacgtcacccgcggcgctgtgctcatgtaccagggtaagcggttggagccgagttgggccagcgttaaaaaggacctgatttcctacgggggaggctggagactcaggggctcttggaatacaggggaggaagtgcaggtcatcgcagtggagcctggcaagaatcccaagaatgtacagaccgccccaggtacattcaagactcccgaaggcgaggtcggggctattgccctggattttaaacctggaacctcgggcagcccaatcgtgaaccgagaaggtaagatagttgggctttatggaaatggcgtggtcacgacatcaggcacttacgtgtccgcaatcgctcaagccaaagcgagtcaggaggggcccctgcctgagattgaagacgaggttttccggaagcgcaacttgaccatcatggatctacacccgggatctggtaaaacaagaaggtatctgccagccattgtgcgggaagcaatcaagcgaaagctcagaaccttaatactggctcccactcgcgtcgtggccagcgagatggctgaagcacttaaaggcatgcctattaggtaccagaccacagccgtaaagtccgagcatacggggaaagagatcgtggacctgatgtgccacgccacttttaccatgcgtctcttgtcaccagttcgggtccccaattataacatgatcattatggatgaagctcatttcacagacccttctagcatcgcggcaagaggatacataagtaccagggtgggcatgggtgaggccgctgccatttttatgactgcaacaccgcccgggtccgtggaagccttcccacaaagcaatgctgtcatccaggatgaggaacgcgacattcctgagcgatcttggaactcaggatatgagtggatcaccgattttcccggcaagacggtatggttcgtgccatccataaaaagtggcaatgacattgcgaactgtctgagaaagaatgggaagcgggttatccagctcagcaggaaaacttttgatacagaataccagaagaccaaaaacaacgactgggactacgtggtcaccactgatatctcggagatgggagccaatttccgcgcagaccgtgtgattgatcctagacggtgcctgaagcccgttatccttaaagacggtccagaaagggtgattctagctggcccgatgcctgtcacagtggcctctgcagcccaacgccgagggagaataggacggaaccacaataaggagggcgatcagtatatctacatgggtcagcccctgaacaatgacgaggatcatgctcactggaccgaagccaagatgttgttagacaacattaatacaccagaggggatcatccccgcgctgttcgaacctgagagggaaaaatccgcagccgtagatggcgagtatcgcctcagaggagaggctaggaagacttttgtggaactgatgcggcgtggcgaccttccagtttggctgagctacaaagtcgcctcagaggggttccagtatagtgatcgccgatggtgctttgacggagaaagaaacaatcaagtgctcgaggaaaacatggatgtggagatttggacgaaggagggtgaaaggaaaaagttgcggccccgctggctggacgctagaacctactctgaccctctagcactgagggagttcaaagaatttgccgctggccggaagtccgtcagcggggatctcatacttgagatcggaaagctgccgcagcacttaacacagcgagcccagaatgcattggacaacctggttatgctccataattcagaacaaggcggtagagcgtatcgccacgccatggaggagctgccagatactattgaaacccttatgctgctcgctttgatcgccgtgctgacagggggcgtaaccttattctttctaagtggaaggggcctggggaaaactagcattggactcctttgtgtgatggcatcctctgtcctgttgtggatggctagcgtggagccccattggatcgccgcatccataatcctggagttctttctcatggttctgcttattcctgagcccgaccggcagcgtacgccacaggataaccagctcgcctacgtggtcatcggtctgttgttcatgattctgaccgtagctgcgaatgagatgggcttactagaaacaactaagaaagacctggggatcggacacgtggccgttgagaaccaccatcacgcagctatgctcgatgtggaccttcatcctgcctcagcctggaccctgtacgcagtcgctacaaccataattactcccatgatgagacacacaatcgaaaacacgaccgccaatatttctttgactgcgatcgctaaccaagccgcaatactgatgggcctcgataagggttggccaatcagtaaaatggacattggggtgcctctgcttgccttaggctgctattcgcaggtcaatccgctgacactcaccgctgcagtgttgatgctggttgcccattacgcgatcattggacccggcctacaggctaaggccaccagggaggcacaaaagcgcacagccgctgggatcatgaaaaacccaactgtggatggaatagtagccattgacctggatcctgtggtctatgacgcaaagtttgaaaaacagctcggccagatcatgcttctgatcttgtgtacgagccagattctgctcatgcggaccacatgggctctgtgcgagtccatcactttagccaccggtccccttacaaccctgtgggaggggtctccaggaaagttctggaatactacgatagcggtttcaatggccaacatttttcgaggcagctacctcgcaggagctggcctagccttctccctgatgaaaagtctagggggtggcagaagggggacaggagcacaaggcgaaaccctgggtgagaagtggaagcgccagctcaatcagctttctaaaagcgagttcaacacttataagcggtcagggatcatggaggtggacagatccgaagctaaagagggactgaagcgtggcgagaccacaaaacacgccgtcagtaggggtactgccaagttgcggtggtttgtggaacgcaatctggtaaagcctgagggcaaagtgattgatctcgggtgtggacgaggcgggtggagctactattgcgcgggattaaagaaagttaccgaagtgaagggctacacaaaaggtgggcccggacacgaggaaccgatcccaatggctacgtacggctggaacctggtcaaacttcattctggcaaagacgtgttctttatacctcccgagaagtgtgataccctgctatgcgacatcggggagtcctcaccaaatcccactattgaagagggaagaacactcagggtcctgaagatggtggaaccttggttgcggggtaaccagttctgtatcaaaattctgaatccgtatatgcccagcgttgtagagaccctcgagcaaatgcagcgcaagcacggcgggatgcttgtgagaaacccactgtcgagaaattctactcatgaaatgtactgggtcagttgcggaacaggcaacatcgtgtccgcagttaatatgaccagccgaatgttactgaaccggtttacgatggcccaccgtaaacctacctatgagagagatgtggacttgggtacagggactcgccacgtcgctgtggaacccgaggtagccaacctcgatattatcggacagaggatagaaaatattaagcatgagcacaaatcaacctggcattacgacgaggataacccttataagacatgggcataccacggctcctatgaagtgaagccatctggcagcgccagttccatggttaatggggtcgtgaaactgctaactaagccctgggacgtgatccctatggtcacccagatcgctatgacagagcttcatctgggacaacagcgggttttcaaagaaaaggtggataccagaactccacgcgcgaaaaggggtacggcccagattatggagatgacagcacgatggctctggggctttctgagccggaacaagatacccagaatctgtaccagggaagagttcactcgcaaggtacgttctaatgctgccattggggcagtgtttgtcgacgagaaccaatggaactcagccaaagaagctgtggaggacgaacggttctgggatttggttcacagagagagggaactgcacaagcagggaaaatgcgcaacctgcgtgtacaacatgatgggcaagcgcgagaaaaagctcggtgagtttgggaaggcgaaaggaagtcgagcaatctggtacatgtggcttggcgcccggttcctggaatttgaggctttaggcttcatgaatgaagaccattggttctccagagagaacagcctgtctggggtcgagggagaaggtttgcacaagctcggctatattctgagggatatctcgaaaataccagggggaaatatgtacgccgacgatacagcaggctgggacacgcgcatcaccgaggatgacctacagaacgaagctaagattactgatatcatggagcctgaacatgcccttctggctaaagccatttttaagctcacatatcagaataaagtggtaagagttcaacggccagcaaagaacggtaccgtgatggacgtcatctcaaggcgtgatcagcgagggagcggacaggtgggcacttacggcctgaatacattcaccaacatggaggcgcagttgatacgccaaatggagtccgaagagatttttagtccctctgaattagagacacctaacctggccgaaagagctctcgactggcttgagaagtatggggtggagcggctgaaaaggatggccatcagcggagatgactgtgtcgttaagccaatcgacgatcgcttcgcaactgctctaaccgccctgaatgacatgggtaaagtgagaaaggatattccccagtgggaaccgtccaaaggctggaacgactggcagcaggtacctttttgctcacaccacttccatcaactcataatgaaggatgggcgggagatcgtggtcccctgtaggaatcaggacgaattggtgggacgagcacgtgttagtcagggcgccggttggtctctgagagagacggcgtgccttggaaagagctacgctcagatgtggcaactgatgtattttcaccgccgggatctcaggttagccgcaaacgccatttgttccgctgtgccagtcgactgggtgcctacctcaagaacaacttggagcatccatgcccaccatcagtggatgaccacagaagatatgctgtctgtatggaatcgcgtttggattgaggagaacccctggatggaagacaaaactcacatctccagttgggaggatgtgccatacttgggaaagcgggaagaccagtggtgcggcagcctgataggcctcaccgcaagggctacgtgggccacaaatatccaagtcgcgattaaccaggtgcgaagacttatcgggaatgagaactacctggactatatgacctcgatgaaacggttcaagaatgagtccgatcccgaaggagctctatggtga

SEQ ID NO: 13753 - RNA, 9879 nt, synthetic construct
  misc_feature 1..9879: note = derived and/or modified CDS sequence (opt3) from DENV-1__KF921935__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagctgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgccccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagagcaggacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattaccccccaggcccctacaaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccggaagcttcaaactggagaaggaagtcgccgagacgcagcacggtacagtgcttgttcagataaagtacgagggcaccgacgctccttgcaaaatcccattcttgactcaagatgaaaagggggtgacacagaacggacgcctgattaccgcgaatcccatcgtaactgacaaagagaagcctgtcaacatagaagcagagccaccctttggcgagtcgtatattatcatcggtgccggggaaaaagctctcaagctgtcttggttcaagaaaggctcctcaattggaaagatgtttgaggccaccgcaagaggcgccaggcggatggctatccttggggatacagcctgggacttcggaagtattggtggcgtgtttacgagcgttgggaaactggtgcatcagatattcggaaccgcatacggcgtcttgttttccggtgtgtcttggactatgaagatcgggattggcgtactcctgacatggttaggactgaatagccgatcaaccagtctatccatgacatgtatcgcggtgggcctcgttactctgtaccttggggtcatggtgcaggctgatagcggatgcgtgatcaactggaaaggccgcgaattgaagtgtggttctgggattttcgtcaccaatgaggttcacacgtggacagaacaatataagtttcaggccgactcaccgaaaagactgagtgcagccataggaaaggcttgggaggagggcgtgtgcggtatcaggagcgccacccggctcgaaaacattatgtggaaacagatctccaacgagctgaatcatattttactggaaaacgacatgaagttcactgtggtagtcggcgatgtggcagggatccttgctcagggaaaagagatgatacgccctcaacccatggaatacaagtattcttggaaatcgtggggcaaggccaagatcattggggcggacgttcagaataccacatttatcattgatggaccaaacactcctgagtgtcccgacgatcagagagcctggaatatctgggaggtggaagactacggcttcggtatatttaccacaaacatttggttgaaactcagggatagccacacgcaggtctgcgaccaccgtctgatgtccgctgcaatcaaggattcaaaagccgtgcatgctgacatggggtattggattgagagtgaaaagaatgagacctggaaactagcccgggcatctttcatcgaagttaagacttgtatatggccaaagagccacacactgtggtccaacggagtgctcgagtcagagatgatcattcccaaaatctacggcggtcctattagccaacataattatcgaccaggctacttcacccagactgcggggccgtggcacctgggaaagcttgaattggattttgacctgtgcgagggcacaaccgtagtcgtggatgaacactgcgggaacagaggaccctctttaaggacgactaccgtgacaggcaaaatcatacatgagtggtgttgccgctcctgtaccctccctccactgcggttcagaggtgaggacgggtgctggtacggaatggaaattaggcccgtcaaggagaaagaagagaatcttgttaagagtatggtgagcgccggctctggtgaagtagactccttttcactgggcttgctctgtatcagtatcatgattgaggaggtgatgcgcagccgatggtcgcggaagatgctgatgactgggacactagctgtcttctttctgctcatcatgggacagctgacctggaacgatcttattcgtttgtgcataatggtgggcgccaatgcatccgacagaatggggatgggaacaacttatctggctttaatggccaccttcaaaatgaggcctatgtttgcagttggcctcctgttccgccggcttacgtctagagaagtgctgctactcacaatcggtctgagcttggtcgcctcagtggagctgccaaacagtttagaagagctcggggatggactggctatgggcattatgatccttaagctgttgaccgactttcaatcccaccagctctgggcgactctgctatctctgaccttcattaaaacaacttttagccttcattacgcctggaagaccatggcaatggttctctccatcgtgtcactgttccccttgtgtctgagcacgacaagtcagaaaaccacttggttaccggtcctcctgggctctcttgggtgcaagcctctgacaatgtttttgatagctgaaaataagatctggggaaggcgatcctggccactcaacgagggtattatggccgtaggcatcgtgagcattctgctatcgtcactgcttaaaaacgatgttcccctcgccgggcctctgatcgctggaggcatgttgatagcatgttatgtgatttctggtagttccgccgacttaagcctggagaaggcggctgaagtctcttgggaggaagaggccgaacacagcggggcatcccataatatcctcgtggaggtacaggatgacggaaccatgaaaatcaaggatgaggaacgcgacgatactctgacaattcttctgaaagccaccttgctagctgtgtcaggcgtctaccccctgagtataccagcaacgctcttcgtttggtatttctggcaaaagaaaaagcagcggagcggcgtgctgtgggacactccttctcccccagaggtggaaagagccgtccttgatgacgggatctacaggattatgcagcgtggattactgggtcgctcccaggtgggcgttggggtatttcaagagaacgtgttccacaccatgtggcacgtcacacggggagcggtgctcatgtatcagggcaagagattggagccgtcatgggctagtgttaaaaaggacctgatcagctacggtgggggatggaggctccagggctcctggaataccggcgaagaggtgcaggtcattgccgtggaacctgggaaaaaccccaagaatgtacaaacagcaccaggaacttttaaaacccccgagggtgaagtcggcgccatcgctctggatttcaagcctgggacgtctggatcgccaatagtgaaccgagagggcaagatcgttggtctttacgggaatggagtggtcacaactagcggcacctatgtgtcagccattgcacaggctaaagcctcccaggagggccccctgcctgaaatcgaggacgaagtttttcggaagcgcaacttgacaattatggatctacatccggggagtggaaaaaccagaaggtacctgccagcgatcgtgcgggaggccataaagcgaaaactcagaactttaattctggcacccacccgcgtcgtggcttctgaaatggccgaggctcttaagggtatgcctatcaggtatcaaacaacggcagtaaagagcgagcacactggcaaagaaatcgtggacctgatgtgccatgccaccttcacaatgcgtctcttgtccccagttcgggtccccaattacaacatgattatcatggatgaggcccactttaccgacccttcatctatagctgcgagagggtatattagcactagggtgggaatgggcgaagcagccgctatcttcatgacagccaccccgcccggtagtgtggaggcatttccacagtccaatgccgtcattcaggatgaagagcgcgacatccctgagcgaagctggaactctgggtacgaatggataacggatttccccggaaagactgtatggtttgtgccatcaattaaatccggcaatgacatcgctaactgtctgagaaagaatggcaaacgggttatccagctcagtaggaagacattcgataccgagtatcaaaagaccaaaaacaacgactgggactacgtggtcactacagatattagcgaaatgggggcgaatttccgcgccgaccgtgtgatcgatcctagacggtgcctgaagcccgttattcttaaagacggaccagagagggtgatactagcaggtccgatgcctgtcaccgtggcttcggccgcacagcgccgaggcagaatcgggcggaaccataataaggagggagatcagtacatttatatgggccagcccctgaacaatgacgaagatcacgcccactggacagaggctaaaatgttgttagacaacatcaatactccagaaggtatcattcccgccctgtttgagcctgaaagggagaagtctgcggcaatagatggggagtaccgcctcagaggcgaagccaggaagacgttcgtagagctgatgcggcgtggagaccttccagtgtggctgtcctataaagttgctagcgaaggctttcaatactcagatcgccgatggtgcttcgacggggagagaaacaatcaggtcctcgaagagaacatggatgtggagatctggaccaaggaaggagagaggaaaaagttgcggccccgctggctggacgccagaacatatagtgaccctctagctctgagggaatttaaagagttcgcagccggtcggcgatctgtgtccggcgatctcattcttgaaatcgggaagctgccgcagcatttaactcagagagctcaaaatgccttggacaacctggtcatgctccacaatagcgagcagggaggccgcgcatacaggcatgcgatggaggaactgccagataccattgagacacttatgctgctcgccttgatcgctgttctgaccggtggggtgactttatttttcctatcaggccggggactgggcaaaacgagtatagggctcctttgtgtaatggccagctccgtgctgttgtggatggcatctgtcgaaccccactggatcgctgccagcattatcctggagtttttcctcatggtgctgcttattcctgagcccgaccgtcagagaaccccacaggataaccaactcgcatatgttgtgatcggactgttgtttatgatactgacagtcgccgctaatgaaatgggtttactagagactaccaagaaggacctgggcattgggcacgtagcggtggaaaaccatcaccatgccgcaatgctcgatgttgaccttcaccctgcttccgcctggacactgtacgccgtggcaaccactatcattacacccatgatgaggcatacgatcgagaacaccactgctaatatatcattgacagccatcgcgaaccaggctgccattctgatgggactcgataaaggctggccaatctctaagatggacattggtgtccctctgcttgcattagggtgctacagtcaggtgaatccgctgaccctcaccgccgctgtcttgatgctggtggcacactatgccatcataggccccggactacaagcgaaagctacacgcgaagcccagaagcggactgcagccggcattatgaaaaacccaacggttgatgggatcgtggctatcgacctggatcctgtagtgtacgacgccaagttcgagaagcagctcggacagattatgcttctgatcttgtgtacctcgcaaatactgctcatgcgaacaacttgggcactgtgcgagagcattaccttagctacaggcccccttaccactctgtgggaaggttccccagggaaattttggaatacgacaatcgccgtctctatggcgaacattttcagaggatcatatctcgccggcgcaggtctagctttcagcctgatgaagtccttgggcgggggaaggcgcggcaccggggcccagggagagactctgggcgaaaaatggaagcggcagctcaatcagcttagtaaatctgagtttaacacctacaagagaagcggtatcatggaagttgaccgttcagaggcaaaggaggggctgaaaaggggagaaacaactaagcacgctgtgtcccggggcaccgccaaattgcgctggttcgtcgagcgaaatctggtgaagcctgaaggtaaagtaatagatctcggctgtgggagaggaggctggagttattactgcgccgggttaaagaaggtgacagaggttaaaggatatacgaagggcggtcccgggcatgaagagccgatcccaatggcgacctacggatggaacctggtgaaacttcacagcggcaaggacgtctttttcattcctcccgagaaatgtgatactctgctatgcgacatcggcgaatcttccccaaatcccacaattgaggaagggaggaccctccgggtgctgaagatggtcgagccttggttgcgcggaaaccaattttgtatcaaaattctgaatccgtacatgccctcagtggttgagactctcgaacagatgcagagaaagcatggtggcatgcttgtaaggaacccactgagccgaaattcgacacacgagatgtattgggtgtcttgcgggaccggaaacatcgtcagtgctgtgaatatgacgtcccggatgttactgaaccgtttcaccatggcacacagaaagcctacatacgaacgcgatgttgacttgggcgccggtactaggcatgtggctgtcgagcccgaaatagccaacctcgatattatcgggcagcggatcgagaatattaaacacgagcataagagcacctggcactatgacgaagataacccttacaaaacatgggcatatcatggatcatacgaggtgaagccatccggctctgccagcagtatggtaaatggcgtggttaaactgctaactaagccctgggacgtcatacctatggtgacccaaatcgctatgacagataccactccatttgggcagcagagagtgttcaaggaaaaagtcgacacgcgcacacccaaggcgaaaaggggaaccgcccaaattatggaggttactgcaaagtggctttggggttttctgtcccgaaacaaaaagccgcggatctgtaccagagaagagttcacaaggaaggtgcgcagcaatgctgccattggcgcagtatttgtggacgagaaccagtggaattctgccaaagaagctgtcgaggatgaacgtttctgggacctcgtgcaccgggagagagaactgcacaagcaggggaaatgcgccacgtgcgtttataacatgatgggaaagagggagaaaaagttgggcgagtttggtaaggcgaaagggtcacgcgcaatctggtacatgtggctgggagcccgattcctcgaattcgaggctcttggctttatgaatgaagatcattggttcagtcgggagaactccctgagcggcgtggagggggaaggattacacaagctgggttacatattgagagacatctctaaaattcctggcgggaatatgtatgccgatgacaccgcaggatgggatactaggatcacagaggacgatctccagaacgaagctcgcattaccgacatcatggagccagaacatgccctgctagctaagtcgatatttaaacttacttaccaaaataaggtcgtgagagtacagcggcccgccaaaaacggcacagttatggatgtgatttcaaggcgtgaccagcgaggtagcgggcaggtcggaacctatggcctgaatacattcactaacatggaggcacaactcatccgccagatggagtccgaaggcatctttagtccttctgagctggaaaccccaaacttggcggagagagtgttagattggctggaaaagtacggggtggagcggctcaagaggatggccattagcggagacgactgtgtcgttaaacccatagatgaccgcttcgctacggcccttaccgcactgaatgatatgggtaaggtgagaaaagacatcccgcagtgggagccttccaagggctggaacgattggcagcaagtacccttttgctcacaccacttccatcagctaattatgaaagacgggcgggaaatcgtggtcccatgtaggaatcaggatgagctggtgggacgagctcgtgttagtcagggcgccggttggtctctcagagaaacagcatgcttggggaagagctatgcccaaatgtggcagctgatgtactttcaccgccgggaccttaggctggcggctaacgccatttgttccgcagtgcctgtcgattggatccccacttcaagaaccacatggagcatacatgcccaccatcagtggatgactaccgaggacatgctctctgtgtggaatcgcgtatggatcgaagagaacccatggatggaggataagacgcacatttccagttggggagacgttccctatttaggcaaacgggaagaccaatggtgcggcagcctgatcgggttgacagctagggccacctgggcaactaatattcaggtggctatcaaccaggtccgaagactgattggaaatgagaactacctcgattacatgacatcgatgaagcggttcaaaaatgaaggtgaccctgagggcgccctttggtga

SEQ ID NO: 13754 - RNA, 9879 nt, synthetic construct
  misc_feature 1..9879: note = derived and/or modified CDS sequence (opt3) from DENV-1__GQ199776__SS-prME
  source 1..9879: mol_type = other RNA
agcgtgaccatgctgctcatgcttatgcccaccgccctggctttccacttgactacgcggggaggggaacctcatatgatcgtctccaagcaggaaaggggaaaatctttactgtttaagacctcagccggtgttaatatgtgcacgctaattgccatggacctcggcgaactgtgtgaagatactatgacctacaaatgcccacggataacagagaccgaaccggacgatgtggactgttggtgcaatgcgactgatacatgggtgacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaggacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaggcccctacaaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccggtagcttcaaactggagaaggaagtcgccgagacgcagcacggaacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattgtgatcggtgccggggaaaaagctctgaagctctcctggttcaagaaaggctcaagtatcggaaagatgtttgaggccaccgcaagaggcgccaggcggatggctattctgggggatacagcctgggacttcggaagcatcggtggcgtttttacgtccgtggggaaacttgtccatcagattttcggaaccgcatacggcgtgctgttttctggtgtaagctggactatgaagatagggatcggcgtgttgctcacatggctgggattaaattcacgaagtacctccctgagcatgacatgtattgcggttggcctagtcactctctacctgggggtgatggtgcaggctgattctggatgcgtcatcaactggaaaggccgcgaacttaagtgtggttcagggatcttcgttaccaatgaggtgcacacgtggacagaacaatataagtttcaggccgacagtccgaaaagattgagcgcagccattggaaaggcttgggaggagggcgtgtgcggtataaggtccgccacccggctggaaaacatcatgtggaaacagatttctaacgagctcaatcatatcctgttagaaaacgacatgaagttcactgtagtcgtgggcgatgttgcagggattctggctcagggcaagaagatgatccgccctcaacccatggagtacaaatattcgtggaaaagctggggcaaggccaagataatcggggcggacgtgcagaataccacatttattatcgatggaccaaacactcctgaatgtcccgacgatcagagagcctggaatatttgggaggtcgaggactacggcttcggtatctttaccacaaacatatggcttaagttgagggattcctatacacaggtgtgcgaccaccgtctcatgtcagctgcaattaaagatagtaaggccgttcacgctgacatggggtactggatcgaatctgagaaaaatgaaacctggaagctggcccgggcatccttcattgaggtgaagacttgtatctggccaaaatcccatacactatggtcaaacggagtactggaaagcgagatgataatccccaagatttatggcggtcctatctctcaacacaattaccgaccaggctacttcacccaggcggccgggccgtggcatctcggaaaactggagcttgattttgacttgtgcgaaggcactacagtcgtggtggatgagcactgcgggaacagaggaccctccctgaggaccacgactgtcaccggcaagattatccacgaatggtgttgccgcagttgtacattacctccactccggttcagaggtgaggacgggtgctggtatggaatggagataaggcccgttaaagaaaaggaggaaaatctggtaaagagcatggtatctgctggctccggtgaggtggactcatttagtcttggcctgttgtgtattagcatcatgatcgaagaggtcatgcgctcgcgatggtcccggcgtatgctcatgaccgggactctggccgtgttctttctactgattatgggacagctcacatggaacgatctgatcagactttgcattatggttggcgcaaatgcttctgacaggatggggatgggaaccacatacttggccctgatggcaactttcaaaatgcgccctatgtttgccgtgggcttactcttccggagactgaccagcagggaggtccttctgctaacgataggtctctcactggtggctagtgttgaattgccaaactccctggaggaattaggggatggactcgcgatgggcatcatgattctgaaacttctgacagactttcaatctcatcagttgtgggccaccctcctgagcctaactttcatcaaaaccacactgtcccttcactatgcatggaagactatggctatggtgctctcaattgtcagcctgtttcccttgtgtctgagtaccacgtctcagaaaacaacctggttaccggtactcctgggctcccttgggtgcaagcctctgactatgttcttgatcgccgagaataagatatggggacgacgcagctggccactcaacgaaggtatcatggccgtgggcattgtttcgatcctgctatcatctctgcttaaaaacgatgtgcccctcgctgggcctctgattgcaggaggcatgttgatcgcctgttacgtcataagtggttccagcgcggacttatctctggagaaggctgccgaggtgagctgggaagaggaagcagagcattccggggcctcacacaatattctcgtagaagtgcaggatgacggaacaatgaaaatcaaggatgaggagcgggacgataccctgactatccttctgaaagctacattgctagcagtcagtggcgtttatcccctgagcattccagccaccctctttgtgtggtacttctggcaaaagaaaaagcagagatctggcgtgctgtgggacacgccttcacccccagaagtcgagagggcggtgcttgatgacgggatatatcgtatcatgcagcgcggattactgggtcggagccaggttggcgtaggggtgttccaagaaaacgtctttcatactatgtggcacgtgaccagaggagctgttctcatgtaccagggcaagaggttggagccgagttgggccagcgtgaaaaaggacctgatttcctacggtgggggatggcgactccagggctcttggaatacaggcgaggaagtccaggtgatcgcagtagagcctgggaaaaaccccaagaatgtccaaaccgccccaggaacattcaaaactcccgaaggtgaggtgggcgctattgccctggattttaagcctgggacctcgggaagcccaatcgttaaccgggaaggcaagatagtgggtctttatgggaatggagtcgtgacgacatcaggcacttacgtttccgcaatcgctcaggccaaagcgagtcaggagggccccctgcctgagattgaagacgaggtgttccgcaagagaaacttgaccatcatggatctacacccggggtctggaaaaacaaggcggtatctgccagccattgtccgagaagcaatcaagagaaaactccgcaccttaatactggctcccactagggtggtagccagcgagatggctgaagcacttaagggtatgcctattcgttaccaaaccacagccgtgaagtccgagcatacgggcaaagagatcgttgacctgatgtgccacgccacttttaccatgcggctcttgtcaccagtcagagtgcccaattataacatgatcattatggatgaagctcatttcacagacccttctagcatcgcggcaagggggtacataagtacccgcgtgggaatgggcgaggccgctgccatttttatgactgcaacaccgcccggttccgtcgaagccttcccacagagcaatgctgtaatccaggatgaggaacgagacattcctgagagatcttggaactcagggtatgagtggatcaccgattttcccggaaagacggtgtggttcgttccatccataaaaagtggcaatgacattgcgaactgtctgcggaagaatggcaaaagggtgatccagctcagccgcaagacttttgatacagaataccaaaagaccaaaaacaacgactgggactacgtcgtgaccactgatatctcggagatgggggccaatttccgtgcagacagagttattgatcctcggaggtgcctgaagcccgtgatccttaaagacggaccagaacgcgtcattctagctggtccgatgcctgtgacagtagcctctgcagcccagcgaagaggccggatagggaggaaccacaataaggagggagatcagtatatctacatgggccagcccctgaacaatgacgaggatcatgctcactggaccgaagccaaaatgttgttagacaacattaatacaccagagggtatcatccccgcgctgttcgaacctgagcgcgaaaagtccgcagccattgatggggagtatagactcaggggcgaggctcggaagacttttgtggaactgatgcgtcgcggagaccttccagtttggctgagctacaaagtcgcctcagagggcttccaatatagtgatcgaagatggtgctttgacggggaaaggaacaatcaggtgctcgaggaaaacatggatgtggagatatggacgaaggagggagaacggaaaaagttgcgccccagatggctggacgctaggacctactctgaccctctagcactgcgggagttcaaagaatttgccgctggtcgaagatccgtcagcggcgatctcatccttgagattgggaagctgccgcagcacttaacacagcgcgcccaaaatgcattggacaacctggttatgctccataattcagaacagggaggcagggcgtatcggcacgccatggaggagctgccagatactatcgaaacccttatgctgctcgctttgattgccgtgctgacaggtggggtaaccttattctttctaagtggccgtggactgggcaaaactagcatcgggctcctttgtgtgatggcatcctctgtcctgttgtggatggctagcgtggagccccattggatagccgcatccatcattctggagttctttctcatggttctgcttatccctgagcccgacagacagaggacgccacaggataaccaactcgcctacgtggtcattggactgttgttcatgatcctgaccgtagctgcgaatgagatgggtttactagaaacaactaagaaggacctgggcatagggcacgtggccgttgagaaccaccatcacgcagctatgctcgatgtggaccttcatcctgcctcagcctggaccctgtacgcagtcgctacaaccattatcactcccatgatgcgccacacaattgaaaacacgaccgccaatatctctttgactgcgatagctaaccaggccgcaatcctgatgggactcgataaaggctggccaattagtaagatggacatcggtgtgcctctgcttgccttagggtgctattcgcaggtcaatccgctgacactcaccgctgcagtgttgatgctggttgcccattacgcgattatcggccccggactacaagctaaagccacccgggaggcacagaagcgaacagccgctggcataatgaaaaacccaactgtggatgggattgtagccatcgacctggatcctgtggtctatgacgcaaagtttgaaaagcagctcggacagatcatgcttctgattttgtgtacgagccaaatcctgctcatgagaaccacatgggctctgtgcgagtccataactttagccaccggcccccttacaaccctgtgggagggttctccagggaaattctggaatactacgattgcggtttcaatggccaacatctttaggggaagctacctcgcaggcgctggtctagccttctccctgatgaagagtttgggcgggggacgccggggcacaggggcacagggagaaaccctgggcgagaaatggaagagacagctcaatcagctttctaaaagcgagttcaacacttataagcgttcaggtattatggaggtggacaggtccgaagctaaggaggggctgaaacggggagagaccacaaagcacgccgtcagtcgcggcactgccaaattgcgatggtttgtggaaagaaatctggtaaagcctgagggtaaagtgatcgatctcggctgtgggaggggaggctggagctactattgcgcggggttaaagaaggttaccgaagtgaaaggatacacaaagggcggtcccgggcacgaggaaccgataccaatggctacgtacggatggaacctggtcaaacttcattctggcaaggacgtgttctttatccctcccgagaaatgtgataccctgctatgcgacattggcgagtcctcaccaaatcccactatcgaagaggggcggacactccgcgtcctgaagatggtggaaccttggttgagaggaaaccaattctgtattaaaatcctgaatccgtatatgcccagcgttgtagagaccctcgagcagatgcagaggaagcacggtggcatgcttgtgcgaaacccactgtcgagaaattctactcatgaaatgtactgggtcagttgcgggacaggaaacattgtgtccgcagttaatatgaccagccgtatgttactgaacagatttacgatggcccaccgcaagcctacctatgagagggatgtggacttgggcgctggtacacggcacgtcgtggtagaacccgaggtggccaacctcgatatcatagggcagagaattgaaaatatcaaacatgagcacaagtcaacttggcattacgacgaggataacccttataaaacctgggcataccacggatcctatgaagttaagccatctggcagcgccagttccatggtcaatggcgtggtgaaactgctaacaaagccctgggacgtcatccctatggttactcaaattgctatgaccgatacaaccccattcgggcagcagcgcgtgtttaaggagaaagtagacactaggacgcccaaggcgaaacgaggaacagcccaaataatggaagtgaccgcaaagtggctttggggtttcctgagccggaacaaaaagccgagaatctgtactagggaggaatttacccgcaaggtccgttctaatgctgccattggcgcagtgttcgttgacgagaaccagtggaactcagccaaagaggctgtggaagatgagcggttttgggacctcgtccatagagaaagggagctgcacaagcaggggaaatgcgccacatgcgtgtacaacatgatgggaaagcgcgagaaaaagttgggcgagttcggtaaggcgaaagggagtcgagcaatctggtacatgtggctgggagcccggtttctcgagttcgaagctcttggcttcatgaatgaggatcactggttttccagagaaaacagcctgtctggcgtagagggggagggattacataagctgggttatattttgagggacatctcgaaaatacctggcgggaatatgtacgccgatgacacggcaggatgggatacccgcatcactgaagacgatctccagaacgaggctagaattacagacatcatggaaccagagcacgccctgctagctaagtcaattttcaaacttacctatcaaaataaggttgtgcgggtccagaggcccgccaaaaacggcactgtgatggatgtgatcagccgtcgagaccagcgcggttccgggcaggtcggaacatacggcctgaatacctttacaaacatggaagcacaactcataagacagatggagagtgagggcattttctctcctagcgaactggagactccaaacttggcggaacgggttttagattggctggagaagtatggggtggaaaggctcaagcgcatggccatctccggagacgactgtgtagtgaaacccatcgatgacagatttgctaccgcccttacggcactgaatgatatgggtaaggtccggaaagacattccgcagtgggagccttcaaagggctggaacgattggcagcaagtgcccttctgcagtcatcactttcaccagctaataatgaaagacgggagggagatcgttgtgccatgtcgaaatcaggatgaactggtcggacgtgctagagtgtctcagggcgccggttggagcctccgcgagaccgcatgcttggggaagtcctacgcccaaatgtggcagctgatgtatttccatcggagggaccttagactggcggctaacgccatttgttcagcagtacctgttgattggatccccacaagccgcactacctggtctattcacgcccatcaccagtggatgacaactgaagacatgctctccgtgtggaatcgggtctggatcgaggaaaacccatggatggaggataagacccatataagtagctggggagacgtgccctacttaggcaaaagggaggaccaatggtgcggctcgctgatcgggttgacggctcgagccacatgggcaaccaatattcaggttgctatcaaccaggtgagacggctgattggaaatgaaaactacctcgattatatgacttccatgaagaggtttaaaaatgagtctgaccctgaaggtgccctttggtga

SEQ ID NO: 13755 - RNA, 9879 nt, synthetic construct
  misc_feature 1..9879: note = derived and/or modified CDS sequence (opt3) from DENV-1__GQ199777__SS-prME
  source 1..9879: mol_type = other RNA
agcgtgaccatgctgctcatgcttatgcccactgccctggctttccacttgactacgcggggaggggaacctcatatgatcgtctccaagcaggaaagggggaaatctttactgtttaagacctcagccggtgttaatatgtgcacgctaattgccatggacctcggcgaactgtgtgaagatactatgacctacaaatgcccacggataacagagaccgaaccggacgatgtggactgttggtgcaatgcgactgatacatgggtgacctatgggacgtgtagtcaaactggggagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgtgatcggcacctcgattacgcagaagggcatcatattcatcctcttaatgctggtcactccatcaatggccatgcgctgcgtggggattggaagcagagattttgtagagggtcttagtggcgctacatgggttgacgtggtcttggagcacgggtcctgtgtgaccactatggccaaggataaacccacactggacatcgaactactcaagaccgaggtgacgaaccctgcggtcctgaggaaactttgcattgaagcaaagatctctaataccacaactgatagccggtgtccaacccaaggagaggccacactggttgaagaacaggacgctaacttcgtgtgccgccgaacttttgtagatagaggctggggtaatgggtgtggattgttcggcaaaggctccctcataacctgcgccaagtttaagtgcgtgacaaaactggaggggaagattgtccagtacgaaaacttaaaatattcagtgatcgttaccgtgcacactggagaccagcatcaagtcggtaatgagagtacggaacacggcacaaccgcaactattacaccccaagctcctaccaccgagatccagctgactgactacggggccctcacacttgattgtagcccaaggacgggactggacttcaacgaaatggtgttgctaaccatgaaggagaaatcttggctggtacataagcagtggtttctcgatctgccgcttccctggacttccggcgcgtcaacaagccaagagacctggaatcggcaggacctgttggttacattcaaaactgcccacgcaaagaagcaggaagtggtcgtgctcggtagtcaagagggggctatgcacaccgccctgacgggcgctaccgaaatccagacatctggaactaccacaatttttgccggccatttaaaatgccgtctgaagatggataaactaactctcaaggggatgtcctatgtcatgtgtaccggactgttcaaacttgagaaggaagtggcagagacgcagcacggtacagttttggtgcagataaagtacgagggcaccgacgccccttgcaaaatcccattcagcactcaagatgaaaagggggtaacacagaacggacgcctgattaccgctaatcccatcgtcactgacaaagagaagcctgtgaacatagaagcggagccaccctttggcgagtcgtatattatcatcggtgcaggggaaaaagccctcaagctgtcttggttcaagaaaggctcctcaattggaaagatgtttgaggctaccgccagaggcgcaaggcggatggccatccttggggatacagcttgggacttcggaagtattggtggcgtttttacgagcgtggggaaactggtccatcagatattcggaaccgcctacggcgtgttgttttccggtgtatcttggactatgaagatcgggattggcgtgctcctgacatggttaggactgaatagccgatcaaccagtctatccatgacatgtatcgcagttggcctcgtcactctgtaccttggggtgatggtgcaggcggatagcggatgcgtcatcaactggaaaggccgcgaattgaagtgtggttctgggattttcgttaccaatgaggtgcacacgtggacagaacaatataagtttcaggctgactcaccgaaaagactgagtgccgcaataggaaaggcctgggaggagggcgtgtgcggtatcaggagcgctacccggctcgaaaacattatgtggaaacagatctccaacgagctgaatcatattttactggaaaacgacatgaagttcactgtagtcgtgggcgatgttgccgggatccttgcacagggcaaaaagatgatacgccctcaacccatggagtacaaatattcttggaagtcgtggggcaaggctaaaatcattggggccgacgtgcagaataccacatttatcattgatggaccaaacactcctgaatgtcccgacgatcagagagcgtggaatatctgggaggtcgaggactacggcttcggtatatttaccacaaacatttggttgaagctcagggatagctatacacaggtgtgcgaccaccgtctgatgtccgccgctatcaaagattcaaaggcagttcacgccgacatggggtactggattgaaagtgagaaaaatgaaacctggaagctagctcgggcctctttcatcgaggtgaagacttgtatatggccaaaaagccatacactgtggtccaacggagtactcgaatcagagatgatcattcccaagatctatggcggtcctattagccaacacaattaccgaccaggctacttcacccagactgcagggccgtggcatctgggaaaacttgagttggattttgacctgtgcgaaggcacaaccgtcgtggtggatgagcactgcgggaacagaggaccctctttaaggacgactaccgtcacaggcaagatcatacacgaatggtgttgccgctcctgtaccctccctccactgcggttcagaggtgaggacgggtgctggtatggaatggagattaggcccgttaaagaaaaggaggaaaatcttgtgaagagtatggtaagcgcgggctctggtgaggtggactccttttcactgggcttgctctgtatcagtatcatgattgaagaggtcatgcgcagccgatggtcgcggaaaatgctgatgactgggacactagccgtgttctttctgctcatcatgggacagctgacctggaacgatcttattcgtttgtgcataatggttggcgctaatgcctccgacagaatggggatgggaacaacttacctggcattaatggctaccttcaagatgaggcctatgtttgccgtgggcctcctgttccgccggcttacgtctagagaggtcctgctactcacaatcggtctgagcttggtggcatcagttgaactgccaaacagtttagaggaactcggggatggactggccatgggcattatgatccttaaactgttggctgactttcaatcccatcagctctgggcgaccctgctatctctgactttcattaagaccacatttagccttcactatgcctggaaaactatggcaatggtgctctccatcgtctcactgttccccttgtgtctgagcaccacgagtcagaagacaacctggttaccggtactcctgggctctcttgggtgcaagcctctgactatgtttttgatagctgagaataaaatctggggaaggcgatcctggccactcaacgaaggtattatggccgtgggcatcgttagcattctgctatcgtcactgcttaagaacgatgtgcccctcgccgggcctctgatcgctggaggcatgttgatagcatgttacgtcatttctggtagttccgccgacttaagcctggagaaagcggctgaggtgtcttgggaagaggaagccgagcatagcggggcatcccacaatatcctcgtagaagtgcaggatgacggaacaatgaagatcaaagatgaggagcgcgacgataccctgactattcttctgaaggccacattgctagctgtctcaggcgtttatcccctgagtataccagcaaccctcttcgtgtggtacttctggcagaaaaagaagcagcggagcggcgtgctgtgggacacgccttctcccccagaagtcgagagagccgtgcttgatgacgggatctataggattatgcagcgtggattactgggtcgctcccaggttggcgtaggggtgtttcaagaaaacgtcttccatactatgtggcacgtgacccggggagcggttctcatgtaccagggcaaaagattggagccgtcatgggctagtgtgaagaaagacctgatcagctacggtgggggatggaggctccagggctcctggaatacaggcgaggaagtccaggtgattgccgtagagcctgggaagaaccccaaaaatgtccaaaccgcaccaggaacatttaagactcccgaaggtgaggtgggcgccatcgctctggatttcaagcctgggacctctggatcgccaatagttaaccgagaaggcaaaatcgtgggtctttatgggaatggagtcgtgacgacaagcggcacttacgtttcagccattgcacaggctaaggcctcccaggagggccccctgcctgagatcgaagacgaggtgtttcggaaacgcaacttgaccattatggatctacacccggggagtggaaagacaagaaggtatctgccagcgatcgtccgggaagccataaaacgaagactccgcaccttaattctggcacccactagggtggtagcttctgagatggccgaagctcttaagggtatgcctatccgttaccaaaccacagcagtaaagagcgagcatacgggcaaagagatcgttgacctgatgtgccacgccactttcaccatgcggctcttgtccccagtcagagtgcccaattataacatgattatcatggatgaagcccattttacagacccttcatctatagctgcgagggggtacattagcacccgcgtgggaatgggcgaggcagccgctatcttcatgactgccacaccgcccggtagtgtcgaagcatttccacagtccaatgccgtaattcaggatgaggaacgagacatccctgagagaagctggaactctgggtatgagtggataaccgatttccccggaaagacggtgtggtttgttccatcaattaaatccggcaatgacatcgctaactgtctgcggaagaatggcaaaagggtgatccagctcagtcgcaagactttcgatacagaataccaaaagaccaaaaacaacgactgggactacgtcgtgaccactgatattagcgagatgggggcgaatttccgtgccgacagagttatcgatcctcggaggtgcctgaagcccgtgattcttaaagacggaccagaacgcgtcatactagcaggtccgatgcctgtgacagtagcttcggccgcacagcgaagaggccggatcgggaggaaccacaataaggagggagatcagtatatttacatgggccagcccctgaacaatgacgaggatcatgcccactggaccgaagctaaaatgttgttagacaacatcaatacaccagagggtatcattcccgccctgtttgaacctgagcgcgaaaagtctgcggcaatagatggggagtatagactcaggggcgaggcccggaagactttcgtggaactgatgcgtcgcggagaccttccagtttggctgtcctacaaagtcgctagcgagggctttcaatattcagatcgaagatggtgcttcgacggggaaaggaacaatcaggtgctcgaggaaaacatggatgtggagatctggacgaaggagggagaacggaaaaagttgcgccccagatggctggacgccaggacctacagtgaccctctagctctgcgggagtttaaagagttcgcagccggtcgaagatctgtctccggcgatctcattcttgagatcgggaagctgccgcagcacttaacacagcgcgctcaaaatgccttggacaacctggttatgctccataatagcgaacagggaggcagggcatatcggcacgcgatggaggagctgccagatactattgaaacccttatgctgctcgccttgatcgctgtgctgacaggtggggtaaccttatttttcctatcaggccgtggactgggcaaaacaagtatagggctcctttgtgtgatggccagctccgtcctgttgtggatggcatctgtggagccccattggatcgctgccagcattatcctggaatttttcctcatggttctgcttattcctgagcccgacagacagaggacgccacaggataaccaactcgcatacgtggtcatcggactgttgtttatgatactgaccgtagccgctaatgagatgggtttactagaaacaactaagaaggacctgggcattgggcacgtggcggttgagaaccaccatcacgccgcaatgctcgatgtggaccttcatcctgcttccgcctggaccctgtacgccgtcgcaacaaccatcattactcccatgatgcgccacacaatcgaaaacacgaccgctaatatatcattgactgccatcgcgaaccaggctgccattctgatgggactcgataaaggctggccaatctctaagatggacattggtgtgcctctgcttgcattagggtgctatagtcaggtcaatccgctgacactcaccgccgctgtgttgatgctggttgcacattacgccatcataggccccggactacaagcgaaagctacccgggaggcccagaagcgaacagcagccggcattatgaaaaacccaactgtggatgggatcgtagctatcgacctggatcctgtggtctatgacgccaagttcgaaaagcagctcggacagattatgcttctgatcttgtgtacgtcgcaaatactgctcatgagaaccacatgggcactgtgcgagagcattactttagctaccggcccccttacaaccctgtgggagggttccccagggaaattttggaatactacgatcgccgtttctatggcgaacattttcaggggatcatacctcgccggcgcaggtctagctttcagcctgatgaagtccttgggcgggggacgccggggcacaggggcccagggagaaaccctgggcgagaaatggaagagacagctcaatcagcttagtaaatctgaatttaacacttataagcgtagcggtatcatggaggtggacaggtcagaagcaaaggaggggctgaaacggggagagaccacaaagcacgctgtctcccgcggcactgccaaattgcgatggttcgtggaaagaaatctggtaaagcctgagggtaaagtgatagatctcggctgtgggaggggaggctggagttactattgcgccgggttaaagaaggttaccgaagtgaaaggatacacaaagggcggtcccgggcacgaggaaccgatcccaatggcgacgtacggatggaacctggtcaaacttcatagcggcaaggacgtgtttttcattcctcccgagaaatgtgataccctgctatgcgacatcggcgagtcttccccaaatcccactattgaagaggggcggacactccgcgtcctgaagatggtggaaccttggttgagaggaaaccaattttgtatcaaaattctgaatccgtatatgccctcagttgtagagaccctcgagcagatgcagaggaagcacggtggcatgcttgtgcgaaacccactgagcagaaattcgactcatgaaatgtactgggtctcttgcgggacaggaaacatcgtgagtgctgttaatatgacctcccgtatgttactgaacagattcacgatggcacaccgcaagcctacctatgagagggatgtggacttgggcgccggtacacggcacgtcgctgtggaacccgaggtagccaacctcgatataattgggcagagaatcgaaaatatcaaacatgagcacaagagcacttggcattacgacgaggataacccttataaaacctgggcataccacggatcatatgaagtgaagccatccggctctgccagcagtatggttaatggcgtcgtgaaactgctaacaaagccctgggacgtgattcctatggtcactcaaatagctatgaccgatacaaccccatttgggcagcagcgcgttttcaaggagaaagtggacactaggacgcccaaggcgaaacgaggaacagcccaaatcatggaagtaaccgcaaagtggctttggggttttctgtcccggaacaaaaagccgagaatttgtactagggaggagttcacccgcaaggtgcgtagcaatgctgccatcggcgcagtctttgtggacgagaaccagtggaactctgccaaagaggctgttgaagatgagcggttctgggacctcgtgcatagagaaagggagctgcacaagcaggggaaatgcgccacatgcgtctacaacatgatgggaaagcgcgagaaaaagttgggcgagtttggtaaggcgaaagggtcacgagcaatttggtacatgtggctgggagcccggttcctcgagttcgaagctcttggctttatgaatgaggatcactggttcagtagagaaaactccctgagcggcgtggagggggagggattacataagctgggttatatcttgagggacatatctaaaatccctggcgggaatatgtacgccgatgacacggcaggatgggatacccgcattactgaagacgatctccagaacgaggctagaatcacagacattatggaaccagagcacgccctgctagctaagtcgatctttaaacttacctatcaaaataaggtagttcgggtgcagaggcccgccaaaaacggcactgtcatggatgtgatatcacgtcgagaccagcgcggtagcggacaggtgggaacatacggcctgaataccttcacaaacatggaagcacaactcattagacagatggagtccgagggcatctttagtccttctgaactggagactccaaacttggcggaacgggtcttagattggctggagaagtatggggttgaaaggctcaagcgcatggccatcagcggagacgactgtgtggtaaaacccattgatgacagattcgctaccgcccttacggcactgaatgatatgggtaaggtgcggaaagacataccgcagtgggagccttccaagggctggaacgattggcagcaagtccccttttgctcacatcacttccaccagctaatcatgaaagacgggagggagattgtggttccatgtcgaaatcaggatgaactggtgggacgtgctagagtcagtcagggcgccggttggtctctccgcgagaccgcatgcttgggaaagagctacgcccaaatgtggcagctgatgtattttcatcggagggaccttagactggcggctaacgccatctgttccgcagtgcctgtagattggattcccacatcacgcactacctggagcatccacgcccatcaccagtggatgacaactgaagacatgctctctgtttggaatcgggtgtggatagaggaaaacccatggatggaggataagacccatatctccagttggggagacgtcccctacttaggcaaaagggaggaccaatggtgcggcagcctgattgggttgacggctcgagccacatgggcaaccaatatccaggtggctattaaccaggttagacggctgatcggaaatgaaaactacctcgattatatgacttcgatgaagaggttcaaaaatgagtccgaccctgaaggtgccctttggtga

SEQ ID NO: 13756 - RNA, 9879 nt, synthetic construct
  misc_feature 1..9879: note = derived and/or modified CDS sequence (opt3) from DENV-1__GQ199778__SS-prME
  source 1..9879: mol_type = other RNA
tccgtgaccatgctgctcatgcttatgcccacagccctggctttccacttgactacgcggggaggggaacctcatatgatcgtctccaagcaggaaaggggaaaatctttactgtttaagacctcagccggtgttaacatgtgcacactaattgccatggacctcggcgaactgtgtgaagatactatgacctacaaatgcccacggataacagaaaccgaaccggacgatgtggactgttggtgcaatgcgactgatacatgggtaacctatgggacgtgtagtcaaactggagaacaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaggacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaggcccctacaaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagaggcatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatgtgtactgggtcgttcaaactggagaaggaagtcgctgagacccagcacggtacggtgcttgttcagataaagtacgagggcacagacgcgccttgcaaaatcccattctcgacccaagatgaaaagggggtgactcagaacggacgcttgattacagcaaatcccatcgtaaccgacaaagagaagcctgtcaacatagaagccgagccaccctttggcgagtcttatattgtgatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtttttacatccgtggggaaacttgtccatcagattttcggaacggcgtacggcgtgctgttttctggtgtaagctggaccatgaagatagggatcggcgtgttgctcacttggctgggattaaattcacgaagtacatccctgagcatgacctgtattgctgttggcctagtcacactctacctgggggtgatggtgcaggccgattctggatgcgtcatcaactggaaaggccgcgaacttaagtgtggttcagggatcttcgttactaatgaggtgcacacctggacggaacaatataagtttcaggcagacagtccgaaaagattgagcgccgctattggaaaggcctgggaggagggcgtgtgcggtataaggtccgcaacacggctggaaaacatcatgtggaaacagatttctaacgagctcaatcatatcctgttagaaaacgacatgaagttcaccgtagtcgtgggcgatgttgctgggattctggcccagggcaagaagatgatccgccctcaacccatggagtacaaatattcgtggaaaagctggggcaaggcgaagataatcggggccgacgtgcagaatactacctttattatcgatggaccaaacacacctgaatgtcccgacgatcagagagcttggaatatttgggaggtcgaggactacggcttcggtatctttactaccaacatatggcttaagttgagggattcctatacacaggtgtgcgaccaccgtctcatgtcagcagccattaaagatagtaaggctgttcacgccgacatggggtactggatcgaatctgagaaaaatgaaacgtggaagctggcacgggcgagcttcattgaggtgaagacctgtatctggccaaaatcccatactctatggtcaaacggagtactggaaagcgagatgataatccccaagatttatggcggtcctatctctcaacacaattaccgaccaggctacttcacacaggccgctgggccgtggcatctcggaaaactggagcttgattttgacttgtgcgaaggcaccactgtcgtggtggatgagcactgcgggaacagaggaccctccctgaggacaaccacggtcactggcaagattatccacgaatggtgttgccgcagttgtaccttacctccactccggttcagaggtgaggacgggtgctggtatggaatggagataaggcccattaaagaaaaggaggaaaatctggttaagagcatggtgtctgccggctccggtgaggtagactcatttagtcttggcctgttgtgtatcagcatcatgattgaagaggtgatgcgctcgcgatggtcccggcgtatgctcatgacagggaccctggcagtcttctttctactgatcatgggacagctcacttggaacgatctgattagactttgcataatggtgggcgctaatgcctctgacaggatggggatgggaacaacctacttggcactgatggccacattcaaaatgcgccctatgtttgctgttggcttactcttccggagactgactagcagggaggtgcttctgctaaccatcggtctctcactggtcgcgagtgtggaattgccaaactccctggaggaattaggggatggactcgccatgggcattatgatcctgaaacttctgacggactttcaatctcatcagttgtgggcaacactcctgagcctaaccttcattaaaactaccttttccctgcactatgcttggaagacaatggccatggttctttcaatcgtgagcctcttccccctgtgtttgagtactacctctcagaaaacgacatggctgccggtcttactcggctccctggggtgcaagcctcttaccatgtttctgatagccgagaataagatctggggacgacgcagctggccattgaacgaaggtattatggctgtaggcatcgtgtcgattctcctgtcatctctactgaaaaacgatgttccccttgcagggcctctcatcgccggaggcatgctgatagcgtgttacgtgattagtggttccagcgctgacttgtctttagagaaggccgcagaggtcagctgggaagaggaagccgagcattccggggcttcacacaatatcctggtggaagtacaggatgacggaactatgaaaatcaaggatgaggagcgggacgatacactcaccattctgcttaaagcaactctgttggccgtgagtggcgtctatcccctaagcataccagcgacactgttcgtttggtacttctggcaaaagaaaaagcagagatctggcgtgctctgggacaccccttcacccccagaagtggagagggctgtcctggatgacgggatctatcgtattatgcagcgcggacttttaggtcggagccaggtgggcgttggggtatttcaagaaaacgtgttccatacgatgtggcacgtcactagaggagccgtgctgatgtaccagggcaagaggctcgagccgagttgggcaagcgttaaaaaggacttgatctcctacggtgggggatggcgactgcagggctcttggaataccggcgaggaagtgcaggtcattgccgtggagcctgggaaaaaccccaagaatgtacaaacagctccaggaacctttaaaacacccgaaggtgaggtcggcgccatcgcactcgatttcaagcctgggacttcgggaagcccaatagtgaaccgggaaggcaagatcgttggtctgtatgggaatggagtggtcaccacgtcaggcacatacgtgtccgctattgcccaggcgaaagccagtcaggagggcccccttcctgagatcgaagacgaggtttttcgcaagagaaacctgactattatggatttgcacccggggtctggaaaaaccaggcggtatctaccagcaatcgtgcgagaagctataaagagaaaactgcgcacactcattttagcccccaccagggtcgtggctagcgagatggcagaagccctgaagggtatgcctatccgttaccaaactaccgccgtaaagtccgagcatacaggcaaagagatcgtggaccttatgtgccacgctacgttcactatgcggctgctctcaccagttagagtccccaattataacatgattatcatggatgaagcgcattttaccgacccttctagcatagcagccagggggtacattagtacacgcgtgggaatgggcgaggctgccgcaatcttcatgaccgccactccgcccggttccgtggaggcttttccacagagcaatgcggtcattcaggatgaggaacgagacatccctgagagatcttggaactcagggtatgagtggataacagatttccccggaaagaccgtatggtttgtgccatccattaaaagtggcaatgacatcgccaactgtttgcggaagaatggcaaaagggttatccagctgagccgcaagacgttcgatactgaataccaaaagaccaagaataacgactgggactacgtggtcaccaccgatatttcggagatgggggcaaatttccgtgctgacagagtgatcgatcctcggaggtgcctcaagcccgttattctgaaagacggaccagaacgcgtgatacttgccggtccgatgcctgtcactgtggcatctgccgctcagcgaagaggccggatcgggaggaaccacaataaggagggagatcagtatatttacatgggccagcccctaaacaatgacgaggatcatgcccactggacagaagcgaaaatgctgttggacaacatcaataccccagagggtatcattcccgcattatttgaacctgagcgcgaaaagtccgccgctatagatggggagtatagactgaggggcgaggcccggaagacattcgtagaactcatgcgtcgcggagacctgccagtgtggcttagctacaaagttgcttcagagggctttcaatatagtgatcgaagatggtgcttcgacggggaaaggaacaatcaggtcctggaggaaaacatggatgtggagatctggactaaggagggagaacggaaaaagctccgccccagatggttggacgcaaggacgtactctgaccctctggccctacgggagtttaaagagttcgctgccggtcgaagatccgtgagcggcgatctgattctcgagatcgggaaacttccgcagcacctgacccagcgcgcacaaaatgcgttagacaacttggtcatgctgcataattcagaacagggaggcagggcctatcggcacgctatggaggagctcccagatacaattgaaactctgatgcttctggccctcatcgcagttttgaccggtggggtgacactgtttttcttaagtggccgtggactaggcaaaaccagcatagggctgctctgtgtaatggcttcctctgtgcttctgtggatggccagcgtcgagccccattggatcgcagcctccattatcttggaatttttcctgatggtgctcctgattcctgagcccgacagacagaggactccacaggataaccaacttgcttacgttgtgatcggactcctgtttatgatattgacggtcgcggccaatgagatgggtctgttagaaaccacaaagaaggacctaggcattgggcacgtagcagtggagaaccaccatcacgctgccatgctggatgttgacctccatcctgcctcagcatggactctttacgctgtggccaccacaatcattacccccatgatgcgccacactatcgaaaacacaacggcgaatatatctctgaccgctatcgccaaccaggcagccattttgatgggactggataaaggctggccaatcagtaagatggacattggtgtccctctcctggctcttgggtgctatagccaggtgaatccgttaactctgacagcagccgtcctcatgttggtggcgcattacgctatcataggccccggactgcaagccaaagcaacccgggaggcccagaagcgaaccgctgccggcattatgaaaaacccaacagttgatgggatcgtggcaatcgacctagatcctgtagtgtatgacgctaagttcgaaaagcagctgggacagattatgctccttatcctgtgtactagccaaatattgctgatgagaacgacctgggccctctgcgagtccattacactggcgactggccccttaaccacactttgggagggttctccagggaaattttggaataccactatcgccgtctcaatggcaaacattttcaggggaagctacctggctggcgccggtctcgcattctccctaatgaagagtctgggcgggggacgccggggcacgggggctcagggagaaacattgggcgagaaatggaagagacagctgaatcagctctctaaaagcgaatttaacacctataagcgttcaggtatcatggaggttgacaggtccgaagccaaggaggggcttaaacggggagagactaccaagcacgccgtgagtcgcggcacagcgaaactgcgatggttcgtcgaaagaaatttggtgaagcctgagggtaaagtaatagatctgggctgtgggaggggaggctggagctactattgcgctgggctcaagaaggtgactgaagttaaaggatacaccaagggcggtcccgggcacgaggaaccgatcccaatggcaacatacggatggaacttagtgaaactgcattctggcaaggacgtctttttcattcctcccgagaaatgtgatacgcttctgtgcgacatcggcgagtcctcaccaaatcccaccattgaagaggggcggactctacgcgtgctcaagatggtcgaaccttggctgagaggaaaccaattttgtatcaaaattttgaatccgtatatgcccagcgtggttgagacactggagcagatgcagaggaagcacggtggcatgctcgtacgaaacccactttcgagaaattctacccatgaaatgtactgggtgagttgcgggactggaaacatcgtctccgccgtgaatatgacaagccgtatgctgttaaacagattcaccatggctcaccgcaagcctacgtatgagagggatgttgacctgggcgccggtacccggcacgtggcagtcgaacccgaggtggccaacttggatataattgggcagagaatcgaaaatatcaaacatgagcacaagtcaacatggcattacgacgaggataacccttataaaacttgggcttaccacggatcctatgaagtaaagccatctggcagcgcgagttccatggtgaatggcgttgtcaaactcctgaccaagccctgggacgtgattcctatggtgacacaaatagccatgactgataccacaccatttgggcagcagcgcgtcttcaaggagaaagttgacaccaggactcccaaggcaaaacgaggaacggctcaaatcatggaagtgacagccaagtggctatggggttttcttagccggaacaaaaagccgagaatttgtaccagggaggagttcactcgcaaggtacgttctaatgcagccatcggcgctgtgtttgtcgacgagaaccagtggaactcagccaaagaggcggtggaagatgagcggttctgggacctggttcatagagaaagggagctccacaagcaggggaaatgcgcaacctgcgtgtacaacatgatgggaaagcgcgagaaaaagctgggcgagtttggtaaggccaaagggagtcgagctatttggtacatgtggttgggagcccggttcctggagttcgaagcactcggctttatgaatgaggatcactggttctccagagaaaacagcctttctggcgtcgagggggagggactgcataagttaggttatatcctgagggacatatcgaaaatccctggcgggaatatgtacgctgatgacacagccggatgggatacgcgcattaccgaagacgatttgcagaacgaggctagaatcactgacattatggaaccagagcacgccctcctggcaaagtcaatctttaaactaacatatcaaaataaggtggtacgggttcagaggcccgcgaaaaacggcaccgtgatggatgtcataagccgtcgagaccagcgcggttccggacaggtgggaacttacggccttaatacattcaccaacatggaagcccaactgattagacagatggagagtgagggcatcttttctcctagcgaactcgagacaccaaacctggctgaacgggtgttggattggttagagaagtatggggtcgaaaggctgaagcgcatggccatctccggagacgactgtgttgtgaaacccattgatgacagattcgcaactgctctcaccgcccttaatgatatgggtaaggtacggaaagacataccgcagtgggagccttcaaagggctggaacgattggcagcaagtgcccttttgcagtcatcacttccaccagctgatcatgaaagacgggagggagattgtcgtgccatgtcgaaatcaggatgagctagttggacgtgcaagagtgtctcagggcgccggttggagcctgcgcgagacggcgtgcctcgggaagtcctacgctcaaatgtggcagttgatgtattttcatcggagggacctgagacttgccgcaaacgccatctgttcagctgtccctgtggattggattcccaccagccgcacaacttggtctatccacgcccatcaccagtggatgaccacagaagacatgctgtccgtatggaatcgggtttggatagaggaaaacccatggatggaggataagactcatatcagtagctggggagacgtgccctacctcggcaaaagggaggaccaatggtgcggctcgttaattgggctgaccgcacgagctacgtgggccacaaatatccaggtcgcgattaaccaggtgagacggttgatcggaaatgaaaactacctggattatatgacctccatgaagaggttcaaaaatgagtctgaccctgaaggtgctctctggtga

SEQ ID NO: 13757 - RNA, 9879 nt, synthetic construct
  misc_feature 1..9879: note = derived and/or modified CDS sequence (opt3) from DENV-1__GQ199780__SS-prME
  source 1..9879: mol_type = other RNA
tccgtgacaatgctgctaatgcttatgcccacagcactggctttccacttgactacgcgaggcggggaacctcatatgatcgtctccaagcaggaaagggggaaatctttactgtttaagacatcagccggtgttaacatgtgcacactaattgccatggacctcggcgagttctgtgaagatactatgacctacaaatgcccacggataacagaagcggaaccggacgatgtggactgttggtgcaatgctaccgatacttgggtaacatatgggacctgtagtcagacgggagaacaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaagacgcaaactttgtttgccgccgaacattcgtggatagaggctggggtaatgggtgtggactgtttggcaaaggctccttgataacttgcgctaagttcaagtgcgtaaccaaactcgaggggaagattgtgcagtacgaaaacctgaaatattcagtcatcgtgacagttcacaccggagaccagcatcaagtgggtaatgagagtactgaacacggcacgacagccaccattactccccaggcgcctagcaccgagatccagttaacagactacggggccctgaccctcgattgttctccaaggactggacttgactttaacgaaatggtcctgttgacaatgaaggagaaatcctggctagtgcataagcagtggttcctggatctcccgctgccctggacgtcaggcgcaagcaccagtcaagagacttggaatcggaaagaccttctggtaacatttaagaccgctcacgccaagaaacaggaagttgtggtcttgggttctcaggagggggctatgcacacagccctcactggcgcaaccgaaatccaaacgtccggaaccacaactattttcgccggccatctgaagtgccgtttaaaaatggataagctgaccctaaaagggatgagctatgtgatgtgtacaggatcgttcaagctcgagaaggaagtcgctgagactcagcacggtaccgtgctggttcagataaaatacgagggcacggacgcgccttgcaagatcccattttctacacaggatgaaaaaggggtgacccaaaacggacgccttattactgcaaatcccatcgtaacagacaaggagaaacctgtcaacatagaagccgagccacccttcggcgagtcctatattgtgatcggtgctggggaaaaggccttgaagctgtcatggtttaaaaagggcagtagcatcggaaaaatgttcgaggcaaccgccagaggcgctaggcggatggccattctcggggatactgcatgggactttggatccatcggtggcgttttcacctctgtggggaagctggtccatcagatttttggaacagcgtacggcgtgcttttcagcggtgtatcatggacgatgaaaatagggatcggcgtgctgttgacctggctcggactgaatagtcgatccactagcttatctatgacatgtattgctgttggcctggtcaccctatacctcggggtgatggtgcaggccgattcaggatgcgtcatcaactggaagggccgcgaactgaagtgtggtagtgggatctttgttacaaatgaggtgcacacttggaccgaacagtataaattccaagcagacagcccgaagagactttccgccgctattggaaaagcctgggaggagggcgtgtgcggtataaggtctgcaacgcggttggaaaacatcatgtggaagcagatttcgaacgagctgaatcatatcctcctggaaaacgacatgaaatttacagtagtcgtgggcgatgttgctgggattttagcccagggaaagaaaatgatccgccctcagcccatggagtacaagtatagctggaagtcctggggcaaagcgaagataatcggggccgacgtgcaaaataccactttcattatcgatggaccaaacacccctgaatgtcccgacgatcagagagcttggaatatttgggaggtcgaggactacggctttggtatcttcacaactaacatatggctgaaacttagggattcatatacccaggtgtgcgaccaccgtttgatgagtgcagccattaaggattctaaagctgttcacgccgacatggggtactggatcgaaagcgagaagaatgaaacatggaagctcgcacgggcgtccttcattgaggtgaaaacgtgtatctggccaaagtcacataccctgtggagcaacggagtactagaatctgagatgataatccccaaaatttatggcggtcctatctcccagcacaattaccgaccaggctactttactcaaacagccgggccgtggcatctgggaaagctcgagctggatttcgacctttgcgaaggcaccactgtcgtggtggatgagcactgcgggaacagaggacccagtttgaggacaaccacggtcactggcaaaattatccacgaatggtgttgccgcagctgtaccctgcctccattacggtttaagggtgaggacgggtgctggtatggaatggagataagacccgttaaggaaaaagaggaaaatctcgtgaagtctatggtatccgctggctcaggtgaggtggacagtttcagcctgggccttctgtgtatttcgatcatgatcgaagaggtcatgaggtcccgctggtctcgaaaaatgttgatgacagggaccctcgccgtgtttttcctgctaattatgggacagctgacttggaacgatctcatccggctgtgcattatggttggcgcaaatgctagcgaccgtatggggatgggaacaacctaccttgccttgatggcaacatttaagatgagacctatgttcgccgtgggcctgttatttaggcgcctcacttcacgggaggtcctgcttctgaccataggtctaagtctcgtggcttccgttgaactgccaaactctttggaggaactgggggatggattagcgatgggcatcatgattctcaaactgcttacggacttccagagccatcaactgtgggccacattgctctccctgacctttatcaagactaccttctcactacactatgcatggaagacaatggctatggtgctgagcattgtcagtctttttcccctctgtctgtctactacctcccagaaaacgacatggttgccggtactgttaggcagcctcgggtgcaagcctctgaccatgttccttatcgccgagaataaaatatggggaagaaagtcgtggccactgaacgaaggtatcatggccgtgggcattgtttcaatcttgctctctgctctgctcaagaacgatgtgcccctggcagggcctcttattgccggaggcatgctcatcgcgtgttacgtcataagtggttccagcgctgacctgtctttggagaaggccgcagaggtgagctgggaagaggaagccgagcattccggggcttcacacaatattttagtagaagtgcaggatgacggaactatgaaaatcaaggatgaggagagggacgatacactgaccatcctcctgaaggcaactcttctggccgtcagtggcgtttatcccttgagcattccagcgacactattcgtgtggtacttttggcagaaaaagaaacaacgatctggcgtgctgtgggacaccccttcacccccagaagtcgagcgcgctgtgctcgatgacgggatatatcggatcatgcagagaggactgcttggtaggagccaggttggcgtaggggtgttccaggaaaacgtctttcatacgatgtggcacgtgactcgtggagccgttttaatgtaccaaggcaagcgcctggagccgagttgggcaagcgtgaaaaaggacctcatttcctacggtgggggatggcggttgcagggctcttggaataccggcgaggaagtccaggtgatcgccgtagagcctgggaagaaccccaaaaatgtccagacagctccaggaaccttcaagacatcggaaggtgaggtgggcgccattgcactggattttaaacccgggactagcggatcacctatcgttaacagagaaggcaagatagtgggtctctatgggaatggagtcgtgaccacgtccggcacatacgttagtgctatcgcccaagcgaaagcctctcaggagggcccactgcccgagattgaagacgaggtgttcaggaagcgaaaccttactatcatggatctgcaccctgggagcggaaagacccggcgctatttgccggcaattgtcagagaagctatcaaaaggaagctacggacactgatactcgccccaacccgagtggtagcttccgagatggcagaagccttaaaaggtatgcccattagataccagactaccgccgtgaagtcagagcatacaggcaaagagatcgttgacctgatgtgccacgctacgtttactatgcgccttctgtctcctgtcagggtgccaaattataacatgatcattatggatgaagcgcatttcaccgaccccagcagtatcgcagcccgtgggtacatatccacacgggtgggaatgggcgaggctgccgcaatttttatgaccgccactcctccgggtagcgtcgaggctttcccccaatctaatgcggtaatccaggatgaggaaagagacattccagagaggtcatggaactccgggtatgagtggatcacagattttcctggaaagaccgtgtggttcgttcccagtataaagagcggcaatgacattgccaactgtctccgcaaaaatggcaagcgagtgatccagttgtcgagaaaaacgttcgatactgaataccagaagaccaaaaacaacgactgggactacgtcgtgaccaccgatatctctgagatgggggcaaattttcgggctgacagggttattgatccacgccgttgcctgaagcctgtgatcctcaaggacggacccgaaagagtcattctggccggtccaatgccggtgactgtagcatccgccgctcaacggaggggccgcatagggcgaaaccacaataaagagggagatcagtatatctacatgggccagcctcttaacaatgacgaggatcatgcccactggacagaagcgaagatgctactggacaacattaatacccccgagggtatcatcccagcattgttcgaacccgagagagagaaaagcgccgctattgatggggagtatcggttaaggggcgaggcccgcaagacatttgtggaactgatgagaaggggagacctccctgtttggctgtcatacaaagtcgctagtgagggcttccagtattctgatcggcgttggtgctttgacggggaacgcaacaatcaagtgcttgaggaaaacatggatgtggagatatggactaaggagggagaaaggaaaaagctgagaccaagatggctcgacgcacggacgtactccgaccccttggccctgcgcgagttcaaggaatttgctgccggtagaaggagcgtctcaggcgatctaatcctggagattgggaaactccctcagcaccttacccagcgggcacagaatgcgctggacaacttagttatgttgcataatagtgaacaaggaggccgagcctatagacacgctatggaggagctgccggatacaatcgaaactctcatgctgcttgccctgattgcagtgctcaccggtggggtaacattgttctttctgagcggccgcggattaggcaagacctccatcgggctactgtgtgtgatggcttctagcgtcctcctttggatggcctccgtggagccacattggatagcagcctcaatcattctggagttctttttgatggttctgctcatccccgagcctgacaggcagcggactccccaggataaccagctggcttacgtggtcattggacttctcttcatgatcctgacggtagcggccaatgagatgggtttgctggaaaccaccaaaaaggacttaggcatagggcacgtggcagttgagaaccaccatcacgctgccatgctagatgtggacctgcatccagcctctgcatggactctctacgctgtcgccaccacaattatcacccctatgatgcgtcacactattgaaaacacaacggcgaatatcagtcttaccgctatagccaaccaagcagccatcctgatgggattggataaaggctggcccatttcgaagatggacatcggtgtgccactgctcgctctggggtgctatagccaggtcaatcctcttactttaacagcagccgtgctgatgctcgttgcgcattacgctattatcggcccgggattgcaggccaaggcaaccagagaggcccagaaaaggaccgctgccggcataatgaagaaccccacagtggatgggattgtagcaatcgacctggatccagtggtctatgacgctaaatttgaaaagcagctaggacagatcatgctgctcattctttgtacttcccagatcctgttgatgcgcacgacctgggccctgtgcgagtctataacactcgcgactggccctctgaccacattatgggagggttcacccgggaaattctggaataccactattgccgttagcatggcaaacatcttccggggatcctaccttgctggcgccggtctggcatttagtctcatgaagtctctaggcgggggacgaagaggcacgggggctcaaggagaaacactgggcgagaagtggaaaaggcagttgaatcagctgagcaagtcagagttcaacacctataaacgctccggtattatggaggtggaccggagtgaagccaaggaggggctcaaaagaggagagactaccaagcacgccgtcagccgtggcacagcgaaacttaggtggtttgtggaacggaatctggtaaaaccagagggtaaggtgatcgatttgggctgtgggcgcggaggctggtcttactattgcgctgggctgaaaaaggttactgaagtgaaaggatacaccaagggcggtcctgggcacgaggaacccataccgatggcaacatacggatggaacctcgtcaaattacattccggcaaggacgtgttctttatcccacctgagaagtgtgatacgctgctttgcgacattggcgagtcaagccccaatccaaccatcgaagaggggcgaactctgagagtcctaaaaatggtggaaccctggctcaggggaaaccagttctgtattaagatcctgaatccttatatgccgtcggttgtagagacattggagcaaatgcagcggaaacacggtggcatgctggtgcgcaaccccctctctagaaatagtacccatgaaatgtactgggtctcctgcgggactggaaacattgtgagcgccgttaatatgacatcaaggatgcttctgaaccgatttaccatggctcaccggaagccaacgtatgagcgtgatgtggacttaggcgccggtaccagacacgtcgcagtggaacctgaggtagccaacctggatatcatagggcagcgcattgaaaatatcaaacatgagcacaagtccacatggcattacgacgaggataacccctataagacttgggcttaccacggatcttatgaagtgaaacctagcggcagtgcgtccagcatggttaatggcgtcgtgaagttgctcaccaaaccatgggacgtgatccccatggtcacacagattgccatgactgataccacacctttcgggcaacagagggtttttaaggagaaagtggacacccggactccaaaggcaaagagaggaacggctcagataatggaagtaacagccaaatggctgtggggtttcctatctcgcaacaagaaacccaggatctgtacccgagaggaatttactcggaaggtgagatcaaatgcagccattggcgctgtcttcgtggacgagaaccaatggaatagtgccaaagaggcggttgaagatgagaggttttgggaccttgtgcatcgcgaacgtgagctgcacaagcaggggaagtgcgcaacctgcgtctacaacatgatgggaaaacgggaaaagaaactcggcgagttcggtaaggccaaagggtccagagctatctggtacatgtggctgggagccaggttcttggagtttgaagcactgggcttcatgaatgaggatcactggtttagccgcgaaaactctctctcgggcgtggagggggagggacttcataagctgggttatattttacgagacatctcaaaaataccgggcgggaatatgtacgctgatgacacagccggatgggatacgcggatcaccgaagacgatctgcagaacgaggctaagattactgacatcatggaacctgagcacgccttgctcgcaaagagcattttcaaactgacatatcagaataaggtagttagagtgcaaaggccagcgaaaaacggcaccgtcatggatgtgatctcccgcagagaccagcggggtagtggacaggtgggaacttacggcctaaatacatttaccaacatggaagcccagcttataaggcaaatggagtctgagggcattttcagcccctccgaactggagacacctaacctcgctgggcgtgtcctggattggttggaaaagcatggagttgagcgattaaaacgcatggccatctcaggtgacgactgtgtggtaaagccaatcgatgacagatttgcaactgctctgaccgccctcaatgatatgggcaaggtgcggaaagacgtcccccagtgggaaccgagtaaggggtggaacgattggcaacaggtgcctttctgctctcaccactttcatcaacttattatgaaagacggaagggagatagttgtgccctgtcgcaatcaggatgagctggtcggcagagcacgggtgagccagggtgccgggtggtccctaagggaaacggcgtgcctgggaaagtcatatgctcagatgtggcaactcatgtacttccaccgacgtgacttgagactggccgcaaacgccatctgtagcgctgtaccagttgattgggtgcctacctctcgcacaacttggtccattcatgcccaccatcagtggatgaccacagaggacatgcttagtgtctggaatcgggtgtggatcgaagagaacccctggatggaagataaaactcacattagctcgtggggcgacgttccatatctgggcaagagggaggaccagtggtgcgggtccctcatcggattaaccgcaagagctacgtgggccacaaatatacaagtggcgatcaaccaggtccgccggctgattggtaatgagaactacttggattacatgacctctatgaagaggtttaaaaatgaatcagaccccgagggcgctctgtggtga

SEQ ID NO: 13758 - RNA, 9879 nt, synthetic construct
  misc_feature 1..9879: note = derived and/or modified CDS sequence (opt3) from DENV-1__GQ199781__SS-prME
  source 1..9879: mol_type = other RNA
agcgtgaccatgctgctcatgcttatgcccaccgcactggctttccacttgactacgaggggaggggaacctcatatgatcgtcaccaagcaggaaaggggaaaatccttactgtttaagacatctgccggtgttaatatgtgcactctaattgccatggacctcggcgaactgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcattttcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggtagcttcaaactggagaaggaagtggctgagacccagcacggaacggtccttgtgcagataaagtacgagggcacagacgcgccttgcaaaatcccattctcgacccaagatgaaaagggggttattcagaacggacgcttgatcactgcaaatcccatagtgacagacaaagagaagcctgtaaacattgaagccgagccaccctttggcgagtcttatatcgtcatcggtgtgggggaaaaagctctgaagctctcctggttcaagaaaggctcaagtattggaaagatgtttgaggccaccgcaagaggcgccaggcggatggctatcctgggggatactgcctgggacttcggaagcattggtggcgtttttacctccgtggggaaacttgtccatcagatattcggaacagcatacggcgtgctgttttctggtgtaagctggacgatgaagatcgggattggcgtgttgctcacctggctgggattaaattcacgaagtacttccctgagcatgacatgtatcgcggttggcctagtcaccctctacctgggggtgatggtgcaggctgattctggatgcgtcatcaactggaaaggccgcgaacttaagtgtggttcagggattttcgttacaaatgaggtgcacacttggaccgaacaatataagtttcaggccgacagtccgaaaagattgagcgcagccataggaaaggcttgggaggagggcgtgtgcggtatcaggtccgccacgcggctggaaaacattatgtggaaacagatctctaacgagctcaatcatattctgttagaaaacgacatgaagttcacagtagtcgtgggcgatgttgtggggatcctggcacagggcaaaaagatgatacgccctcaacccatggagcacaaatactcgtggaaaagctggggcaaggctaagatcattggggccgacgcgcagaataccacttttatcattgatggaccaaacacccctgaatgtcccgacgatcagagagcctggaatatctgggaggtcgaggactatggcttcggtatatttacaactaacatttggcttaagttgagggattcctacacccaggcttgcgaccaccgtctcatgtcagcagccatcaaagatagtaaggctgtgcatgccgacatggggtattggattgaatctgagaaaaatgaaacatggaagctggcacgggcgagcttcatcgaggttaagacgtgtatatggccaaaatcccacaccctatggtcaaacggagtgctggaaagcgagatggtaatccccaagatttacggcggtcctatctctcaacataattatcgaccaggctacttcactcagacagccgggccgtggcacctcggaaaactggagcttgattttgacttgtgcgaaggcaccactgtcgtggtggatgagcactgcgggaacagaggaccctccctgaggacaaccacggtcactggcaagattatccatgaatggtgttgccgcagttgtaccttacctccactccggttcaaaggtgaggacgggtgctggtacggaatggagataagacccgttaaggaaaaggaggaaaatctggtgaaaagcatggtatctgctggctccggtgaggtggactcatttagtcttggcctgttgtgtattagcatcatgatcgaagaggtcatgaggtcgcgctggtcccgaaagatgctcatgacagggaccctggccgtgttcctactgctcattatgggacagctgacttggaacgatcttatccggttgtgcattatggttggcgcaaatgcttctgaccgtatggggatgggaacaacctatctggccttaatggcaacatttaaaatgagacctatgttcgccgtgggcctcctgtttaggcgccttactagccgggaggtcctgctactcaccataggtctgtcattggtggctagtgttgaactgccaaactccttagaggaactcggggatggactggcgatgggcatcatgattcttaagctgttgacggacttccaatctcaccagctctgggccacactgctaagcctgacctttatcaaaactaccctttccctccattacgcatggaagacaatggctatggtgctgtcaattgtcagcttgttccccctgtgtttaagtactacctctcagaagacgacatggctcccggtactgcttggctccctggggtgcaaacctttgaccatgtttctcatcgccgagaataagatatggggaagaaaaagctggccactgaacgaaggtatcatggccgtgggcgttgtgtcgattctactgtcatctcttctcaagaacgatgtccccctggctgggcctttgatcgcaggaggcatgttaattgcctgttatgtgatcagtggttccagcgcggacctgtctctcgagaaagctgccgaggtaagctgggaagaggaagcagagcactccggggcctcacataatatactggtggaagtccaggatgacggaactatgaagattaaagatgaggagagggacgatacacttaccatcctgttgaaggctactctactggcagttagtggcgtgtaccccctcagcatcccagccacactgttcgtgtggtatttttggcaaaagaaaaagcagcgatctggcgtcctttgggacaccccttcacccccagaagtggagcgcgcggttttagatgacgggatttaccggataatgcagagaggactgctcggtaggagccaggtaggcgtgggggtcttccaagaaaacgtgttccacacgatgtggcacgttactcgtggagctgtgttgatgtatcagggcaaacgcctggagccgagttgggccagcgtcaagaaagacctcatctcctacggtgggggatggcggctgcagggctcttggaataccggcgaggaagtgcaggtaattgcagtcgagcctgggaagaaccccaagaatgtgcaaacagccccaggaacctttaaaacacccgaaggtgaggttggcgctatcgcccttgatttcaagcctgggacttcgggaagcccaattgtgaacagagaaggcaaaatcgtcggtctgtacgggaatggagtggttaccacgtcaggcacatatgtgtccgcaatagctcagactaaggccagtcaggagggccccttgcctgagatcgaagacgaggtctttaggaaacgaaacctaaccattatggatctgcatccggggtctggaaagacacggcgctacctcccagcgatcattagagaagccatcaagaggaaattacggaccctgatacttgcacccactcgagtggtagctagcgagatggccgaagctctgaagggtatgcctattagatatcaaaccacagcagtgaaatccgagcacacgggcaaggagatcgttgacctcatgtgccatgccactttcaccatgcgcttgctgtcaccagtcagggtgcccaattacaacatgatcattatggatgaagcccactttacagacccttctagcatcgctgcgcgtgggtatataagtacccgggtgggaatgggcgaggcagccgctattttcatgactgccacaccgcccggttccgtcgaagcatttccacagagcaatgccgtaatccaggatgaggaaagagacattcctgagaggtcttggaactcagggtacgagtggatcaccgatttccccggaaaaacggtgtggtttgttccatccataaagagtggcaatgacattgctaactgtctccgcaagaatggcaaacgagtgatccagctgagcagaaagactttcgatacagaatatcagaaaaccaagaacaacgactgggactacgtcgtgaccactgatatctcggagatgggggcgaattttcgggccgacagggttattgatcctcgccgttgccttaaacccgtgatcctaaaggacggaccagaaagagtcattctggcaggtccgatgcctgtgacagtagcttctgccgcacagcggaggggccgcatagggcgaaaccataataaggagggagatcagtacatctatatgggccagcccttgaacaatgacgaggatcacgcccactggaccgaagctaaaatgttactggacaacattaatacaccagagggtatcatccccgccctcttcgaacctgagagagaaaagtccgcggcaattgatggggagtaccggctgaggggcgaggcccgcaaaactttcgtggaacttatgagaaggggagacctgccagtttggctcagctataaggtcgcttcagagggctttcaatacagtgatcggcgttggtgcttcgacggggaacgcaacaatcaggtgttggaggaaaacatggatgtggagatatggacgaaagagggagaacgaaagaaactgagacccaggtggctagacgcccggacctattctgaccctctggctctccgcgagtttaaggagttcgcagccggtagaaggtccgtcagcggcgatcttatcctggagattgggaagttaccgcagcatttgacacagcgggctcaaaatgccctggacaacctcgttatgctgcacaattcagaacagggaggccgagcatacagacatgcgatggaggagcttccagatactatcgaaaccctgatgctcttggccctgattgctgtgttaacaggtggggtaaccctatttttcctgagtggccgcggactcggcaaaactagcatcgggcttctgtgtgtgatggcctcctctgtcttgctgtggatggcaagcgtggagccccactggatagctgcctccatcattctcgaatttttcctgatggttcttctcatccctgagcccgacaggcagcggacgccacaggataaccaactggcatatgtggtcattggattgctgtttatgatcttaaccgtagccgctaatgagatgggtctactggaaacaactaagaaagacctcggcatagggcacgtggcggttgagaaccatcaccatgccaccatgcttgatgtggacctgcaccctgcatcagcttggacattgtacgccgtcgccaccactattatcacacccatgatgcgtcatacgattgaaaacaccactgcaaatatctctctgacagctatagccaaccaggcggctatcctcatgggactggataagggctggccaattagtaaaatggacatcggtgtgcctcttttagccctggggtgctactcgcaggtcaatccgctcaccttgaccgcagccgtgctgatgctagttgctcactatgcaattatcggccccggactgcaagccaaggcgacaagagaggctcagaagaggactgccgcaggcataatgaaaaacccaacggtggatgggattgtagccatcgacctcgatcctgtggtctacgacgctaagttcgaaaaacagcttggacagatcatgctgttgattctgtgtaccagccaaatcctcctgatgcgcacaacttgggccttatgcgagtccataacccttgcaacaggccccctgaccactctctgggagggttctccagggaagttttggaatacgacaattgctgtttcaatggccaacatcttccggggaagctatctagcgggcgccggtctggcattttccttgatgaaaagtctgggcgggggacgaagaggcaccggggctcagggagaaactctcggcgagaagtggaagaggcagcttaatcagctgtctaaaagcgagttcaacatttacaagcgctcaggtatcatggaggtggaccggtccgaagccaaagaggggttgaagagaggagagaccacacgtcacgcagtcagtaggggcactgctaaactgcggtggttcgtggaacgcaatctcgtaaagcctgagggtaaggtgatagatttaggctgtgggcgaggaggctggagctattactgcgccgggctgaaaaaggttaccgaagtgaaaggatatacaaagggcggtcccgggcatgaggaaccgatcccaatggccacgtacggatggaaccttgtcaaactgcactctggcaaggacgtgtttttcgcgcctcccgagaaatgtgataccctactctgcgacattggcgagtcctcaccaaatcccactatcgaagaggggagaacactgagggtcttgaagatggtggaaccttggctgcggggaaaccaattttgtattaagatcctcaatccgtacatgcccagcgttgtagagacccttgagcagatgcagcgcaaacatggtggcatgctggtgagaaacccattatcgagaaattctactcacgaaatgtattgggtcagttgcgggacaggaaacattgtgtccgctgttaatatgaccagccgaatgctgttgaaccggttcacgatggcacaccgtaagcctacctacgagagagatgtggacctcggcgccggtacacgccatgtcgctgtggaacccgaggtagccaacctggatatcatagggcagaggattgaaaatatcaaacacgagcataagtcaacttggcactatgacgaggataacccttacaaaacctgggcatatcatggatcctacgaagtgaagccatctggcagcgccagttccatggttaatggcgtcgtgaagctacttacaaaaccctgggacgtgatccctatggtcactcaaattgctatgaccgatacaaccccatttgggcagcagcgggttttcaaggagaaagtggacactagaacgcccaaggcgcgcaggggaacagcccaaataatggaagtaaccgcacgatggctgtggggttttctcagccggaacaaaaagccgagaatctgtactagggaggagttcacccgcaaggtgcgttctaatgctgccattggcgcagtctttgtggacgagaaccagtggaactcagccaaagaggctgttgaagatgagcggttctgggacctggtgcagaaggaaagagagttgcacaaacaggggaagtgcgccacatgcgtctataacatgatgggaaaaagggaaaagaagctgggcgagtttggtaaagcgaaggggagtcgcgcaatctggtacatgtggctcggagcccgattccttgagtttgaagctctgggcttcatgaatgaggatcactggttctcccgggaaaacagcttatctggcgtggagggggagggactgcataaattgggttacattctcagagacatctcgaagatacctggcgggaatatgtatgccgatgacacggcaggatgggataccaggatcactgaagacgatctgcaaaacgaggctaaaattacagacatcatggaaccagagcacgccctacttgctacctcaatttttaagctgacttaccagaataaagtagttcgcgtgcagagacccgccaagaacggcacagtcatggatgtgatcagccggagggaccagcgtggttccgggcaagtgggaacctatggcctcaatacattcactaacatggaagcacagctgatacgacagatggagagtgagggcatatttttgccttctgaattagagaccccaaacctggcggaacgcgtcctcgattggcttgagaagcatggggttgaaagactgaaacggatggccatcagcggagacgactgtgtggtaaagcccatcgatgacaggttcgctacggccctaaccgcactgaatgatatgggtaaagtgcgcaaggacattccgcagtgggagccttccaaaggctggaacgattggcaacaggtccccttttgctcacaccacttccatcagctcataatgaaggacgggagagagatcgtggttccatgtcggaatcaggatgaattggtgggaagggctcgagtcagtcaaggcgccggttggtctctgcgtgagacagcatgccttgggaagtcctacgcccagatgtggcagctgatgtattttcacagacgcgacctccggttagcggctaacgccatttgttccgcagtgcctgtagattgggttcccacttcaaggaccacatggagcatccatgcccaccatcaatggatgactaccgaagacatgctgtctgtgtggaatagagtctggattgaggaaaacccatggatggaggataaaacgcacgtgtccagttggggagacgttccctacttgggcaagcgcgaggaccagtggtgcggcagcctgatcgggctcacagctcgggccacctgggcatcgaatatacaggtggctatcaaccaggtcaggcgacttattggaaatgaaaactatctggattacatgacttccatgaaaagattcaagaatgagggtgaccctgaaggcgccctatggtga

SEQ ID NO: 13759 - RNA, 9879 nt, synthetic construct
  misc_feature 1..9879: note = derived and/or modified CDS sequence (opt3) from DENV-1__GQ199782__SS-prME
  source 1..9879: mol_type = other RNA
agcgtgaccatgctgctcatgcttatgcccaccgccctggctttccacttgactacgagaggaggggagcctcatatgatcgtcaccaagcaggaaaggggaaaatccttactgtttaagacatctgccggtgttaatatgtgcactctaattgccatggacctcggcgagctgtgtgaagataccatgacatacaaatgcccacggataaccgaggcggaaccggacgatgtggactgttggtgcaatgctactgatacatgggtgacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaggacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactgggtcgttcaaactggagaaggaagtggctgagacccagcacggtacggtccttgtgcagataaagtacgagggcacagacgcgccttgcaaaatcccattctcgacccaagatgaaaagggggttactcagaacggacgcttgattacagcaaatcccatcgtgaccgacaaagagaagcctgtaaacatagaagccgagccaccctttggcgagtcttatattgtcatcggtgctggggaaaaagccctgaagctctcctggttcaagaaaggctcaagtatcggaaagatgtttgaggcaactgccagaggcgctaggcggatggccattctgggggataccgcatgggacttcggaagcgtgggtggcgtttttacatccgtggggaaacttgtccatcagatcttcggaacggcgtacggcgtgctgttttctggtgtaagctggaccatgaagattgggataggcgtgttgctcacttggctgggattaaattcacgaagtacatccctgagcatgacctgtatcgctgttggcctagtcacactctacctgggggtgatggtgcaggccgattctggatgcgtcattaactggaaaggccgcgaacttaagtgtggttcagggatcttcgttactaatgaggtgcacacctggacggaacaatataagtttcaggcagacagtccgaaaagattgagcgccgctatcggaaaggcctgggaggagggcgtgtgcggtattaggtccgcaacacggctggaaaacataatgtggaaacagatctctaacgagctcaatcatattctgttagaaaacgacatgaagttcaccgtagtcgtgggcgatgttgtggggatcctggctcagggcaaaaagatgattcgccctcaacccatggagcacaaatactcgtggaaaagctggggcaaggccaaaatcataggggcggacatccagaatactacctttattatcgatggaccaaacacacctgaatgtcccgacgatcagagagcctggaatatttgggaggtcgaggactatggcttcggtatctttactaccaacatatggcttaggttgcgtgattcctacacacaggtgtgcgaccaccggctcatgtcagctgcaattaaggatagtaaagccgttcatgctgacatggggtattggatcgaatctgagaagaatgaaacgtggaaactggcccgagcatccttcattgaggtgaagacctgtatctggccaaagtcccacactctatggtcaaacggagtactggaaagcgagatgataatccccaaaatttacggcggtcctatctctcaacataattatagaccaggctacttcacacagaccgcggggccgtggcacctcggaaagctggagcttgattttgacttgtgcgaaggcactacagtcgtggtggatgagcactgcgggaacaggggaccctccctgcgcaccacgactgtcaccggcaaaattatccatgaatggtgttgccggagttgtacattacctccactcagattcaagggtgaggacgggtgctggtacggaatggagataaggcccgttaaagaaaaggaggaaaatctggtaaagagcatggtatctgccggctccggtgaggtggactcatttagtcttggcctgttgtgtattagcatcatggtcgaagaggtgatgcgctcgcgatggtcccggaaaatgctcatgaccgggactctggctgttttcctactgctcatcatgggacagctgacatggaacgatcttattcgtttgtgcatcatggtgggcgccaatgcatctgacagaatggggatgggaaccacatatctggctttaatggccacttttaagattaggcctatgttcgcagtcggcctcctggtgcgccggcttaccagcagagaggttctgctactcacgataggtctgtcattggtggccagtgtcgaactgccaaactccttagaggaactcggggatggactggctatgggcatcatgattcttaaactgttgacagactttcaatctcaccagctctgggcgaccctgctaagcctgactttcatcaagaccacactttccctccattacgcctggaaaactatggcaatggtactgtcaattgtgagcttgtttcccctgtgtttaagtaccacgtctcagaagacaacctggctcccggttctgcttggctccctggggtgcaagcctttgactatgttcctcatcacagagaataaaatatggggaagaaagagctggccactgaacgaaggtatcatggctgtgggcgtcgtgtcgattctactgtcatctcttctcaaaaacgatgtacccctggccgggcctttgatcgccggaggcatgttaattgcttgttatgtgatcagtggttccagcgcagacctgtctctcgagaaggccgcggaggtcagctgggaagaggaagctgagcactccggggcctcacataatatactggttgaagtgcaggatgacggaaccatgaaaattaaggatgaggagcgagacgatactcttacaatcctgttgaaagcaaccctactggccgtgagtggcgtctaccccctcagcatcccagctacgctgtttgtgtggtatttctggcaaaagaagaaacagcgctctggcgttctttgggacactccttcacccccagaagtagagcgggcagtgttagatgacgggatttacagaataatgcagaggggactgctcggtcgtagccaggtcggcgtgggggtttttcaagaaaacgtgttccacaccatgtggcacgtcacacgcggagccgtgttgatgtatcagggcaagcggctggagccgagttgggcgagcgtaaagaaggacctcatctcctacggtgggggatggagactgcagggctcttggaataccggcgaggaagtccaggtgattgctgttgagcctgggaaaaaccccaagaatgtgcaaacagccccaggaactttcaagacccccgaaggtgaggtcggcgcaatcgcccttgattttaaacctgggacgtcgggaagcccaattgtgaacagggaaggcaagatcgttggtctgtacgggaatggagtggtcacaacttcaggcacctatgtgtccgctatagcccaggcaaaagctagtcaggagggccccttgcctgagatcgaagacgaggtattccgaaagcggaacctaacaattatggatctgcatccggggtctggaaaaacccgcagatacctcccagccatcgtgagggaagcgattaagcggaagttacgaactctgatccttgcccccaccagagttgtcgcaagcgagatggctgaagccctgaaaggtatgcctatacgctatcaaacaacggctgtgaagtccgagcacactggcaaagagattgtggacctcatgtgccatgcaacctttacaatgaggttgctgtcaccagtccgtgtacccaattacaacatgatcatcatggatgaagcccacttcaccgacccttctagcattgccgctcgggggtatatcagtactagagtgggaatgggcgaggcggcagccatatttatgacagctaccccgcccggttccgttgaagccttcccacagagcaatgcagtgattcaggatgaggaaagggacatccctgagcgctcttggaactcagggtacgagtggattacggattttcccggaaagactgtctggttcgtgccatccatcaaaagtggcaatgacatagccaactgtctccgaaagaatggcaagagagttattcagctgagccggaaaacatttgataccgaatatcaaaagaccaaaaacaacgactgggactacgtggtcactacagatatctcggagatgggggctaatttcagggcggaccgcgtgatcgatcctcgtagatgccttaagcccgtaattctaaaagacggaccagaacgggtgatcctggccggtccgatgcctgttaccgtcgcatctgctgcccagaggcgcggccgaattgggagaaaccataataaggagggagatcagtacatatatatgggccagcccttgaacaatgacgaggatcacgcacactggacagaagccaagatgttactggacaacatcaatactccagagggtattatccccgctctctttgaacctgagcgggaaaaatccgccgcgatcgatggggagtacaggctgcgcggcgaggcaagaaagacgttcgtggaacttatgaggcggggagacctgccagtgtggctcagctataaagtcgcctcagagggcttccaatacagtgatcgtcgctggtgctttgacggggaacgaaacaatcaggttttggaggaaaacatggatgtggagatttggaccaaggagggagaaaggaaaaagctgaggccccggtggctagacgctcgcacatattctgaccctctggccctcagagagttcaaagaatttgctgcaggtaggcggtccgtaagcggcgatcttatactggagatcgggaagttaccgcagcatttgactcagcgagcccaaaatgctctggacaacctcgtgatgctgcacaattcagaacagggaggcagagcctaccgccatgcaatggaggagcttccagataccattgaaacactgatgctcttggcgctgatcgccgtcttaaccggtggggtgactctattctttctgagtggcaggggactcggcaagacgagcattgggcttctgtgtgttatggcttcctctgtgttgctgtggatggccagcgtcgagccccactggatcgcagcttccataatcctcgagttctttctgatggtacttctcattcctgagcccgaccggcagcgtaccccacaggataaccaactggcctatgtggttatcggattgctgttcatgattttaacagtggcagccaatgagatgggtctactggaaactaccaaaaaggacctcggcatcgggcacgtcgctgtggagaaccatcaccatgcgacaatgcttgatgtcgacctgcaccctgcctcagcatggaccttgtacgctgtggccactacaataattacgcccatgatgagacataccatcgaaaacactacagccaatatttctctgaccgcaatcgctaaccaggccgcgatactcatgggactggataaaggctggccaatcagtaagatggacattggtgttcctcttttagctctggggtgctacagccaggtgaatccgctcaccttgacagccgcagtactgatgctagtggcccactatgctatcattggccccggactgcaagcaaaagccactagggaggcgcagaagcgcacggctgccggcatcatgaagaacccaaccgtcgatgggatagttgcaattgacctcgatcctgtggtctacgacgccaaatttgaaaagcagcttggacagatcatgctgttgatcctgtgtacaagccaaattctcctgatgcggactacctgggctttatgcgagtccatcacacttgccaccggccccctgactacgctctgggagggttctccagggaaattctggaatacaaccatagcagtgtcaatggctaacatttttcgaggaagctatctagccggcgcgggtctggccttctccttgatgaagagtctgggcgggggaagaaggggcactggggcacagggagaaaccctcggcgagaaatggaagcgccagcttaatcagctgtctaagagcgaatttaacatctacaaacggtcaggtattatggaggtagacagatccgaagctaaggaggggttgaaacgtggagagacaactaggcacgccgtgagtcggggcaccgcaaagctgcgctggttcgttgaacgaaatctcgtgaaacctgagggtaaggtcatcgatttaggctgtgggagaggaggctggagctattactgcgctgggctgaagaaagtgacagaagtcaagggatatacgaaaggcggtcccgggcatgaggaaccgataccaatggccacctacggatggaaccttgtgaagctgcactctggcaaagacgttttctttactcctcccgagaagtgtgatacactactctgcgacatcggcgagtcctcaccaaatcccaccattgaagaggggaggactctgcgggtattgaaaatggtggaaccttggctgcgcggaaaccaattctgtatcaagattctcaatccgtacatgcccagcgtcgtggagacacttgagcagatgcagagaaagcatggtggcatgctggttaggaacccattatcgcgaaattctacccacgaaatgtattgggtgagttgcgggacgggaaacatcgtctccgccgtgaatatgaccagccggatgctgttgaaccgttttacaatggcgcacagaaaacctacttacgagcgcgatgtagacctcggcgctggtaccaggcatgtggcagttgaacccgaggtcgccaacctggatattatcgggcagcggatagaaaatatgaagcacgagcataaatcaacatggcactatgacgaggataacccttacaagacttgggcttatcatggatcctacgaagtgaaaccatctggcagcgccagttccatggtgaatggcgtcgttaagctacttaccaagccctgggacgtgattcctatggtaacacaaatcgcaatgaccgatactacgccattcgggcagcagagagtgtttaaagagaaggtcgacacacgcacccccaaagccaagaggggaactgctcaaatcatggaagtgaccgcgcgatggctgtggggtttcctcagccggaacaaaaagccgagaatttgtacaagggaggaatttacgcgcaaggttcgttctaatgccgcaataggcgctgtgttcgtcgacgagaaccagtggaactcagccaaagaggcagtggaagatgagcggttttgggacctggtacagaaggaaagagagttgcacaaacaggggaagtgcgcaacctgcgtttataacatgatgggaaaaagggaaaagaagctgggcgagttcggtaaagctaaggggagtcgcgccatctggtacatgtggctcggagcgcgatttcttgagttcgaagcactgggctttatgaatgaggatcactggttctcccgggaaaacagcttatctggcgtggagggggagggactgcataaattgggttacattctcagagacatctcgaagattcctggcgggaatatgtatgccgatgacactgctggatgggatacaaggatcaccgaagacgatctgcaaaacgaggccaaaataactgacatcatggaaccagagcacgcactacttgctacatcaattttcaagctgacctaccagaataaagtcgtgcgcgtgcagagacccgccaagaacggcacagtcatggatgttatcagccggagggaccagcgtggttccgggcaagtgggaacttatggcctcaatacctttacgaacatggaagctcagctgattcgacagatggagagtgagggcatcttcttgccttctgaattagagaccccaaacctggccgaacgcgtactcgattggcttgagaagtacggggtggaaagactgaaacggatggcaataagcggagacgactgtgtcgtgaagcccattgatgacaggtttgcgacagccctaactgctctgaatgatatgggtaaagttcgcaaggacatcccgcagtgggagccttccaaaggctggaacgattggcaacaggtgcccttctgctcacatcactttcaccagctcatcatgaaggacgggagagagattgtcgtgccatgtcggaatcaggatgaattggtaggaagggcccgagttagtcaaggcgcaggttggtctctgcgtgagaccgcttgccttggaaagagctatgcccagatgtggcagctgatgtacttccatagacgcgacctccggttagcagccaacgcgatatgttccgctgtgcctgtcgattgggtgcccacatcaaggactacctggagcatccacgcccatcaccaatggatgacgacagaagacatgctgtctgtttggaatagagtgtggattgaggaaaacccatggatggaggataaaacccatgtctccagttggggagacgtgccctatttgggcaagcgcgaggaccagtggtgcggcagcctgatcgggctcactgcacgggccacatgggcttcgaatattcaggtagccatcaaccaggtgaggcgacttataggaaatgaaaactacctggattacatgacctccatgaaaagatttaagaatgagggtgaccctgaaggcgcactatggtga

SEQ ID NO: 13760 - RNA, 9879 nt, synthetic construct
  misc_feature 1..9879: note = derived and/or modified CDS sequence (opt3) from DENV-1__GQ199783__SS-prME
  source 1..9879: mol_type = other RNA
agcgtgaccatgctgctcatgcttatgcccacagcactggctttccacttgactacgagaggaggggaacctcatatgatcgtcaccaagcaggaaaggggaaaatccttactgtttaagacatctgccggtgttaacatgtgcactttaattgccatggacctcggagaactgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtacaagcggcgcgacctgggtagacgttgtgcttgagcacgggagttgtgtcactacaatggcaaaggataaacccaccttggacatcgaactgcttaagacggaggtgaccaaccctgccgtgctcaggaaactgtgcattgaagctaagatctccaatacaactaccgattctcggtgtccaacacaaggagaggccactcttatggaagaacaagacgcaaacttcgtctgccgccgaacctttgttgatagaggctggggtaatgggtgtggactgttcggcaaaggcagcttgataacatgcgctaagtttaagtgcgtgaccaaactcgaggggaagattgtacagtacgaaaacctgaaatattccgtgatcgtcactgtgcacacgggagaccagcatcaagttggtaatgagtcaacagaacacggcaccactgccaccattacaccccaggcgcctaccagtgagatccagttaactgactacggggccctgacactcgattgtagcccaaggacgggacttgacttcaacgaaatggtgctgttgaccatgaaggagaaatcttggctggtccataagcagtggtttctggatctcccgctgccctggacttccggcgcatcaacaagccaagagacctggaatcggcaggaccttctggtgacattcaaaactgctcacgccaagaagcaggaagtagttgtgttgggtagtcaagagggggctatgcacaccgccctcacgggcgcaaccgaaatccagacatctggaactaccacaatttttgccggccatctgaaatgccgtttaaagatggataaactgactctaaaggggatgtcctatgtcatgtgtaccggcagcttcaaactcgagaaggaagtggctgagacgcagcacggtacagtcctggtgcagataaagtacgagggcaccgacgcgccttgcaaaatcccattctcgactcaagatgaaaagggggttacacagaacggacgccttattaccgcaaatcccatcgtgactgacaaagagaagcctgtaaacatagaagccgagccaccctttggcgagtcttatattgtcatcggtgctggggaaaaagccttgaagctgtcctggttcaagaaaggctcaagtatcggaaagatgtttgaggcaaccgccagaggcgctaggcggatggccattctcggggatacagcatgggacttcggaagcgtgggtggcgtttttacgtccgtggggaaactggtccatcagatcttcggaaccgcgtacggcgtgctattttctggtgtaagctggactatgaagattgggataggcgtgctgttgacatggctcggactaaattcacgaagtacctccttaagcatgacatgtatcgctgttggcctggtcactctatacctcggggtgatggtgcaggccgattctggatgcgtcattaactggaaaggccgcgaactgaagtgtggttcagggatcttcgttaccaatgaggtgcacacgtggacagaacaatataagtttcaggcagacagtccgaaaagacttagcgccgctatcggaaaggcctgggaggagggcgtgtgcggtattaggtcctctacccggttggaaaacataatgtggaaacagatctcgaacgagctgaatcatattctcctggaaaacgacatgaagttcactgtagtcgtgggcgatgttgtggggatcttagcacagggcaagaagatgattcgccctcaacccatggagcacaaatacagctggaagtcctggggcaaggctaaaatcataggggccgacgtccagaataccacatttatcattgatggaccaaacactcctgaatgtcccgacgatcagagagcgtggaatatctgggaggtggaggactatggcttcggtatttttaccacaaacatctggctgaaacttagggattcatacacgcaggtttgcgaccaccgtttgatgagtgccgctataaaagattctaaggcagtgcatgccgacatggggtattggattgaaagcgagaaaaatgaaacctggaagctcgctcgggcctccttcatcgaggtaaagacttgtatttggccaaaatcacacacactgtggagcaacggagtcctagaatctgagatgatcatacccaagatctacggcggtcctatttcccaacataattatcgaccaggctacttcacccagactgcagggccgtggcacctgggaaaactcgagctggattttgacctttgcgaaggcacaaccgtggtggtcgatgagcactgcgggaacagaggacccagtttgaggacgactaccgttacaggcaagatcattcatgaatggtgttgccgcagctgtaccctgcctccattacggttcaaaggtgaggacgggtgctggtacggaatggagatcagacccgtgaaggaaaaggaggaaaatctcgtaaaatctatggtgtccgcgggctcaggtgaggtcgacagttttagcctgggccttctgtgtatatcgattatgatcgaagaggtgatgaggtcccgctggtctcgaaagatgttgatgactgggacactcgccgttttcctgctactgatcatgggacagctcacctggaacgatctgattcggctttgcatcatggtgggcgctaatgccagcgaccgtatggggatgggaacaacttatttggcactgatggctacctttaaaattagacctatgttcgccgtcggcttactctttaggcgcctgacgtcacgggaggtgcttctgctaacaataggtctcagtctggttgcatccgtggaattgccaaactctctggaggaattaggggatggactcgccatgggcatcatgattctgaaacttctgaccgacttccaaagccaccagttgtgggctactctcctgtccctaacctttatcaaaacaactctgtcacttcatcacgcgtggaagaccatggccatggtcctcagcattgtaagtctgttccccttgtgtctgtctacgacatcccagaagaccacttggttaccggtgctcctgggcagccttgggtgcaaacctctgacaatgtttttgatcaccgagaataagatatggggaagaaaatcgtggccactcaacgaaggtatcatggcagttggcgtggtctcaattctgctatctagtctgcttaagaacgatgtgcccctcgctgggcctctgatcgccggaggcatgttgattgcctgttacgtaatctccggtagctctgctgacttaagcctggagaaagcagccgaggtgtcctgggaagaggaagcggagcattcaggggctagtcacaatatactcgtcgaagttcaggatgacggaactatgaagattaaagatgaggagagggacgatacactgaccatccttctgaaggccacgttgctagcagtgagcggcgtgtatcccctgtctatcccagccactctcttcgtctggtacttttggcaaaagaaaaagcagcgatccggcgtgctgtgggacaccccttcacccccagaagttgagcgcgctgtacttgatgacgggatttatcggataatgcagagaggattactgggtaggagtcaggtgggcgtcggggtgttccaagaaaacgttttccacacaatgtggcatgtgacccgtggagcagtcctcatgtaccagggcaaacgcttggagccgagctgggcctccgtgaagaaagacctgatctcttatggtgggggatggcggctccagggctcgtggaatacaggcgaggaagtacaggtcattgcggtggagcctgggaagaaccccaagaatgttcaaactgctccaggaacctttaaaacgcccgaaggtgaggtgggcgccatcgcactggatttcaagcctgggacaagcggatcaccaattgtcaacagagaaggcaaaatcgtgggtctttacgggaatggagttgtgactacctccggcacatacgtcagtgccatagctcagaccaaggcctctcaggagggccccctgcctgagatcgaagacgaggtgtttaggaaacgaaacttgactattatggatctacacccggggagcggaaagacccggcgctatctgccagcaatcgtaagagaagctattaagaggaaactccggacattaatcctggcccccacgcgagtggttgcgtccgagatggccgaagcacttaagggtatgcctataagataccaaactaccgctgtcaaatcagagcatacaggcaaggagattgtggacctgatgtgccacgccaccttcactatgcgcctcttgtctccagtgagggtccccaattataacatgatcatcatggatgaagctcattttacagaccctagcagtattgcagcccgtgggtacatctccacccgggtaggaatgggcgaggccgctgcgatattcatgacggcaactccgcccggtagcgtggaagcctttccacagtctaatgctgttattcaggatgaggaaagagacatccctgagaggtcatggaactccgggtatgagtggattacagatttccccggaaaaaccgtgtggtttgtcccaagtatcaagagcggcaatgacatagccaactgtctgcgcaagaatggcaaacgagtgattcagctctcgagaaagaccttcgatactgaataccagaagacaaagaacaacgactgggactatgttgtgaccacagatatctctgagatgggggcaaattttcgggccgacagggtcatcgatcctcgccgttgcctgaaacccgtgattcttaaggacggaccagaaagagtaatcctagctggtccgatgcctgtgactgttgcgtccgccgcacagcggaggggccgcattgggcgaaaccacaataaggagggagatcagtacatatacatgggccagcccctgaacaatgacgaggatcacgctcattggacggaagccaaaatgttgttagacaacatcaataccccagagggtattatccccgcactgttcgaacctgagagagaaaagagcgccgctatcgatggggagtatcggctcaggggcgaggcccgcaaaacattcgtcgaactgatgagaaggggagaccttccagtgtggctgtcatacaaggtggcgagtgagggctttcaatattctgatcggcgttggtgcttcgacggggaacgcaacaatcaggtcctcgaggaaaacatggatgttgagatttggactaaagagggagaacgaaagaaattgagacccaggtggctggacgcacggacctactccgaccctctagccctgcgcgagtttaaggagttcgctgccggtagaaggagcgtgtcaggcgatctcatacttgagatcgggaagctgccgcagcacttaacacagcgggctcaaaatgcattggacaacctggtaatgctccataatagtgaacagggaggccgagcctatagacacgctatggaggagctgccagataccattgaaactcttatgctgctcgccttgatcgcagtgctgacgggtggggtcaccttatttttcctaagcggccgcggactgggcaaaacatccattgggctcctttgtgtgatggcgtctagcgttctgttgtggatggcctccgtggagccccactggatcgctgcctcaataatcctggaatttttcctcatggtcctgcttattcctgagcccgacaggcagcggactccacaggataaccaactcgcatacgtagtgatcggactgttgtttatgattctgaccgttgctgccaatgagatgggtttactagaaacaaccaagaaagacctgggcatcgggcatgtggcagtcgagaaccaccatcacgccactatgctcgatgtggaccttcatcctgcttctgcgtggacactgtatgccgtcgcaacgaccataattactcccatgatgcgtcacacaatcgaaaacaccaccgctaatattagtttgacagccatcgccaaccaggcagctatactgatgggactcgataagggctggccaatctcgaaaatggacattggtgtgcctctgcttgccttagggtgctacagccaggttaatccgctgactctcacggcggctgtgttgatgctggtagcccactacgcaatcattggccccggactacaagccaaggctaccagagaggcacagaagaggacagccgcgggcatcatgaaaaacccaactgtggatgggatagtcgctattgacctggatcctgttgtgtatgacgccaagttcgaaaaacagctcggacagatcatgcttctgatcttgtgtacctcccaaattctgctcatgcgcacaacctgggcactgtgcgagtctatcactttagccacgggcccccttacaaccctgtgggagggttcaccagggaagttttggaatactaccatagctgtcagcatggccaacattttccggggatcctacctcgcaggcgctggtctagcctttagtctgatgaaatctttgggcgggggacgaagaggcacaggggcgcagggagaaactctgggcgagaagtggaagaggcagctcaatcagcttagcaaatcagagttcaacatctataagcgctccggtattatggaggtggaccggagtgaagccaaagaggggctgaagagaggagagaccacacgtcatgcagtaagcaggggcacggctaaattgcggtggttcgtggaacgcaatctggttaagcctgagggtaaggtgatcgatctcggctgtgggcgaggaggctggtcttactattgcgccgggctgaaaaaggtcaccgaagtgaaaggatacactaagggcggtcccgggcacgaggaaccgataccaatggcaacatatggatggaacctagtcaaacttcattccggcaaggacgtgtttttcacccctcccgagaaatgtgatactctgctatgcgacatcggcgagtcaagcccaaatcccacaattgaagaggggagaaccctcagggttctgaagatggtagaaccttggttgcggggaaaccaattttgtatcaagattctgaatccgtacatgccctcggtggtcgagacgctcgagcagatgcagcgcaaacacggtggcatgcttgtgagaaacccactgtctaggaatagtacccacgaaatgtactgggtttcctgcgggacaggaaacatcgtgagcgctgtcaatatgacttcacgaatgttactgaaccggttcaccatggcccatcgtaagcctacatatgagagagatgtggacttgggcgccggtactcgccacgtagcggtggaacccgaggttgctaacctcgatattatcgggcagaggatagaaaatattaaacatgagcacaagtccacctggcattacgacgaggataacccttataaaacatgggcataccacggatcttatgaagtcaagccaagcggcagtgcctccagcatggtgaatggcgtggtcaagctgctaaccaaaccctgggacgttatccctatggtgactcaaatcgctatgacggatacaaccccatttgggcagcagcgggtattcaaggagaaagtggacactagaacccccaaggccaaacgcggaacagcacaaattatggaagtcacggccaggtggctttggggttttctgtctcgaaacaagaagccgcggatatgtaccagagaggagttcactaggaaagtgcgctcaaatgctgcgatcggcgccgtttttgtggacgagaaccagtggaatagtgcaaaggaggctgtcgaagatgagcgtttctgggacctcgtgcagaaagaacgggagctgcacaagcaggggaaatgcgccacatgcgtatacaacatgatgggaaagagagaaaagaaattgggcgagtttggtaaggcaaaagggtccagggccatttggtatatgtggctgggagctcgcttcctcgagtttgaagcccttggcttcatgaatgaggatcattggttcagccgagaaaactctctgtcgggcgttgagggggagggattacacaagctgggttacatcttgcgggacatttcaaaaatccctggcgggaatatgtacgcggatgacaccgcaggatgggatactagaataacagaagacgatctccaaaacgaggccaagatcaccgacattatggaaccagagcatgctctgctagccacaagcatctttaaacttacttatcagaataaggtggtcagggtgcagcgccccgcaaagaacggcaccgtgatggatgtcatttccagacgggaccagaggggtagtgggcaagttggaacgtacggcctgaataccttcacaaacatggaagctcagctcatccgtcagatggagtctgagggcatatttctgcctagcgaattggagactccaaacttagccgaacgagtgctggattggctcgagaaatatggggtagaacgccttaagagaatggctatttccggagacgactgtgtggtcaaacccatcgatgaccggttcgccaccgcactgacagcgctaaatgatatgggtaaggtgaggaaagacatcccgcagtgggagccttcaaagggctggaacgattggcaacaggttcccttttgcagtcaccacttccatcagctgattatgaaggacgggcgcgagatagtggtcccatgtagaaatcaggatgaactcgtgggacgggccagggtatctcaaggcgctggttggagcttgcgagagactgcctgcctggggaaatcctacgcacagatgtggcagcttatgtattttcaccgtagagacctgcgcctcgctgccaacgcaatctgttcagccgttcctgtggattgggtccccaccagccggacgacatggtctattcatgcgcaccatcaatggatgaccactgaagacatgttatccgtgtggaatagggtttggatcgaggaaaacccatggatggaggataagacacacgtgagtagctggggagacgtcccctacctgggcaaaagagaggaccagtggtgcggctcgttgattgggctgaccgctcgcgccacttgggcatccaatatccaggtggccataaaccaggtacggaggctcatcggaaatgaaaactatcttgattacatgacctctatgaagcgattcaaaaatgagggtgaccctgaaggcgctctgtggtga

SEQ ID NO: 13761 - RNA, 9879 nt, synthetic construct
  misc_feature 1..9879: note = derived and/or modified CDS sequence (opt3) from DENV-1__GQ199784__SS-prME
  source 1..9879: mol_type = other RNA
agcgtgaccatgctgctcatgcttatgcccacagccctggctttccacttgactacgaggggaggggaacctcatatgatcgtcaccaagcaggaaaggggaaaatccttactgtttaagacatctgctggtgttaatatgtgcactctgattgccatggacctcggcgaactgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgctccccatgtcggcctgggtttggagaccagaacagaaacttggatgagctccgagggggcctggaaacagatccagagggtggaaacctgggctctccggcaccctggattcacagttattgcactgtttctggcccatgtgatcggcacctctattacgcagaagggcatcatattcatcctcttaatgctggtcactccatcgatggctatgcgctgcgtggggattggatcaagagattttgtagagggtcttagcggcgccacatgggttgacgtggtcttggagcacgggagttgtgtgaccactatggcgaaggataaacccacactggacatcgaactactcaagaccgaggtgacgaaccctgcagtcctgaggaaactttgcattgaagccaagatctccaataccacaactgattctcggtgtccaacccaaggagaggctacactgatggaagaacaagacgccaacttcgtttgccgccgaacttttgtggatagaggctggggtaatgggtgtggattgttcggcaaaggcagcctcataacctgcgcaaagtttaagtgcgtaacaaaactggaggggaagattgtgcagtacgaaaacttaaaatattccgtcatcgtgaccgttcacactggagaccagcatcaagtgggtaatgagtcaacggaacacggcacaaccgctactattacaccccaggcccctacaagtgagatccagctgaccgactacggggcgctcactcttgattgtagcccaaggacaggactggacttcaacgaaatggtcttgctaacgatgaaggagaaatcttggctggtgcataagcagtggtttctcgatctgccgcttccctggacctccggcgcctcaactagccaagagacatggaatcggcaggacctgttggtaaccttcaaaacagcacacgctaagaagcaggaagttgtggtcctcggtagtcaagagggggccatgcacactgctctgaccggcgccacggaaatccagacctctggaacaactaccatttttgcaggccatttaaaatgccgtctgaagatggataaactaacactcaaggggatgtcctatgtgatgtgtactggtagcttcaaactggagaaggaagtcgccgagacccagcacggaacggtgcttgttcagataaagtacgagggcacagacgctccttgcaaaatcccattctcgacccaagatgaaaagggggtgactcagaacggacgcttgattacagcgaatcccatcgtaaccgacaaagagaagcctgtcaacatagaagcagagccaccctttggcgagtcttatattgtgatcggtgccggggaaaaagctctgaagctctcctggttcaagaaaggctcaagtatcggaaagatgtttgaggccactgcaagaggcgccaggcggatggctattctgggggataccgcctgggacttcggaagcatcggtggcgtttttacatccgtggggaaacttgtccatcagattttcggaacggcatacggcgtgctgttttctggtgtaagctggaccatgaagatagggttgggcgtgctcctgacttggttaggactaaattcacgaagtacatccctaagcatgacctgtatcgcggttggcctcgtcacactgtaccttggggtgatggtgcaggctgattctggatgcgtcattaactggaaaggccgcgaattgaagtgtggttcagggatcttcgttactaatgaggtgcacacctggacggaacaatataagtttcaggccgacagtccgaaaagactgagcgcagccatcggaaaggcttgggaggagggcgtgtgcggtattaggtccgccacacggctcgaaaacataatgtggaaacagatctctaacgagctgaatcatattttactggaaaacgacatgaagttcaccgtagtcgtgggcgatgttgtggggatccttgcacagggcaagaagatgattcgccctcaacccatggagcacaaatactcgtggaaaagctggggcaaggctaagatcataggggccgacgtccagaatactacctttatcattgatggaccaaacacacctgaatgtcccgacgatcagagagcgtggaatatctgggaggtggaggactatggcttcggtatttttactaccaacatctggttgaagctcagggattcccacacacaggtttgcgaccatcgtctgatgtcagccgctataaaagatagtaaggcagtgcacgccgacatggggtactggattgaatctgagaaaaatgaaacgtggaagctagctcgggccagcttcatcgaggtaaagacctgtatttggccaaaatcccatactctgtggtcaaacggagtcctcgaaagcgagatgatcatacccaagatctatggcggtcctatttctcaacacaattaccgaccaggctatttcacacagaccgcagggccgtggcacctgggaaaacttgagttggattttgacctgtgcgaaggcactacagtggtggtcgatgagcattgcgggaacagaggaccctccttaaggaccacgactgttaccggcaagatcattcacgaatggtgttgccgcagttgtacactccctccactgcggttcaaaggtgaggacgggtgctggtacggaatggagatcagacccgtgaaggaaaaggaggaaaatcttgtaaaaagcatggtgtctgcgggctccggtgaggtcgactcatttagtctgggcttgctctgtataagcattatgatcgaagaggtgatgaggtcgcgctggtcccgaaagatgctgatgaccgggactctagccgttttcctgctcctgatcatgggacagcttacatggaacgatttgattcggctgtgcatcatggtgggcgctaatgcctctgaccgtatggggatgggaaccacatacttagcactcatggctacttttaaaatgagacctatgttcgccgtcggcctgctttttaggcgcctgaccagccgggaggtgctactcctgacgattggtttgtcactggttgcaagtgtggaattaccaaactccctcgaggaactgggggatggacttgccatgggcataatgatcctgaagttgctcacagacttccaatctcatcagctgtgggctaccctactgagccttacttttattaaaaccacactctccctgcactatgcgtggaagactatggccatggtcttgtcaatcgtaagcctgttccccttatgtctcagtaccacgtctcagaagacaacctggctgccggtgcttctgggctccttggggtgcaaacctctcgcaatgtttctgattgctgagaataagatctggggaagaaaaagctggccactaaacgaaggtataatggccgttggcgtggtctcgatcctgctttcatctctcctgaagaacgatgtgcccttggccgggcctttaattgctggaggcatgctgatcgcatgttacgtaattagtggttccagcgccgacctctctctggagaaagcggctgaggtgagctgggaagaggaagccgagcattccggggcatcacacaatatccttgtcgaagttcaggatgacggaactatgaagataaaagatgaggagagggacgatacactgaccattttgctaaaggccactctgctcgctgtgagtggcgtgtatcccctgagcatcccagcaacacttttcgtctggtacttttggcaaaagaaaaagcagcgatctggcgtgttatgggacaccccttcacccccagaagttgagcgcgccgtactggatgacgggatctatcggattatgcagagaggactcttgggtaggagccaggtgggcgtcggggtgttccaagaaaacgttttccacacgatgtggcatgtgactcgtggagcggtcctgatgtaccagggcaaacgcctcgagccgagttgggctagcgtgaagaaagacctgatatcctatggtgggggatggcggcttcagggctcttggaataccggcgaggaagtacaggtcatcgccgtggagcctgggaagaaccccaagaatgttcaaacagcaccaggaacctttaaaacacccgaaggtgaggtgggcgccattgctctggatttcaagcctgggacttcgggaagcccaatcgtcaacagagaaggcaaaattgtgggtttgtacgggaatggagttgtgaccacgtcaggcacatacgtctccgccatcgcacaggctaaggccagtcaggagggccccctacctgagatagaagacgaggtgtttaggaaacgaaacctgactatcatggatctccacccggggtctggaaagacccggcgctatttaccagcgattgtaagagaagccatcaagaggaaactgcggacacttattctggcacccacccgagtggttgctagcgagatggccgaagctctcaagggtatgcctatcagataccaaactaccgcagtcaaatccgagcatacaggcaaggagatagtggacttgatgtgccacgccacgttcactatgcgcctgctctcaccagtgagggtccccaattataacatgattatcatggatgaagcccattttaccgacccttctagcatcgctgcgcgtgggtacattagtacacgggtaggaatgggcgaggcagccgctatcttcatgaccgccactccgcccggttccgtggaagcatttccacagagcaatgccgttatacaggatgaggaaagagacattcctgagaggtcttggaactcagggtatgagtggatcacagatttccccggaaaaaccgtgtggtttgtcccatccattaagagtggcaatgacatcgctaactgtctgcgcaagaatggcaaacgagtgatacagcttagcagaaagacgttcgatactgaataccagaaaaccaagaacaacgactgggactatgttgtgaccaccgatatttcggagatgggggcgaattttcgggccgacagggtcatcgatcctcgccgttgcctaaaacccgtgatcctgaaggacggaccagaaagagtaattttggcaggtccgatgcctgtgactgttgcttctgccgcacagcggaggggccgcatcgggcgaaaccacaataaggagggagatcagtacatttacatgggccagcccttaaacaatgacgaggatcacgcccattggacagaagctaaaatgctgctcgacaacataaataccccagagggtatcattcccgccctgttcgaacctgagagagaaaagtccgcggcaatcgatggggagtatcggcttaggggcgaggcccgcaaaacattcgtcgaactgatgagaaggggagacctcccagtgtggttgagctacaaggtggcttcagagggctttcaatatagtgatcggcgttggtgcttcgacggggaacgcaacaatcaggtcctggaggaaaacatggatgttgagatctggactaaagagggagaacgaaagaaactaagacccaggtggctggacgcccggacgtactctgaccctctcgcacttcgcgagtttaaggagttcgcagccggtagaaggtccgtgagcggcgatctgattttagagatagggaagttgccgcagcacctgacccagcgggctcaaaatgccctcgacaacctggtaatgcttcataattcagaacagggaggccgagcatatagacacgcgatggaggagctgccagatacaatcgaaactctcatgttgctggccttaattgctgtgctaaccggtggggtcacactgtttttcctcagtggccgcggacttggcaaaaccagcatcgggctgttgtgtgtgatggcctcctctgttctgctctggatggcaagcgtggagccccactggattgctgcctccatcatactggaatttttccttatggtcctcctgatccctgagcccgacaggcagcggactccacaggataaccaattggcatacgtagtgattggactgttatttatgatcctaacggttgccgctaatgagatgggtctgctcgaaaccacaaagaaagaccttggcattgggcatgtggcggtcgagaaccaccatcacgccactatgctggatgtggacttgcatcctgcatcagcttggaccctgtatgccgtcgccacaaccatcataactcccatgatgcgtcacacaattgaaaacacgaccgcaaatatctctctcactgctattgccaaccaggcggctatcctgatgggacttgataagggctggccaataagtaaaatggacatcggtgtgcctttactggccctcgggtgctactcgcaggttaatccgttgacactgaccgcagccgtgctaatgctggtagctcactacgcaattatcggccccggactccaagccaaggcgaccagagaggctcagaagaggacagccgcaggcattatgaaaaacccaactgtggatgggatcgtcgccatagaccttgatcctgttgtgtatgacgctaagttcgaaaaacagctgggacagattatgttgctgatcctctgtacgagccaaatcctgttaatgcgcaccacatgggccctttgcgagtccattactctggcaaccggccccctcacaaccctatgggagggttctccagggaagttttggaatactacgatcgctgtctcaatggccaacatattccggggaagctacctggcgggcgccggtttggcattttccctgatgaaaagtctcggcgggggacgaagaggcacaggggctcagggagaaacccttggcgagaagtggaagaggcagctgaatcagttgtctaaaagcgagttcaacatttataagcgctcaggtatcatggaggtggaccggtccgaagccaaagaggggctgaagagaggagagactacccgtcatgcagtaagtaggggcacagctaaactccggtggttcgtggaacgcaatttagttaagcctgagggtaaggtgattgatctgggctgtgggcgaggaggctggagctactattgcgccgggcttaaaaaggtcactgaagtgaaaggatacaccaagggcggtcccgggcacgaggaaccgatcccaatggccacatatggatggaacctggtcaaactacattctggcaaggacgtgtttttcacgcctcccgagaaatgtgataccctcctgtgcgacataggcgagtcctcaccaaatcccactatcgaagaggggagaacattgagggttctgaagatggtagaaccttggctccggggaaaccaattttgtattaagatccttaatccgtacatgcccagcgtggtcgagaccctggagcagatgcagcgcaaacacggtggcatgttagtgagaaacccactgtcgagaaattctactcacgaaatgtactgggttagttgcgggacaggaaacattgtgtccgcggtcaatatgaccagccgaatgttgctcaaccggttcacgatggctcatcgtaagcctacctatgagagagatgtggacctgggcgcaggtacacgccacgtagccgtggaacccgaggttgctaacctagatatcattgggcagaggatcgaaaatataaaacatgagcacaagtcaacttggcattacgacgaggataacccttataaaacctgggcctaccacggatcctatgaagtcaagccatctggcagcgcaagttccatggtgaatggcgtggtcaaacttctgacaaaaccctgggacgttattcctatggtgactcaaatcgccatgaccgatacaaccccatttgggcagcagcgggtattcaaggagaaagtggacactagaacgcccaaggctaaacgcggaacagcgcaaatcatggaagtcaccgccaggtggctctggggttttctgagccgaaacaagaagccgcggatttgtactagagaggagttcaccaggaaagtgcgctctaatgcagctataggcgccgtttttgtggacgagaaccagtggaactcagcaaaggaggccgtcgaagatgagcgtttctgggacttggtgcagaaagaacgggagctgcacaagcaggggaaatgcgctacatgcgtatacaacatgatgggaaagagagaaaagaaactcggcgagtttggtaaggccaaagggagtagggcgatctggtatatgtggcttggagcacgcttcctggagtttgaagccttaggcttcatgaatgaggatcattggttctcccgagaaaacagcctgtctggcgttgagggggagggattgcacaagctcggttacattctgcgggacatctcgaaaattcctggcgggaatatgtacgctgatgacacggccggatgggataccagaatcactgaagacgatctacaaaacgaggcaaggataacagacatcatggaaccagagcatgcacttctggccacctcaatttttaagctcacttatcagaataaagtggtccgcgtgcagagacccgctaagaacggcacagtgatggatgtcatcagccggagggaccagcgtggttccgggcaagttggaacctacggcctgaatacattcactaacatggaagcccagttgattcgacagatggagagtgagggcatctttttaccttctgaactggagacccagaacctcgcagaacgcgtgcttgattggctggagaagtatggggtagaaagactaaaacggatggcgataagcggagacgactgtgtggtcaagccaattgatgacaggttcgccacggctctgaccgccctcaatgatatgggtaaagtgcgcaaggacatcccccaatgggagccgtccaaaggctggaacgattggcagcaggttcctttttgctcacaccacttccatcagttgatcatgaaggacgggagagagattgtggtcccctgtcggaatcaagatgaactggtgggaagggcacgagtaagtcagggcgctggttggtctcttcgtgagacagcctgcctggggaagtcctacgcacagatgtggcaactcatgtattttcacagacgcgacttacggctggccgcgaacgctatatgttccgccgttccagtggattgggtccctacttcaaggaccacatggagcatccatgcacaccatcagtggatgactaccgaagacatgttgtctgtgtggaatagagtttggattgaggaaaacccctggatggaggataaaacgcacgtgtccagttggggagacgtcccatacctgggcaagcgcgaggaccagtggtgcggcagcctcatcgggcttacagcccgggctacctgggcctcgaatattcaggtggcaatcaaccaagtaaggcgactgataggaaatgaaaactatctagattacatgacttccatgaaaagattcaagaatgagggtgaccccgaaggcgctctgtggtga

SEQ ID NO: 13762 - RNA, 9879 nt, synthetic construct
  misc_feature 1..9879: note = derived and/or modified CDS sequence (opt3) from DENV-1__GQ199785__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagctgtgtgaagatactatgacctacaaatgcccacggataacagaggtggaaccggacgatgtagactgttggtgcaataccactgatacatgggtgacctatgggacgtgtagtcaaactggagagcaccgccgagacaagcgtagcgtcgcgcttgctccccatgtgggcctgggtttggagaccagagccgaaacatggatgtcctctgagggggcatggaaacagatccagaaggttgaaacttgggccctcaggcaccctggattcaccgtgattgctctgtttctggcacatgccatcggcacatcgattacccagaagggcatcatattcatcctcttaatgctggtcacgccatcaatggctatgcggtgcgtggggattggaagccgcgattttgtagagggtcttagtggcgccacttgggttgacgtggtcttggagcacgggtcctgtgtgacaaccatggcgaaagataagcccactctggacatcgaactactcaaaacagaggtgaccaaccctgcagtcctgagaaagctttgcattgaagccaaaatctctaatacgaccacagatagcaggtgtccaactcaaggagaggctaccctggttgaagagcaggacgccaacttcgtgtgccggcgcacatttgtagatcgaggctggggtaatgggtgtggattgttcggcaagggctccctcataacttgcgcaaagtttaaatgcgtgaccaagctggaggggaaaattgtccagtacgaaaacttaaagtattcagtgatcgttacagtgcacaccggagaccagcatcaagtcggtaatgagagtactgaacacggcacgacagctaccattactccccaggcccctaccagcgagatccagctgacagactacggggcgctcacccttgattgttctccaagaactggactggacttcaacgaaatggtgttgctaacaatgaaagagaagtcctggctggtacataaacagtggtttctcgatctgccgcttccctggacgtcaggcgccagcaccagtcaagagacttggaataggcaggacctgttggttacattcaagaccgcacacgctaagaaacaggaagtggtcgtgctcggttctcaagagggggccatgcacacagctctgactggcgccaccgaaatccagacgtccggaaccacaactatttttgcaggccatttaaagtgccggctgaaaatggataagctaaccctcaaagggatgagctatgtcatgtgtacaggatcgttcaagctggagaaggaagtggccgagactcagcacggtaccgttcttgtgcagataaaatacgagggcacggacgctccttgcaagatcccattctctacacaagatgaaaaaggggtaacccagaacggacgtttgattactgcgaatcccatcgtcacagacaaggagaaacctgtgaacatagaagcagagccaccctttggcgagtcctatattgttatcggtgccggggaaaaggctctgaagctctcatggttcaaaaagggcagtagcatcggaaaaatgtttgaggccaccgcacgcggcgccagaaggatggctattctgggggatactgcctgggacttcggatccatcggtggcgtgtttacctctgtcgggaagcttgtgcatcagattttcggaacagcatacggcgtactgtttagcggtgtgtcatggacgatgaaaatagggatcggcgttttgctcacctggctgggattaaatagtcggtccactagcctgtctatgacatgtattgcggtcggcctagtgaccctctacctgggggtgatggtccaggctgattcaggatgcgttatcaactggaagggccgagaacttaagtgtggtagtgggatcttcgtgacaaatgaggtgcacacttggaccgaacaatataaatttcaggccgacagcccgaagcgcttgtccgcagccattggaaaagcttgggaggagggcgtatgcggtataagatctgccacgaggctggaaaacatcatgtggcggcagatttcgaacgagctcaatcatatcctgttagaaaacgacatgaagttcacagtcgtggttggcgatgtggtcgggattctggcacagggaaaaaagatgatccgccctcaacccatggagcacaaatacagctggaagtcctggggcaaggctaaaataatcggggccgacgtgcagaataccacttttattatcgatggaccaaacacccctgaatgtcccgacgatcagagagcgtggaatatttgggaggttgaggactatggcttcggtatctttacaactaacatatggcttaagttgagggattcatacacccaggtgtgcgaccaccgtctcatgagtgccgctattaaagattctaaggcagtacatgccgacatggggtattggatcgaaagcgagaaaaatgaaacatggaagctggctcgggcctccttcattgaggtcaagacgtgtatctggccaaaatcacacaccctatggagcaacggagtgctggaatctgagatgataatccccaagatttacggcggtcctatctcccaacataattatcgaccaggctacttcactcagacagcagggccgtggcacctcggaaaactggagcttgattttgacttgtgcgaaggcaccactgtggtcgttgatgagcactgcgggaacagaggacccagtctgaggacaaccacggtgactggcaagattatccatgaatggtgttgccgcagctgtaccttacctccactccggttcaaaggtgaggacgggtgctggtacggaatggagataagacccgtaaaggaaaaggaggaaaatctggtgaaatctatggtctccgcgggctcaggtgaggtggacagttttagccttggcctgttgtgtatttcgatcatgatcgaagaggttatgaggtcccgctggtctcgaaagatgctcatgacagggaccctggccgtgttctttctactgattatgggacagctcacttggaacgatctgatccggagctgcattatggtcggcgctaatgcctcagaccgtatggggatgggaacaacctatcttgcattgatggctacattcaaaatgagacctatgtttgccgtgggcctgttattcaggcgcctcactagtcgggaggttctgcttctgaccataggtctatccctcgtggcatctgtcgaactgccaaacagcttggaggaactgggggatggattagccatgggcatcatgattctcaagctgcttacggactttcaatcctaccagctgtgggctacattgctctcactgaccttcatcaaaactacctttagcctacactatgcgtggaagacaatggccatggtactgagtattgtgtctcttctccccctgtgtttgtccactaccagccagaagacgacatggctgccggttttactcggctcgctggggtgcaaacctcttaccatgttcctgatcgcagagaataagatatggggaagaaaatcatggccattgaacgaaggtatcatggctgtgggcattgtctctatcctcctgagttccctactgaagaacgatgtgccccttgccgggcctctcattgccggaggcatgctgatcgcttgttacgtaataagcggttctagcgcagacttgtccttagagaaagccgcggaggtgtcatgggaagaggaagctgagcatagtggggccagccacaatattctggtcgaagttcaggatgacggaactatgaagatcaaagatgaggagagggacgatacactcaccatcctgcttaaggcaactctgttggccgtgtctggcgtgtatcccctatccattccagctacactgtttgtctggtacttctggcaaaagaaaaagcagcgatcaggcgtgctctgggacacccctagtcccccagaagttgagcgcgcagtactggatgacgggatatatcggatcatgcagagaggacttttaggtaggagccaggtgggcgtcggggtgttccaagaaaacgtttttcatacgatgtggcacgtgactcgtggagccgtcctgatgtaccagggcaaacgcctcgagccgtcctgggcgtctgtgaagaaagacttgatttcgtacggtgggggatggcggctgcagggcagctggaataccggcgaggaagtacaggtcatcgctgtggagcctgggaagaaccccaagaatgttcaaacagccccaggaaccttcaaaacacccgaaggtgaggtgggcgcaattgccctcgattttaagcctgggacttcaggatccccaatcgtcaacagagaaggcaaaatagtgggtctgtatgggaatggagttgtgaccacgagtggcacatacgtctctgctatcgcccaggcaaaggctagccaggagggcccccttcctgagattgaagacgaggtgttcaggaaacgaaacctgactatcatggatttgcacccggggtccggaaagacccggcgctatctaccagccattgtaagagaagcgatcaagaggaaactgcggacactcatattagcccccacccgagtggttgcatcagagatggctgaagccctgaagggtatgcctattagataccaaactaccgctgtcaaatctgagcatacaggccgcgagatcgtggaccttatgtgccacgcaacgtttactatgaggctgctcagcccagtgcgtgtccccaattataacatgatcattatggatgaagcccatttcaccgaccctagttccatcgccgctcgggggtacataagcacaagagtaggaatgggcgaggcggcagccatttttatgaccgctactccgcccggttctgtggaagccttcccacagtcaaatgcagttatccaggatgaggaaagggacattcctgagcgctcctggaacagtgggtatgagtggatcacagattttcccggaaagaccgtgtggttcgtcccaagcataaaatcgggcaatgacattgccaactgtttgcgaaagaatggcaagagagtgatccagctgtctcggaaaacgtttgatactgaataccaaaagacaaaaaacaacgactgggactacgttgtgaccaccgatatctccgagatgggggctaatttcagggcggaccgcgtcattgatcctcgtagatgcctcaagcccgtgatcctgaaagacggaccagaacgggtaattcttgccggtccgatgcctgtgactgttgcaagcgctgcccagaggcgcggccgaatagggagaaaccacaataaggagggagatcagtatatctacatgggccagcccctaaacaatgacgaggatcatgcacactggacagaagccaagatgctgttggacaacattaataccccagagggtatcatccccgctttattcgaacctgagcgggaaaaatcagccgcgattgatggggagtataggctgcgcggcgaggcaagaaagacatttgtcgaactcatgaggcggggagacctgccagtgtggcttagttacaaagtggcctctgagggcttccaatattccgatcgtcgctggtgctttgacggggaacgaaacaatcaggtcctggaggaaaacatggatgttgagatatggactaaggagggagaaagaaaaaagctcaggccccggtggttggacgctcgcacgtacagcgaccctctggccctaagagagttcaaagaatttgctgcaggtaggcggtcagtgagtggcgatctgatcctcgagattgggaagcttccgcagcacctgacccagcgagcccaaaatgctttagacaacttggtaatgctgcataatagcgaacagggaggcagagcctatcgccacgcaatggaggagctcccagatacaatcgaaactctgatgcttctggcgctcattgccgtgttgaccggtggggtcacactgttctttttatccggcaagggactaggcaaaacctctatcgggctgctctgtgtgatggctagctccgcccttctgtggatggcatcagttgagccccattggatagctgcctctatcattttggaattctttctgatggtgctcctgatccctgagcccgacaggcagcggactccacaggataaccaacttgcatacgtcgtaattggactcctgttcatgatcttgacggtggccgctaatgagatgggtctgttagaaaccacaaagaaagacctaggcatagggcacgttgcggtggagaaccaccatcacgccactatgctggatgtcgacctccatcctgcaagtgcttggaccctttacgccgtggccacaaccattatcactcccatgatgcgtcacacaattgaaaacacgaccgcaaatatctcgctgactgctatagccaaccaggcggctatcttgatgggactggataagggctggccaattagcaaaatggacatcggtgtccctctcctggcccttgggtgctattcccaggtgaatccgttaacactgaccgcagccgttctcatgttggtggctcattacgcaattatcggccccggactgcaagccaaggcgaccagagaggctcagaagaggacagccgcaggcataatgaaaaacccaactgtagatgggattgtggccatcgacctagatcctgtcgtttatgacgctaagtttgaaaaacagctgggacagatcatgctccttattctgtgtacgtctcaaatcttgctgatgcgcaccacatgggccctctgcgagtcaataactctggcaaccggccccttaacaaccctttgggagggtagcccagggaagttctggaatactacgattgctgtgtccatggccaacatctttcggggaagttacctggcgggcgccggtctcgcattctctctaatgaaaagcctgggcgggggacgaagaggcacaggggctcagggagaaaccttgggcgagaagtggaagaggcagctgaatcagctctcaaaatccgaattcaacacttataagcgcagtggtattatggaggtcgaccggagcgaagccaaagaggggcttagacgtggagagaccacaaagcacgcagtgtctaggggcactgctaaactgcggtggtttgtagaacgcaatttggtgaagcctgagggtaaggttatcgatctgggctgtgggcgaggaggctggtcctactattgcgccgggctcaaaaaggtgaccgaagtcaaaggatacacaaagggcggtcccgggcacgaggaaccgataccaatggccacgtacggatggaacttagtgaaactgcattcaggcaaggacgtcttctttatccctcccgagaaatgtgatacccttctgtgcgacattggcgagagctcgccaaatcccactatcgaagaggggagaacactaagggtgctcaagatggttgaaccttggctgcggggaaaccaattctgtattaagatcttgaatccgtatatgccctctgtagtggagaccctggagcagatgcagcgcaaacacggtggcatgctcgtcagaaacccacttagtaggaattccactcatgaaatgtactgggtgagctgcgggacaggaaacattgtttcagcggtgaatatgacctcccgaatgctgttaaaccggtttacgatggctcaccgtaagcctacctatgagagagatgtcgacctgggcgcaggtacacgccacgtggccgtagaacccgaggtggctaacttggatatcatagggcagaggattgaaaatatcaaacatgagcacaagtctacttggcattacgacgaggataacccttataaaacctgggcctaccacggaagctatgaagttaagccaagtggctccgcaagctctatggtcaatggcgtggtgaagctcctgacaaaaccctgggacgtcatccctatggttactcaaattgccatgaccgatacaaccccattcgggcagcagcgggtgtttaaggagaaagtagacactagaacgcccaaggctaaacgcggaacagcgcaaataatggaagtgaccgccaagtggctatggggtttcctttcaaggaacaagaaaccgcgaatctgtactcgggaggaatttaccagaaaggtcaggagtaatgcagctattggcgccgtgttcgttgacgagaaccagtggaattccgcaaaagaggccgtggaagatgagcgcttttgggacctggtccatcgtgaacgggagctccacaagcaggggaaatgcgctacatgcgtgtacaacatgatgggaaagagagaaaagaaactgggcgagttcggtaaggccaaagggagcagggcgatctggtacatgtggttgggagcacgctttctggagttcgaagccctcggcttcatgaatgaggatcactggttttctcgagaaaactcgctttcaggcgtagagggggagggactgcataagttaggttatattctgcgggacatcagcaaaatacctggcgggaatatgtacgctgatgacacggccggatgggataccagaatcactgaagacgatttgcagaacgaggcaaagattacagacatcatgaaaccagaacacgctctcctggccacctccattttcaagctaacttatcaaaataaggttgtgagggtccagcgccccgctagaaacggcacagtgatggatgtgatcagtcggagggaccagcgtggttctgggcaggtcggaacctacggccttaatacatttactaacatggaggcccaactgatacgacagatggaaagcgagggcattttctccccttcagagctcgaaaccccaaacctggcagagcgcgttttggattggttagaaaaacatggggtggagagactgaagcggatggcgatcagtggagacgactgtgtagtgaaacccatcgatgacaggtttgccacggctctctctgcccttaatgatatgggtaaggtccgcaaagacattccgcagtgggaacctagcaagggctggaacgattggcagcaagtgcccttctgctcccaccactttcatcagctgataatgaaggacgggagagagatcgttgtgccatgtcggaatcaggatgagctagtcggaagggcacgagtgtcacagggcgctggttggagcctgcgtgaaaccgcctgcctcgggaaatcttatgcacaaatgtggcagttgatgtacttccacagacgcgacctgcggcttgccgcgaacgctatttgttccgccgtacctgttgattgggtgcccacaagtaggactacctggagcatccatgcacaccatcagtggatgacaactgaggacatgctgtcggtctggaatagagtgtggattgaagagaacccatggatggaagataagacccacatctcctcttggggagacgttccctatctcggcaaacgcgaggaccaatggtgcggctcattaatagggctgacggcccgggctacatgggccaccaatatccaggtggcaattaaccaggtcaggcgattgatcggaaatgagaactacctggattacatgactagcatgaagagatttaaaaatgaaagtgaccctgagggtgctctctggtga

SEQ ID NO: 13763 - RNA, 9879 nt, synthetic construct
  misc_feature 1..9879: note = derived and/or modified CDS sequence (opt3) from DENV-1__GQ199786__SS-prME
  source 1..9879: mol_type = other RNA
agcgtgaccatgctgctcatgcttatgcccacggccctggctttccacttgactacgagaggaggggaacctcatatgatcgtctccaagcaggaaagaggaaaatctttactgtttaagacctcagccggtgttaatatgtgcacactaattgccatggacctcggcgaactgtgtgaagatactatgacctacaaatgcccacggataacagagaccgaaccggacgatgtggactgttggtgcaatgcgactgatacatgggtgacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccgggagcttcaaactggagaaggaagtcgccgagacgcagcacggtacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattgtgatcggtgccggggaaaaagctctgaagctctcctggttcaagaaaggctcaagtatcggaaagatgtttgaggccaccgcaagaggcgccaggcggatggctattctgggggatacagcctgggacttcggaagcatcggtggcgtttttacgtccgtggggaaacttgtccatcagattttcggaaccgcatacggcgtgctgttttctggtgtaagctggactatgaagatagggatcggcgtgttgctcacatggctgggattaaattcacgaagtacctccctgagcatgacatgtattgcggttggcctagtcactctctacctgggggtgatggtgcaggctgattctggatgcgtcatcaactggaaaggccgcgaacttaagtgtggttcagggatcttcgttaccaatgaggtgcacacgtggacagaacaatataagtttcaggccgacagtccgaaaagattgagcgcagccattggaaaggcttgggaggagggcgtgtgcggtataaggtccgccacccggctggaaaacatcatgtggaaacagatttctaacgagctcaatcatatcctgttagaaaacgacatgaagttcactgtagtcgtgggcgatgttgcagggattctggctcagggcaaaaagatgatccgccctcaacccatggagtacaaatattcgtggaaaagctggggcaaggccaagataatcggggcggacgtgcagaataccacatttattatcgatggaccaaacactcctgaatgtcccgacgatcagagagcctggaatatttgggaggtcgaggactacggcttcggtatctttaccacaaacatatggcttaagttgagggattcctatacacaggtgtgcgaccaccgtctcatgtcagctgcaattaaagatagtaaggccgttcacgctgacatggggtactggatcgaatctgagaaaaatgaaacctggaagctggcccgggcatccttcattgaggtgaagacttgtatctggccaaaatcccatacactatggtcaaacggagtactggaaagcgagatgataatccccaagatttatggcggtcctatctctcaacacaattaccgaccaggctacttcacccagactgcggggccgtggcatctcggaaaactggagcttgattttgacttgtgcgaaggcacaaccgtcgtggtggatgagcactgcgggaacagaggaccctccctgaggacgactaccgtcacaggcaagattatccacgaatggtgttgccgcagttgtaccttacctccactccggttcagaggtgaggacgggtgctggtatggaatggagataaggcccgttaaagaaaaggaggaaaatctggtaaagagcatggtatctgccggctccggtgaggtggactcatttagtcttggcctgttgtgtattagcatcatgatcgaagaggtcatgcgctcgcgatggtcccggaaaatgctcatgactgggacactggctgtgttctttctactgattatgggacagctcacctggaacgatctgatccgtctttgcattatggttggcgccaatgcatctgacagaatggggatgggaacaacttacttggctctgatggccaccttcaagatgaggcctatgtttgcagtgggcttactcttccgccggctgacgagcagagaggtccttctgctaacaataggtctctcactggtggccagtgttgaattgccaaactccctggaggaattaggggatggactcgctatgggcatcatgattctgaaacttctgaccgactttcaatctcatcagttgtgggcgactctcctgagcctaaccttcatcaagacaactttttccctgcactatgcctggaaaaccatggcaatggtgctttcaattgtcagcctcttccccctgtgtttgagtacgacatctcagaagaccacttggctgccggtattactcggctccctggggtgcaagcctcttacaatgtttctgatcgctgagaataaaatatggggaaggcgaagctggccattgaacgaaggtatcatggccgtgggcattgtttcgatcctcctgtcatctctactgaagaacgatgtgccccttgccgggcctctcattgctggaggcatgctgatcgcatgttacgtcataagtggttccagcgccgacttgtctttagagaaagcggctgaggtgagctgggaagaggaagccgagcattccggggcatcacacaatattctggtagaagtgcaggatgacggaaccatgaagatcaaagatgaggagcgcgacgatactctcacaatcctgcttaaggccaccctgttggctgtcagtggcgtttatcccctaagcattccagcaacgctgttcgtgtggtacttctggcagaaaaagaagcagcggtctggcgtgctctgggacactccttcacccccagaagtcgagagagccgtgctggatgacgggatatataggatcatgcagcgtggacttttaggtcgcagccaggttggcgtaggggtgtttcaagaaaacgtcttccataccatgtggcacgtgacacggggagcggttctgatgtaccagggcaaaagactcgagccgagttgggctagcgtgaagaaagacttgatttcctacggtgggggatggaggctgcagggctcttggaataccggcgaggaagtccaggtgatcgccgtagagcctgggaagaaccccaaaaatgtccaaacagcaccaggaacttttaagacccccgaaggtgaggtgggcgccattgctctcgatttcaagcctgggacgtcgggaagcccaatcgttaaccgagaaggcaaaatagtgggtctgtatgggaatggagtcgtgacaacttcaggcacctacgtttccgccatcgcacaggctaaggccagtcaggagggcccccttcctgagattgaagacgaggtgtttcggaaacgcaacctgacaatcatggatttgcacccggggtctggaaagaccagaaggtatctaccagcgattgtccgggaagccatcaaacgaaagctgagaactctcatattagcacccacccgcgtggtagctagcgagatggccgaagctctgaagggtatgcctattaggtaccaaacaacggcagtgaaatccgagcatactggcaaggagatcgttgaccttatgtgccacgccaccttcacaatgcgtctgctctcaccagtccgggtgcccaattataacatgatcattatggatgaagcccattttaccgacccttctagcatcgctgcgagagggtacataagtactagggtgggaatgggcgaggcagccgctattttcatgacagccaccccgcccggttccgtcgaagcatttccacagagcaatgccgtaatccaggatgaggaacgcgacattcctgagcgatcttggaactcagggtatgagtggatcacggatttccccggaaaaactgtgtggtttgttccatccataaagagtggcaatgacattgctaactgtttgaggaaaaatggcaagcgggtgatccagctgagcaggaagacattcgataccgaataccagaaaaccaagaacaacgactgggactacgtcgtgactacagatatctcggagatgggggcgaatttccgcgccgaccgtgttattgatcctagacggtgcctcaaacccgtgatcctgaaggacggaccagaaagggtcattcttgcaggtccgatgcctgtgaccgtagcttctgccgcacagcgccgaggcagaatagggcggaaccacaataaagagggagatcagtatatctacatgggccagcccctaaacaatgacgaggatcatgcccactggacagaagctaagatgctgttggacaacattaatactccagagggtatcatccccgccttatttgaacctgagagggaaaagtccgcggcaattgatggggagtatcgcctgagaggcgaggccaggaaaacgttcgtggaactcatgcggcgtggagacctgccagtttggcttagctacaaggtcgcttcagagggctttcaatatagtgatcgccgatggtgcttcgacggggaaagaaacaatcaggtgctggaggaaaacatggatgtggagatatggaccaaagagggagaaaggaagaaactccggccccgctggttggacgccagaacatactctgaccctctggctctaagggagtttaaggagttcgcagccggtcggcgatccgtcagcggcgatctgatcctcgagattgggaaacttccgcagcacctgactcagagagctcaaaatgccttagacaacttggttatgctgcataattcagaacagggaggccgcgcatataggcacgcgatggaggagctcccagataccatcgaaacactgatgcttctggccctcattgctgtgttgaccggtggggtaatcctgtttttcttaagtggccggggactaggcaagactagcatagggctgctctgtgtgatggcctcctctgtccttctgtggatggcaagcgtggagccccattggatcgctgcctccattatcttggaatttttcctgatggttctcctgattcctgagcccgaccgtcagagaacgccacaggataaccaacttgcatacgtggtcatcggactcctgtttatgatattgaccgtagccgctaatgagatgggtctgttagaaacaactaagaaagacctaggcattgggcacgtggcggttgagaaccaccatcacgccgcaatgctggatgtggacctccatcctgcttcagcctggaccctttacgccgtcgcaacaaccatcattactcccatgatgaggcacacaatcgaaaacacgaccgctaatatatctctgactgccatcgcgaaccaggctgccattttgatgggactggataagggctggccaatcagtaaaatggacattggtgtgcctctcctggcacttgggtgctattcgcaggtcaatccgttaacactgaccgccgctgtgctcatgttggttgcacattacgccatcataggccccggactgcaagcgaaggctacccgcgaggcccagaaacggacagcagccggcattatgaagaacccaactgtggatgggatcgtagctatcgacctagatcctgtggtctatgacgccaagttcgaaaaacagctgggacagattatgctccttatcctgtgtacgagccaaatattgctgatgcgaaccacatgggcactctgcgagtccattactctggctaccggccccttaacaaccctttgggagggttctccagggaagttttggaatactacgatcgccgtttcaatggcgaacattttcagaggaagctacctggccggcgcaggtctcgctttctccctaatgaaaagtctgggcgggggaaggcgcggcacaggggcccagggagaaaccttgggcgagaagtggaaacggcagctgaatcagctctctaagagcgaatttaacacttataagagatcaggtatcatggaggtggaccgttccgaagcaaaagaggggcttaagaggggagagaccacaaaacacgctgtcagtcggggcactgccaagctgcgctggttcgtggaacgaaatttggtaaaacctgagggtaaggtgatagatctgggctgtgggagaggaggctggagctactattgcgccgggctcaagaaagttaccgaagtgaagggatacacaaaaggcggtcccgggcacgaggaaccgatcccaatggcgacgtacggatggaacttagtcaagctgcattctggcaaagacgtgtttttcattcctcccgagaagtgtgatacccttctgtgcgacatcggcgagtcctcaccaaatcccactattgaagaggggaggacactacgggtcctcaaaatggtggaaccttggctgcgcggaaaccaattttgtatcaagattttgaatccgtatatgcccagcgttgtagagaccctggagcagatgcagagaaagcacggtggcatgctcgtgaggaacccactttcgcgaaattctactcatgaaatgtactgggtcagttgcgggacaggaaacatcgtgtccgctgttaatatgaccagccggatgctgttaaaccgtttcacgatggcacacagaaaacctacctatgagcgcgatgtggacctgggcgccggtacaaggcacgtcgctgtggaacccgaggtagccaacttggatataattgggcagcggatcgaaaatatcaagcatgagcacaaatcaacttggcattacgacgaggataacccttataagacctgggcataccacggatcctatgaagtgaaaccatctggcagcgccagttccatggttaatggcgtcgtgaagctcctgacaaagccctgggacgtgattcctatggtcactcaaatagctatgaccgatacaaccccatttgggcagcagagagttttcaaagagaaggtggacactcgcacgcccaaagcgaagaggggaacagcccaaatcatggaagtaaccgcaaaatggctatggggttttcttagccgaaacaagaagccgcggatttgtactagagaggagttcaccaggaaagtgcgctctaatgctgccatcggcgcagtctttgtggacgagaaccagtggaactcagccaaggaggctgttgaagatgagcgtttctgggacctggtgcatcgggaaagagagctccacaaacaggggaagtgcgccacatgcgtctacaacatgatgggaaaaagggaaaagaagctgggcgagtttggtaaagcgaaggggagtcgcgcaatttggtacatgtggttgggagcccgattcctggagttcgaagctctcggctttatgaatgaggatcactggttctcccgggaaaacagcctttctggcgtggagggggagggactgcataaattaggttatatcctgagagacatatcgaagatccctggcgggaatatgtacgccgatgacacggcaggatgggataccaggattactgaagacgatttgcagaacgaggctcgcatcacagacattatggaaccagagcacgccctcctggctagatcaatctttaaactaacctatcaaaataaggtagttcgggtgcagaggcccgccaaaaacggcactgtcatggatgtgataagccgtcgagaccagcgcggttccggacaggtgggaacatacggccttaataccttcacaaacatggaagcacaactgattagacagatggagagtgagggcatcttttctcctagcgaactcgagactccaaacctggcggaacgggtcttggattggttagagaagtatggggttgaaaggctgaagcgcatggccatctccggagacgactgtgtggtaaaacccattgatgacagattcgctaccgccctcacggcacttaatgatatgggtaaggtgcggaaagacataccgcagtgggagccttcaaagggctggaacgattggcagcaagtccccttttgcagtcatcacttccaccagctgatcatgaaagacgggagggagattgtggttccatgtcgaaatcaggatgagctagtgggacgtgctagagtctctcagggcgccggttggagcctgcgcgagaccgcatgcctcgggaagtcctacgcccaaatgtggcagttgatgtattttcatcggagggacctgagacttgcggctaacgccatctgttcagcagtgcctgtagattggattcccacaagccgcactacctggtctatccacgcccatcaccagtggatgacaactgaagacatgctgtccgtttggaatcgggtgtggatagaggaaaacccatggatggaggataagacccatatcagtagctggggagacgtcccctacctcggcaaaagggaggaccaatggtgcggctcgttaattgggctgacggctcgagccacatgggcaaccaatatccaggtggctattaaccaggttagacggttgatcggaaatgaaaactacctggattatatgacttccatgaagaggttcaaaaatgagtctgaccctgaaggtgccctctggtga

SEQ ID NO: 13764 - RNA, 9879 nt, synthetic construct
  misc_feature 1..9879: note = derived and/or modified CDS sequence (opt3) from DENV-1__GQ199787__SS-prME
  source 1..9879: mol_type = other RNA
agcgtgaccatgctgctcatgcttgtccccacagccctggctttccacttgactacgaggggaggggaacctcatatgatcgttaccaagcaggaaaggggaaaatccttactgtttaagacatctgctggtgtgaatatgtgcactctaattgccatggacctcggcgaactgtgtgaagataccatgacatacaaatgcccacggataaccgaggcggaaccggacgatgtagactgttggtgcaatgctactgatacatgggtgacctatgggacgtgttcacaaactggagagcaccgccgagacaagcgtagtgtcgcccttgcaccccatgtgggcctgggtttggagaccagaacagaaacttggatgagctccgagggggcctggaaacagatccagagggttgaaacctgggctctccggcaccctggattcacagtgattgcactgtttctggcccatgctatcggcacctctattacgcagaagggcatcatattcatcctcttaatgctggtcactccatcgatggccatgcgctgcgtggggattggatcaagagattttgtagagggtcttagcggcgcgacatgggttgacgtggtcttggagcacgggagttgtgtgaccactatggcaaaggataaacccacactggacatcgaactactcaagaccgaggtgacgaaccctgccgtcctgaggaaactttgcattgaagctaagatctccaataccacaactgattctcggtgtccaacccaaggagaggccacactgatggaagaacaagacgcaaacttcgtttgccgccgaacttttgtggatagaggctggggtaatgggtgtggattgttcggcaaaggcagcctcataacctgcgctaagtttaagtgcgtaacaaaactggaggggaagattgtgcagtacgaaaacttaaaatattccgtcatcgtgaccgttcacactggagaccagcatcaagtgggtaatgagtcaacggaacacggcacaaccgccactattacaccccaggcgcctacaagtgagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatgtgtactggtagcttcaaactggagaaggaagtcgctgagacccagcacggaacggtgcttgttcagataaagtacgagggcacagacgcgccttgcaaaatcccattctcgacccaagatgaaaagggggtgattcagaacggacgcttgatcactgcaaatcccatagtaacagacaaagagaagcctgtcaacattgaagccgagccaccctttggcgagtcttatatcgtgatcggtgttggggaaaaagctctgaagctctcctggttcaagaaaggctcaagtattggaaagatgtttgaggccaccgcaagaggcgccaggcggatggctatcctgggggatactgcctgggacttcggaagcattggtggcgtgtttacctccgtcgggaaacttgtgcatcagatattcggaacagcatacggcgtactgttttctggtgtgagctggacgatgaagatcgggattggcgttttgctcacctggctgggattaaattcacgaagtacttccctgagcatgacatgtatcgcggtcggcctagtgaccctctacctgggggtgatggtccaggctgattctggatgcgttatcaactggaaaggccgcgaacttaagtgtggttcagggattttcgtgacaaatgaggtgcacacttggaccgaacaatataagtttcaggccgacagtccgaaaagattgagcgcagccataggaaaggcttgggaggagggcgtatgcggtatcaggtccgccacgcggctggaaaacattatgtggaaacagatctctaacgagctcaatcatattctgttagaaaacgacatgaagttcacagtcgtggttggcgatgtggtcgggatcctggcacagggcaagaagatgatacgccctcaacccatggagcacaaatactcgtggaaaagctggggcaaggctaagatcattggggccgacgtgcagaataccacttttatcattgatggaccaaacacccctgaatgtcccgacgatcagagagcgtggaatatctgggaggttgaggactatggcttcggtatatttacaactaacatttggcttaagttgagggattcctacacccaggcctgcgaccaccgtctcatgtcagctgcaatcaaagatagtaaggccgtgcatgctgacatggggtattggattgaatctgagaaaaatgaaacatggaagctggcccgggcttccttcatcgaggtaaagacgtgtatatggccaaaatcccacaccctatggtcaaacggagtcctggaaagcgagatggtgatccccaagatttacggcggtcctatctctcaacataattatcgaccaggctacttcactcagacagcggggccgtggcacctcggaaaactggagcttgattttgacttgtgcgaaggcaccactgtggtcgttgatgagcactgcgggaacagaggaccctccctgaggacaaccacggtgactggcaagattatccatgaatggtgttgccgcagttgtaccttacctccactccggttcaaaggtgaggacgggtgctggtacggaatggagataagacccgtaaaggaaaaggaggaaaatctggtgaaaagcatggtctctgccggctccggtgaggtggactcatttagtcttggcctgttgtgtattagcatcatgatcgaagaggttatgaggtcgcgctggtcccgaaagatgctcatgacagggaccctggctgtgttcctactgctcattatgggacagctgacttggaacgatcttatccggttgtgcattatggtcggcgccaatgcatctgaccgtatggggatgggaacaacctatctggctttaatggccacatttaaaatgagacctatgttcgcagtgggcctcctgtttaggcgccttactagccgggaggttctgctactcaccataggtctgtcattggtggccagtgtcgaactgccaaactccttagaggaactcggggatggactggctatgggcatcatgattcttaagctgttgacggacttccaatctcaccagctctgggcgacactgctaagcctgacctttatcaaaactaccctttccctccattacgcctggaagacaatggcaatggtactgtcaattgtgagcttgttccccctgtgtttaagtactacctctcagaagacgacatggctcccggttctgcttggctccctggggtgcaaacctttgaccatgtttctcatcgctgagaataagatatggggaagaaaaagctggccactgaacgaaggtatcatggccgtgggcgtcgtgtcgattctactgtcatctcttctcaagaacgatgtacccctggccgggcctttgatcgctggaggcatgttaattgcatgttatgtgatcagtggttccagcgccgacctgtctctcgagaaagcggctgaggtcagctgggaagaggaagccgagcactccggggcatcacataatatactggttgaagtgcaggatgacggaactatgaagattaaagatgaggagagggacgatacacttaccatcctgttgaaggccactctactggctgtgagtggcgtctaccccctcagcatcccagcaacactgttcctttggtatttttggcaaaagaaaaagcagcgatctggcgtgttatgggacaccccttcacccccagaagttgagcgcgccgtactggatgacgggatttaccggataatgcagagaggactcttgggtaggagccaggtgggcgtcggggtgttccaagaaaacgttttccacacgatgtggcacgtgactcgtggagcggtcctgatgtatcagggcaaacgcctcgagccgagttgggctagcgtgaagaaagacctgatctcctacggtgggggatggcggcttcagggctcttggaataccggcgaggaagtacaggtcattgccgtggagcctgggaagaaccccaagaatgttcaaacagcaccaggaacctttaaaacacccgaaggtgaggtgggcgccatcgctctggatttcaagcctgggacttcgggaagcccaattgtcaacagagaaggcaaaatcgtgggtttgtacgggaatggagttgtgaccacgtcaggcacatatgtctccgccatagcacaggctaaggccagtcaggagggccccctacctgagatcgaagacgaggtgtttaggaaacgaaacctgactattatggatctccatccggggtctggaaagacccggcgctacttaccagcgatcgtaagagaagccattaagaggaaactgcggacacttatcctggcacccacccgagtggttgctagcgagatggccgaagctctcaagggtatgcctataagatatcaaactaccgcagtcaaatccgagcacacaggcaaggagattgtggacttgatgtgccatgccacgttcactatgcgcctgctctcaccagtgagggtccccaattacaacatgatcatcatggatgaagcccactttaccgacccttctagcattgctgcgcgtgggtatatcagtacacgggtaggaatgggcgaggcagccgctatattcatgaccgccactccgcccggttccgtggaagcatttccacagagcaatgccgttattcaggatgaggaaagagacatccctgagaggtcttggaactcagggtacgagtggattacagatttccccggaaaaaccgtgtggtttgtcccatccatcaagagtggcaatgacatagctaactgtctgcgcaagaatggcaaacgagtgattcagcttagcagaaagacgttcgatactgaatatcagaaaaccaagaacaacgactgggactacgttgtgaccaccgatatctcggagatgggggcgaattttcgggccgacagggtcatcgatcctcgccgttgcctaaaacccgtgattctgaaggacggaccagaaagagtaatcttggcaggtccgatgcctgtgactgttgcttctgccgcacagcggaggggccgcattgggcgaaaccataataaggagggagatcagtacatatatatgggccagcccttaaacaatgacgaggatcacgcccactggacagaagctaaaatgctgctcgacaacatcaataccccagagggtattatccccgccctgttcgaacctgagagagaaaagtccgcggcaatcgatggggagtaccggcttaggggcgaggcccgcaaaacattcgtcgaactgatgagaaggggagacctcccagtgtggttgagctataaggtggcttcagagggctttcaatacagtgatcggcgttggtgcttcgacggggaacgcaacaatcaggtcctggaggaaaacatggatgttgagatttggactaaagagggagaacgaaagaaactaagacccaggtggctggacgcccggacgtattctgaccctctcgcacttcgcgagtttaaggagttcgcagccggtagaaggtccgtgagcggcgatctgatattagagatcgggaagttgccgcagcatctgacccagcgggctcaaaatgccctcgacaacctggtaatgcttcacaattcagaacagggaggccgagcatacagacatgcgatggaggagctgccagatacaattgaaactctcatgttgctggccttaatcgctgtgctaaccggtggggtcacactgtttttcctcagtggccgcggacttggcaaaaccagcattgggctgttgtgtgtgatggcctcctctgttctgctctggatggcaagcgtggagccccactggatcgctgcctccataatcctggaatttttccttatggtcctcctgattcctgagcccgacaggcagcggactccacaggataaccaattggcatatgtagtgatcggactgttatttatgattctaacggttgccgctaatgagatgggtctgctcgaaaccacaaagaaagaccttggcatcgggcacgtggcggtcgagaaccatcaccatgccactatgctggatgtggacttgcaccctgcatcagcttggaccctgtacgccgtcgccacaaccataattactcccatgatgcgtcatacaatcgaaaacacgaccgcaaatatttctctcactgctatcgccaaccaggcggctatactgatgggacttgataagggctggccaatcagtaaaatggacattggtgtgcctttactggccctcgggtgctactcgcaggttaatccgttgacactgaccgcagccgtgctaatgctggtagctcactatgcaatcattggccccggactccaagccaaggcgaccagagaggctcagaagaggacagccgcaggcatcatgaaaaacccaactgtggatgggatagtcgccattgaccttgatcctgttgtgtacgacgctaagttcgaaaaacagctgggacagatcatgttgctgatcctctgtacgagccaaattctgttaatgcgcaccacatgggccctttgcgagtccatcactctggcaaccggccccctcacaaccctatgggagggttctccagggaagttttggaatactacgatagctgtctcaatggccaacattttccggggaagctatctggcgggcgccggtttggcattttccctgatgaaaagtctcggcgggggacgaagaggcacaggggctcagggagaaacccttggcgagaagtggaagaggcagctgaatcagttgtctaaaagcgagttcaacatctacaagcgctcaggtattatggaggtggaccggtccgaagccaaagaggggctgaagagaggagagactacccgtcacgcagtaagtaggggcacagctaaactccggtggttcgtggaacgcaatttagttaagcctgagggtaaggtgatcgatctgggctgtgggcgaggaggctggagctattactgcgccgggcttaaaaaggtcactgaagtgaaaggatataccaagggcggtcccgggcatgaggaaccgataccaatggccacatacggatggaacctggtcaaactacactctggcaaggacgtgtttttcacgcctcccgagaaatgtgataccctcctgtgcgacatcggcgagtcctcaccaaatcccactattgaagaggggagaacattgagggttctgaagatggtagaaccttggctccggggaaaccaattttgtatcaagattcttaatccgtacatgcccagcgtggtcgagaccctggagcagatgcagcgcaaacatggtggcatgttagtgagaaacccactgtcgagaaattctactcacgaaatgtattgggttagttgcgggacaggaaacatcgtgtccgcggtcaatatgaccagccgaatgttgctcaaccggttcacgatggctcaccgtaagcctacctacgagagagatgtggacctgggcgcaggtacacgccatgtagccgtggaacccgaggttgctaacctagatattatcgggcagaggatagaaaatattaaacacgagcataagtcaacttggcactatgacgaggataacccttacaaaacctgggcctatcatggatcctacgaagtcaagccatctggcagcgcaagttccatggtgaatggcgtggtcaaacttctgacaaaaccctgggacgttatccctatggtgactcaaatcgccatgaccgatacaaccccatttgggcagcagcgggtattcaaggagaaagtggacactagaacgcccaaggctaaacgcggaacagcgcaaattatggaagtcaccgccaggtggctctggggttttctgagccgaaacaagaagccgcggatatgtactagagaggagttcaccaggaaagtgcgctctaatgcagctatcggcgccgtttttgtggacgagaaccagtggaactcagcaaaggaggccgtcgaagatgagcgtttctgggacttggtgcagaaagaacgggagctgcacaagcaggggaaatgcgctacatgcgtatataacatgatgggaaagagagaaaagaaactcggcgagtttggtaaggccaaagggagtagggcgatttggtacatgtggcttggagcacgcttcctggagtttgaagccttaggcttcatgaatgaggatcactggttctcccgagaaaacagcctgtctggcgttgagggggagggattgcataagctcggttacatcctgcgggacatttcgaaaatccctggcgggaatatgtatgctgatgacacggccggatgggataccagaataactgaagacgatctacaaaacgaggcaaagatcacagacattatggaaccagagcacgcacttctggccacctcaatctttaaactcacttaccagaataaggtggtcagggtgcagcgccccgctaagaacggcacagtgatggatgtcattagcagacgggaccagaggggttccgggcaagttggaacctatggcctgaatacattcactaacatggaagcccagttgatccgtcagatggagagtgagggcatatttttaccttctgaactggagaccccaaacctcgcagaacgagtgcttgattggctggagaaacatggggtagaacgcctaaagagaatggcgattagcggagacgactgtgtggtcaaacccatcgatgaccggttcgccacggctctgaccgccctcaatgatatgggtaaggtgaggaaagacatcccgcagtgggagccttccaagggctggaacgattggcaacaggttcccttttgctcacaccacttccatcagttgattatgaaggacgggcgcgagatagtggtcccatgtagaaatgaagatgagctggtgggacgggcaagggtaagtcagggcgctggttggtctcttcgagaaacagcctgcctggggaaaagctacgcacaaatgtggcagctcatgtattttcaccgtagagacttacgcctggccgcgaacgctatctgttccgccgttcctgtggattgggtccccacttcacggaccacatggagcattcatgcacaccatcagtggatgactaccgaggacatgttgtctgtgtggaatagggtttggatcgaagagaacccatggatggaggataagacgcacgtgtccagttggggagacgtcccctacctgggcaaaagagaagaccaatggtgcggcagcctcattgggcttacagcccgcgctacctgggcctcgaatatccaggtggcaataaaccaggtacggaggctgatcggaaatgagaactatctagattacatgacttccatgaagcgattcaaaaatgaaggtgaccctgagggcgctctgtggtga

SEQ ID NO: 13765 - RNA, 9879 nt, synthetic construct
  misc_feature 1..9879: note = derived and/or modified CDS sequence (opt3) from DENV-1__GQ199788__SS-prME
  source 1..9879: mol_type = other RNA
agcgtgaccatgctgctaatgcttatgcccaccgcactggctttccacttgactacgagaggcggggaacctcatatgatcgtctccaagcaggaaagggggaaatctttactgtttaagacctcagccggtgttaacatgtgcacactaattgcaatggacctcggcgagttctgtgaagatactatgacctacaaatgcccacggataacagaggcggaaccggacgatgtggactgttggtgcaatgctaccgatacttgggtaacatatgggacctgtagtcaaacgggggagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaagacgcaaactttgtttgccgccgaacattcgtggatagaggctggggtaatgggtgtggactgtttggcaaaggctccttgataacttgcgctaagttcaagtgcgtaaccaaactcgaggggaagacagtgcagtacgaaaacctgaaatattcagtcattgtgaccgttcacactggagaccagcatcaagtgggtaatgagagtacggaacacggcacaaccgccactatcacaccccaggcgcctagcacagagattcagttaaccgactacggggccctgactctcgattgttctccaaggacaggacttgactttaacgaaatggtcctgttgacgatgaaggagaaatcctggctagtgcataagcagtggttcctggatctcccgctgccctggacctcaggcgcaagcacaagtcaagagacatggaatcggaaagaccttctggtaacctttaagacagctcacgccaagaaacaggaagttgtggtcttgggttctcaggagggggctatgcacactgccctcaccggcgcaacggaaatccaaacctccggaacaactaccatcttcgccggccatctgaagtgccgtttaaaaatggataagctgacactaaaagggatgagctatgtgatgtgtactggatcgttcaagctcgagaaggaagtcgctgagacccagcacggtacggtgctggttcagattaaatacgagggcacagacgcgccttgcaagataccattttctacccaggatgaaaaaggggtgactcaaaacggacgccttatcacagcaaatcccattgtaaccgacaaggagaaacctgtcaacatcgaagccgagccacccttcggcgagtcctatatagtgattggtgctggggaaaaggccttgaagctgtcatggtttaaaaagggcagtagcatcggaaaaatgttcgaggcaactgccagaggcgctaggcggatggccatcctcggggataccgcatgggactttggatccattggtggcgttttcacatctgtggggaagctggtccatcagatctttggaacggcgtacggcgtgcttttcagcggtgtatcatggaccatgaaaattgggataggcgtgctgttgacttggctcggactgaatagtcgatccactagcttatctatgacctgtatcgctgttggcctggtcacactatacctcggggtgatggtgcaggccgattcaggatgcgtcattaactggaagggccgcgaactgaagtgtggtagtgggatctttgttactaatgaggtgcacacctggacggaacagtataaattccaagcagacagcccgaagagactttccgccgctatcggaaaagcctgggaggagggcgtgtgcggtattaggtctgcaacacggttggaaaacataatgtggaagcagatctcgaacgagctgaatcatattctcctggaaaacgacatgaaatttaccgtagtcgtgggcgatgttgctgggatcttagcccagggaaagaaaatgattcgccctcagcccatggagtacaagtatagctggaagtcctggggcaaagcgaagatcataggggccgacgtgcaaaatactaccttcatcattgatggaccaaacacacctgaatgtcccgacgatcagagagcttggaatatctgggaggtcgaggactacggctttggtattttcactaccaacatctggctgaaacttagggattcatatacacaggtgtgcgaccaccgtttgatgagtgcagccataaaggattctaaagctgttcacgccgacatggggtactggattgaaagcgagaagaatgaaacgtggaagctcgcacgggcgtccttcatcgaggtgaaaacctgtatttggccaaagtcacatactctgtggagcaacggagtactagaatctgagatgatcatacccaaaatctatggcggtcctatttcccagcacaattaccgaccaggctactttacacaaaccgccgggccgtggcatctgggaaagctcgagctggatttcgacctttgcgaaggcactacagtcgtggtggatgagcactgcgggaacagaggacccagtttgaggaccacgactgtcaccggcaaaatcattcacgaatggtgttgccgcagctgtacactgcctccattacggtttaagggtgaggacgggtgctggtatggaatggagatcagacccgttaaggaaaaagaggaaaatctcgtgaagtctatggtatccgctggctcaggtgaggtggacagtttcagcctgggccttctgtgtatatcgattatgatcgaagaggtcatgaggtcccgctggtctcgaaaaatgttgatgaccgggactctcgccgtgtttttcctgctaatcatgggacagctgacatggaacgatctcattcggctgtgcatcatggttggcgcaaatgctagcgaccgtatggggatgggaaccacataccttgccttgatggcaacttttaagatgagacctatgttcgccgtgggcctgttatttaggcgcctcacctcacgggaggtcctgcttctgacgattggtctaagtctcgtggcttccgttgaactgccaaactctttggaggaactgggggatggattagcgatgggcataatgatcctcaaactgcttacagacttccagagccatcaactgtgggccaccttgctctccctgacttttattaagaccacattctcactacactatgcatggaagactatggctatggtgctgagcatcgtcagtctttttcccctctgtctgtctaccacgtcccagaaaacaacctggttgccggtactgttaggcagcctcgggtgcaagcctctgactatgttccttattgccgagaataaaatctggggaagaaagtcgtggccactgaacgaaggtataatggccgtgggcatcgtttcaattttgctctctagtctgctcaagaatgatgtgcccctggctgggcctcttatcgcaggaggcatgctcattgcctgttacgtcatctccggtagctctgcggacctgagcttggagaaggctgccgaggtgtcctgggaagaggaagcagagcattcaggggccagtcacaatatattagtagaagtgcaggatgacggaacaatgaaaattaaggatgaggagagggacgataccctgactatcctcctgaaggctacacttctggcagtcagcggcgtttatcccttgtctatcccagccaccctattcgtgtggtacttttggcagaaaaagaaacaacgatccggcgtgctgtgggacacgccttcacccccagaagtcgagcgcgcggtgctcgatgacgggatttatcggataatgcagagaggactgcttggtaggagtcaggttggcgtaggggtgttccaggaaaacgtctttcatactatgtggcacgtgacccgtggagctgttttaatgtaccaaggcaagcgcctggagccgagctgggcctccgtgaaaaaggacctcatctcttacggtgggggatggcggttgcagggctcgtggaatacaggcgaggaagtccaggtgattgcagtagagcctgggaagaaccccaaaaatgtccagaccgccccaggaacattcaagactagcgaaggtgaggtgggcgctatcgccctggattttaaacccgggacctcaggatcccctattgttaacagagaaggcaagatcgtgggtctctatgggaatggagtcgtgacgacaagtggcacttacgtttctgcaatagctcaagccaaagcgagccaggagggcccactgcccgagatcgaagacgaggtgttcaggaagcgaaaccttaccattatggatctgcaccctgggtccggaaagacacggcgctatttgccggccatcgtcagagaagcaattaaaaggaagctacggaccctgatcctcgctccaactcgagtggtagcctcagagatggctgaagcattaaaaggtatgcccataagataccagaccacagccgtgaagtctgagcatacgggcaaagagattgttgacctgatgtgccacgccacttttaccatgcgccttctgagccctgtcagggtgccaaattataacatgatcatcatggatgaagctcatttcacagaccccagttccattgcggcacgtgggtacatcagcacccgggtgggaatgggcgaggccgctgccatatttatgactgcaacacctccgggttctgtcgaagccttcccccaatcaaatgctgtaattcaggatgaggaaagagacatcccagagaggtcctggaacagtgggtatgagtggattaccgattttcctggaaagacggtgtggttcgttcccagcatcaagtcgggcaatgacatagcgaactgtctccgcaaaaatggcaagcgagtgattcagttgtctagaaaaactttcgatacagaataccagaagaccaaaaacaacgactgggactacgtcgtgaccactgatatctccgagatgggggccaattttcgggcagacagggttatcgatccacgccgttgcctgaagcctgtgattctcaaggacggacccgaaagagtcatcctggctggtccaatgccggtgacagtagccagcgcagcccaacggaggggccgcattgggcgaaaccacaataaagagggagatcagtatatatacatgggccagcctcttaacaatgacgaggatcatgctcactggaccgaagccaagatgctactggacaacatcaatacacccgagggtattatcccagcgttgttcgaacccgagagagaaaaatcagcagccatcgatggggagtatcggttaaggggcgaggctcgcaagacttttgtggaactgatgagaaggggagacctccctgtttggctgagttacaaagtcgcctctgagggcttccagtattccgatcggcgttggtgctttgacggggaacgcaacaatcaagtgcttgaggaaaacatggatgtggagatttggacgaaggagggagaacgaaagaaactgagaccaaggtggctcgacgctcggacctacagcgaccccttggcactgcgcgagttcaaagaatttgccgctggtagaaggtcagtcagtggcgatctaatactggagatcgggaaactccctcagcaccttacacagcgggcccagaatgcactggacaacttagttatgttgcataatagcgaacaaggaggccgagcgtatagacacgccatggaggagctgccggatactattgaaaccctcatgctgcttgctctgatcgccgtgctcacaggtggggtaaccttgttctttctgtccggccgcggattaggcaagacttctattgggctactgtgtgtgatggcaagctccgtcctcctttggatggcttcagtggagccacattggatcgccgcatctataatcctggagttctttttgatggttctgctcattcccgagcctgacaggcagcggacgccccaggataaccagctggcctacgtggtcatcggacttctcttcatgattctgaccgtagctgcgaatgagatgggtttgctggaaacaactaaaaaggacttaggcatcgggcacgtggccgttgagaaccaccatcacgcagctatgctagatgtggacctgcatccagccagtgcctggaccctctacgcagtcgctacaaccataattactcctatgatgcgtcacacaatcgaaaacacgaccgccaatatttcgcttactgcgatcgctaaccaagccgcaatactgatgggattggataaaggctggcccatcagcaagatggacattggtgtgccactgctcgccctggggtgctattcccaggtcaatcctcttacattaaccgctgcagtgctgatgctcgttgcccattacgcgatcattggcccgggattgcaggctaaggccaccagagaggcacagaagaggacagccgctggcatcatgaagaaccccactgtggatgggatagtagccattgacctggatccagtggtctatgacgcaaaatttgaaaagcagctaggacagatcatgctgctcatcctttgtacgtctcagattctgttgatgcgcaccacatgggctctgtgcgagtcaatcactctcgccaccggccctctgacaaccttatgggagggtagccccgggaaattctggaatactacgatagcggtttccatggccaacattttccggggaagttaccttgcaggcgctggtctggccttttctctcatgaaaagcctaggcgggggacgaagaggcacaggggcacaaggagaaaccctgggcgagaagtggaaaaggcagttgaatcagctgtcaaagtccgagttcaacacttataaacgcagtggtatcatggaggtggaccggagcgaagctaaggaggggctcaaaagaggagagaccacaaagcacgccgtctctcgtggcactgccaaacttaggtggtttgtggaacggaatctggtaaaaccagagggtaaggtgattgatttgggctgtgggcgcggaggctggtcctactattgcgcggggctgaaaaaggttaccgaagtgaaaggatacacaaagggcggtcctgggcacgaggaacccatcccgatggctacgtacggatggaacctcgtcaaattacattcaggcaaggacgtgttctttataccacctgagaagtgtgataccctgctttgcgacatcggcgagagctcgcccaatccaactattgaagaggggcgaacactgagagtcctaaaaatggtggaaccctggctcaggggaaaccagttctgtatcaagattctgaatccttatatgccgtctgttgtagagaccttggagcaaatgcagcggaaacacggtggcatgctggtgcgcaaccccctcagtagaaattccactcatgaaatgtactgggtcagctgcgggacaggaaacatcgtgtcagcagttaatatgacctccaggatgcttctgaaccgatttacgatggcccaccggaagccaacctatgagcgtgatgtggacttaggcgctggtacaagacacgtcgccgtggaacctgaggtagcaaacctggatattatcgggcagcgcatagaaaatattaaacatgagcacaagtctacttggcattacgacgaggataacccctataagacctgggcctaccacggaagctatgaagtgaaacctagtggctccgctagctctatggttaatggcgtcgtgaagttgctcacaaaaccatgggacgtgatccccatggtcactcagatcgcgatgaccgatacaacccctttcgggcaacagagggtttttaaggagaaagtggacactcggacgccaaaggccaagagaggaacagcacagattatggaagtaaccgctaaatggctgtggggtttcctatcacgcaacaagaaacccaggatatgtactcgagaggaatttacccggaaggtgagaagtaatgccgcaatcggcgccgtcttcgtggacgagaaccaatggaactccgctaaagaggccgttgaagatgagaggttttgggaccttgtgcatcgcgaacgtgagctgcacaagcaggggaagtgcgcgacatgcgtctacaacatgatgggaaaacgggaaaagaaactcggcgagttcggtaaggcaaaagggagcagagccatttggtacatgtggctgggagctaggttcttggagtttgaagccctgggcttcatgaatgaggatcactggttttctcgcgaaaactcgctctcaggcgtggagggggagggacttcataagctgggttatatcttacgagacattagcaaaatcccgggcgggaatatgtacgcagatgacacggctggatgggatacccggataactgaagacgatctgcagaacgaggccaagatcacagacattatggaacctgagcacgctttgctcgccaagtccatcttcaaactgacctatcagaataaggtagttagagtgcaaaggccagccaagaacggcactgtcatggatgtgattagtcgcagagaccagcggggttctggacaggtgggaacatacggcctaaatacctttacaaacatggaagcgcagcttatcaggcaaatggagagcgagggcatattctccccctcagaactggagactcctaacctcgcccgtcgagtcctggattggttggaaaagcatggggttgagcgcttaaaaagaatggctattagtggagacgactgtgtggtaaagccaatcgatgaccggtttgccaccgcactgacggctctcaatgatatgggtaaggtgaggaaagacatcccccagtgggaaccgtctaagggctggaacgattggcagcaggtccctttctgcagccaccactttcatcaacttattatgaaagacgggcgcgagatagtggttccctgtagaaatcaggatgagctggtgggacgggccagggtctcccagggcgcaggttggtcactacgagaaaccgcctgcctgggaaagagctatgcgcagatgtggcaactcatgtacttccaccgtagagacttgcgcctggctgccaacgcaatctgttctgccgtgccagtagattgggttcctacatcccggactacctggagtattcatgctcaccatcagtggatgacaactgaggacatgcttagcgtgtggaatagggtctggatcgaagagaacccctggatggaagataaaacccacatttcgtcctggggagacgtgccatatctgggcaagagagaggaccagtggtgcggctctctcatcgggttaacggcccgcgcaacatgggctaccaatatacaagttgccatcaaccaggtgcggaggctgattggaaatgagaactacttggattacatgacttcaatgaagcgatttaaaaatgaaagcgaccccgagggtgcgctgtggtga

SEQ ID NO: 13766 - RNA, 9879 nt, synthetic construct
  misc_feature 1..9879: note = derived and/or modified CDS sequence (opt3) from DENV-1__GQ199789__SS-prME
  source 1..9879: mol_type = other RNA
agcgtgaccatgctgctcatgcttatgcccactgcactggctttccacttgactacgagaggaggggaacctcatatgatcgtctccaagcaggaaaggggaaaatctttactgtttaagacctcagccggtgttaacatgtgcaccctaattgccatggacctcggcgagttctgtgaagatactatgacctacaaatgcccgcggataacggaagcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagaaggtggaaacttgggctttgaggcaccctggatttaccgttattgcactcttcctggcccatgctatcggcacatcgattacccagaagggcatcatatttatcctgctcatgttagtgacgccatcaatggccatgcggtgcgtcgggattggaagccgcgatttcgtggagggtctgagtggcgcgacttgggtagacgttgtgcttgagcacgggtcctgtgtcacaaccatggcaaaagataagcccactttggacatcgaactgctaaaaacagaggtgaccaaccctgccgtgctcagaaagctgtgcattgaagctaaaatctctaatacgaccacagatagtaggtgtccaactcaaggagaggccacccttgtcgaagaacaggacgcaaactttgtttgccggcgcacattcgtggatcgaggctggggtaatgggtgtggactgtttggcaagggctccttgataacttgcgctaagttcaaatgcgtaaccaagctcgaggggaaaacagtgcagcacgaaaacctgaagtactcagtcattgtgaccgttcatactggagaccagcaccaagtgggtaatgagagtacggaacatggcacaaccgccactatcacaccccaggcgcctagcacagagattcagttaaccgactatggggccctgactctcgattgttctccaagaacaggacttgactttaacgaaatggtcctgttgacgatgaaagagaagtcctggctagtgcacaaacagtggttcctggatctcccgctgccctggacctcaggcgcaagcacaagccaagagacatggaataggaaggaccttctggtaacctttaagacagctcacgccaaaaagcaggaagttgtggtcttgggttctcaggagggggctatgcatactgccctcaccggcgcaacggaaatccaaacctccggaacaactaccatcttcgccggccacctgaaatgccggttaaagatggataaactgacactaaaggggactagctacgtgatgtgtaccggatcgttcaagctcgagaaagaagtcgctgagacgcagcatggtacagtgctggttcagattaagtatgagggcaccgacgcgccttgcaaaataccattttctactcaggatgaaaagggggtgacacaaaacggacgtcttatcaccgcaaatcccattgtaactgacaaagagaagcctgtcaacatcgaagccgagccacccttcggcgagtcctacatagtgattggtgctggggaaaaggccttgaaactgtcatggtttaagaaaggcagtagcatcggaaagatgttcgaggcaaccgcccgcggcgctagaaggatggccatcctcggggatacagcatgggactttggatccattggtggcgttttcacgtctgtggggaaactggtccaccagatctttggaaccgcgtatggcgtgcttttcagcggtgtatcatggactatgaagattgggataggcgtgctgttgacatggctcggactgaatagtcggtccaccagcttatctatgacatgtatcgctgttggcctggtcactctatacctcggggtgatggtgcaggccgattcaggatgcgtcattaactggaagggccgagaactgaaatgtggtagtgggatctttgttaccaatgaggtgcatacgtggacagaacagtacaagttccaagcagacagcccgaaacgcctttccgccgctatcggaaaggcctgggaggagggcgtgtgcggtattagatctgcaaccaggttggaaaacataatgtggaaacagatctcgaacgagctgaatcacattctcctggaaaacgacatgaagtttactgtagtcgtgggcgatgttgctgggatcttagcccagggcaagaagatgattcggcctcagcccatggagtataagtacagctggaaatcctggggcaaggcgaaaatcataggggccgacgtgcaaaataccacattcatcattgatggaccaaacactcctgaatgtcccgacgatcagcgcgcttggaatatctgggaggtcgaggactatggctttggtattttcaccacaaacatctggctgaaacttagagattcatacacacaggtgtgcgaccacaggttgatgagtgcagccataaaagattctaaggctgttcatgccgacatggggtattggattgaaagcgagaagaatgaaacctggaaactcgcacgtgcgtccttcatcgaggtgaagacttgtatttggccaaaatcacacacactgtggagcaacggagtactagaatctgagatgatcatacccaagatctacggcggtcctacctcccagcataattatcggccaggctactttactcaaacagccgggccgtggcacctgggaaaactcgagctggatttcgacctttgcgaaggcaccacggtcgtggtggatgagcactgcgggaaccgaggacccagtttgagaactaccacagtcaccggcaagattatccatgaatggtgttgcaggagctgtactctgcctccattacgctttaagggtgaggacgggtgctggtacggaatggagattcggcccgttaaagaaaaggaggaaaatctcgtgaaatctatggtatccgctggctcaggtgaggtggacagtttcagcctgggccttctgtgtatctcgataatgattgaagaggtcatgagatccaggtggtctcgcaagatgttgatgacagggaccctcgccgtgtttttcctgctaatcatgggacagctgacatggaacgatctcatccgactgtgcattatggttggcgcaaatgctagcgaccggatggggatgggaactacctatcttgccttgatggcaacgtttaaaatgcgtcctatgttcgccgtgggcctgttatttagaaggctcacatcacgcgaggtcctgcttctgaccatcggtctaagtctcgtggcttccgttgaactgccaaactctttggaggaactgggggatggattagcgatgggcattatgatactcaagctgcttactgacttccagagccaccaactgtgggccaccttgctctccctgacatttatcaagactaccttctcactacattacgcatggaaaacgatggctatggtgctgagcattgtcagtctttttcccctctgtctgtctacaacctcccagaagactacatggttgccggtactgttaggcagcctcgggtgcaaacctctgaccatgttccttatcgccgagaataagatttggggacggaaatcgtggccactgaacgaaggtatcatggccgtgggcatagtttcaatcttgctctctagtctgctaaagaacgatgtgcccctggctgggcctcttattgcaggaggcatgctcatcgcctgttatgtcatttccggtagctctgcggacctgagcttggagaaagctgccgaggtgtcctgggaagaggaagcagagcactcaggggccagtcataatatcttagtagaagtgcaggatgacggaactatgaagataaaggatgaggagagagacgatacactgaccattctcctgaaagctacgcttctggcagtcagcggcgtttaccccttgtctatcccagccactctattcgtgtggtatttttggcagaagaaaaagcaaaggtccggcgtgctgtgggacaccccttcacccccagaagtcgagcgagcggtgctcgatgacgggatctaccgcattatgcagcggggactgcttggtagaagtcaggttggcgtaggggtgttccaggaaaacgtctttcacacaatgtggcacgtgaccaggggagctgttttaatgtatcaaggcaaacgtctggagccgagctgggcctccgtgaagaaggacctcatatcttacggtgggggatggcgcttgcagggctcgtggaatacaggcgaggaagtccaggtgatcgcagtagagcctgggaaaaaccccaagaatgtccagactgccccaggaaccttcaaaacgagcgaaggtgaggtgggcgctattgccctggattttaagcccgggacatcaggatcccctatcgttaaccgggaaggcaaaattgtgggtctctacgggaatggagtcgtgactaccagtggcacatatgtttctgcaatcgctcaagccaaggcgagccaggagggcccactgcccgagatagaagacgaggtgttcagaaagaggaaccttaccatcatggatctgcatcctgggtccggaaaaactcgacggtacttgccggccattgtccgcgaagcaatcaagagaaaactaaggaccctgattctcgctccaacacgggtggtagcctcagagatggctgaagcattaaagggtatgcccatccgatatcagacgactgccgtgaaaggcgagcacaccgggaaggagatagttgacctgatgtgccatgccacatttaccatgagacttctgtctcctgtccgcgtgccaaattacaacatgattatcatggatgaagctcacttcactgaccccagcagtatcgcggcaaggggatatatttccacacgtgtgggcatgggtgaggccgctgccatctttatgaccgcaacgcctccggggagcgtcgaagccttcccccaatctaatgctgtaatacaggatgaggaacgggacattccagagagatcatggaactccggatacgagtggatcactgattttcctggcaagacagtgtggttcgttcccagtattaaaagcggcaatgacatcgcgaactgtctcaggaagaatgggaaacgcgtgatacagttgtcgcgaaagaccttcgataccgaatatcagaaaactaagaacaacgactgggactacgtcgtgacaaccgatatttctgagatgggagccaattttagagcagaccgggttatcgatccaaggcgctgcctgaagcctgtgatcctcaaagacggtcccgaacgtgtcattctggctggcccaatgccggtgacagtagcctccgcagcccaaagacgggggaggatcggacgcaaccataataaggagggcgatcagtacatttatatgggtcagcctcttaacaatgacgaggatcacgctcactggactgaagccaaaatgctactggacaacataaatacgcccgaggggatcattccagcgttgttcgaacccgagcgagaaaagagcgcagccatcgatggcgagtacagattacggggagaggctaggaaaacctttgtggaactgatgcgcagaggcgacctccctgtttggctgtcatataaggtcgccagtgaggggttccagtactctgataggcggtggtgctttgacggagaacgtaacaatcaagtgcttgaggaaaacatggatgtggagatctggacaaaagagggtgaacgcaagaagctgcgaccaagatggctcgacgctaggacttattccgaccccttggcactgcgggagttcaaagaatttgccgctggccgcagaagcgtctcaggggatctaattctggagataggaaagctccctcagcatcttacccagagggcccagaatgcactggacaacttagttatgttgcacaatagtgaacaaggcggtcgggcgtaccgacatgccatggaggagctgccggatacaatcgaaaccctcatgctgcttgctctgattgccgtgctcactgggggcgtaacgttgttctttctgagcggaagaggcttagggaaaacctccatcggactactgtgtgtgatggcatctagcgctctcctttggatggcctccgtcgagccacactggattgcagcctcaatcatactggagttctttttgatggtgctgctcatccccgagcctgaccgccagaggacaccccaggataaccagctggcttatgttgtgattggtcttctcttcatgatcctgactgtcgcggccaatgagatgggcttgctggaaaccacaaagaaagacttagggattggacacgtagcagtggagaaccatcaccatgctgccatgctagatgttgacctgcacccagcctctgcatggaccctctacgctgtggccactacaatcataacgcctatgatgcggcataccattgaaaacactacagcgaatatcagtcttaccgctattgccaaccaagcagccatcctgatgggcttggataagggttggcccatatcgaagatggacatcggggtcccactgctcgctctgggctgctacagccaggtgaatcctcttaccttaacagcagccgtcctgatgctcgtggcgcactatgctattatcggaccgggcttgcaggccaaagcaactcgtgaggcccaaaagagaacggctgccgggattatgaaaaaccccaccgttgatggaatcgtggcaatagacctggatccagtagtgtacgacgctaagtttgaaaaacagctaggccagattatgctgctcgtcctttgtacatcccagatcctgttgatgaggactacctgggccctgtgcgagtctatcacactcgcgaccggtcctctgactacgttatgggaggggtcacccggaaagttctggaatacaaccattgccgttagcatggcaaacatcttccgcggctcctatcttgctggtgccggcctggcatttagtctcatgaagtctctagggggaggccggcgagggactggagctcaaggcgaaaccctgggtgagaaatggaagagacagttgaatcagctgagcaaatcagagttcaacacatacaagaggtccgggataatggaggtggaccgcagtgaagccaaagagggactcaagcggggcgagactaccaagcacgccgtcagcagaggtacagcgaaacttcgttggtttgtggaaaggaatctggtaaagccagagggcaaagtgattgatttggggtgtggacggggcgggtggtcttattactgcgctggactgaagaaagttacggaagtgaagggctataccaaaggtgggcctggacatgaggaacccatcccgatggcaacttacggctggaacctcgtcaagttacactccggcaaggacgtgttctttattccacctgagaaatgtgatacactgctttgcgacatcggggagtcaagccccaatccaaccatagaagagggacgcactctgcgagtcctaaagatggtggaaccctggctcagaggtaaccagttctgtatcaaaattctgaatccttacatgccgtcggttgtagagacattggagcaaatgcagaggaagcatggcgggatgctggtgcggaaccccctctctcgcaatagtacccacgaaatgtattgggtctcctgcggaacgggcaacatcgtgagcgccgttaatatgacctcaagaatgcttctgaacaggtttacaatggctcaccgaaaaccaacttacgagcgggatgtggacttaggtgccgggacccgtcatgtcgcagtggaacctgaggtagccaacctggatattatcggacagagaattgaaaatatcaagcacgagcataagtccacatggcactatgacgaggataacccctacaaaacttgggcttatcatggctcttacgaagtgaagcctagcggcagtgcgtccagcatggttaatggggtcgtgaaattgctcaccaagccatgggacgtgatacccatggtcacacagattgccatgaccgatactacgcctttcggacaacagcgcgtttttaaagagaaggtggacacaaggaccccaaaggcaaaacggggtactgctcagatcatggaagtaaccgccaagtggctgtggggcttcctatctagaaacaaaaagccccgcatctgtacaagggaggaatttacgcgaaaagtgcggtcaaatgcagccattggggctgtcttcgtggacgagaaccaatggaatagtgccaaggaggcggttgaagatgagagattttgggaccttgtgcacagggaacgcgagctgcacaagcagggaaaatgcgcaacctgcgtctataacatgatgggcaagcgtgagaaaaagctcggtgagttcgggaaagccaagggatcccgggctatatggtacatgtggctgggcgccagattcttggagtttgaagcactgggcttcatgaatgaggatcattggtttagcagggaaaactctctctcgggggtggagggagagggtcttcacaaactgggctacatcttacgcgacatttcaaagatcccagggggaaatatgtatgctgatgacactgccggctgggatacacgaattaccgaagacgatctgcagaacgaggctaagatcactgacataatggaacctgagcatgccttgctcgcaaaaagcatcttcaagctgacataccagaataaagtagttcgggtgcaaagaccagcgaagaacggtaccgtcatggatgtgatttccaggcgcgaccagagagggagtggacaggtgggcacatatggcctaaatacttttaccaacatcgaagcccagcttattcggcaaatggagtctgaggaaatcttcagcccctccgagctggaaacgcctaacctcgctgggagggtcctggattggttggagaaacacggagttgaacgtttaaagcgaatggccatatcaggtgacgactgtgtggtaaagccaattgatgaccgctttgcaaccgctctgacagccctcaatgatatgggcaaagtgagaaaggacatcccccagtgggagccgagtaaagggtggaacgattggcagcaggtccctttctgctctcaccattttcaccaacttatcatgaaggacggacgggagattgtggttccctgtaggaatcaggatgaactggtgggccgcgcaagagtcagccagggtgccgggtggtccctacgggagactgcgtgcctgggaaaatcatacgctcagatgtggcaactcatgtatttccataggcgagacttgcgtctggccgcaaacgccatatgtagcgctgtgccagtagattgggttcctacctctagaacaacttggtccatccacgcccatcaccagtggatgaccacggaagacatgcttagtgtgtggaatcgcgtctggattgaggaaaacccctggatggaggataagacacacatcagctcgtggggcgacgtgccatacctgggcaagcgggaggaccagtggtgcgggtccctcattggattaaccgcaagggctacttgggccacaaatatccaagttgcgataaaccaggtgagacgcctgatcggtaatgaaaactatttggattacatgacctctatgaaacggtttaagaatgagtcagaccccgaaggcgctctgtggtga

SEQ ID NO: 13767 - RNA, 9879 nt, synthetic construct
  misc_feature 1..9879: note = derived and/or modified CDS sequence (opt3) from DENV-1__GQ199790__SS-prME
  source 1..9879: mol_type = other RNA
agcgtgaccatgctgctcatgcttatgcccacagcactggctttccacttgactacgaggggaggggaacctcatatgatcgtcaccaagcaggaaaggggaaaatccttactgtttaagacatctgccggtgttaatatgtgcactctaattgccatggacctcggcgaactgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgtgatcggcacctctattacgcagaagggcatcatattcatcctcttaatgctggtcactccatcgatggctatgcgctgcgtggggattggatcaagagattttgtagagggtcttagcggcgccacatgggttgacgtggtcttggagcacgggagttgtgtgaccactatggcgaaggataaacccacactggacatcgaactactcaagaccgaggtgacgaaccctgcagtcctgaggaaactttgcattgaagccaagatctccaataccacaactgattctcggtgtccaacccaaggagaggctacactgatggaagaacaagacgccaacttcgtttgccgccgaacttttgtggatagaggctggggtaatgggtgtggattgttcggcaaaggcagcctcataacctgcgcaaagtttaagtgcgtaacaaaactggaggggaagattgtgcagtacgaaaacttaaaatattccgtcatcgtgaccgttcacactggagaccagcatcaagtgggtaatgagtcaacggaacacggcacaaccgctactattacaccccaggcccctacaagtgagatccagctgaccgactacggggcgctcactcttgattgtagcccaaggacaggactggacttcaacgaaatggtcttgctaacgatgaaggagaaatcttggctggtgcataagcagtggtttctcgatctgccgcttccctggacctccggcgcctcaactagccaagagacatggaatcggcaggacctgttggtaaccttcaaaacagcacacgctaagaagcaggaagttgtggtcctcggtagtcaagagggggccatgcacactgctctgaccggcgccacggaaatccagacctctggaacaactaccatttttgcaggccatttaaaatgccgtctgaagatggataaactaacactcaaggggatgtcctatgtgatgtgtactgggagcttcaaactggagaaggaagtcgccgagacccagcacggtacggtgcttgttcagataaagtacgagggcacagacgctccttgcaaaatcccattctcgacccaagatgaaaagggggtgactcagaacggacgcttgattacagcgaatcccatcgtaaccgacaaagagaagcctgtcaacatagaagcagagccaccctttggcgagtcttatattgtgatcggtgccggggaaaaagctctgaagctctcctggttcaagaaaggctcaagtatcggaaagatgtttgaggccactgcaagaggcgccaggcggatggctattctgggggataccgcctgggacttcggaagcatcggtggcgtttttacatccgtggggaaacttgtccatcagattttcggaacggcatacggcgtgctgttttctggtgtaagctggaccatgaagatagggatcggcgtgttgctcacttggctgggattaaattcacgaagtacatccctgagcatgacctgtattgcggttggcctagtcacactctacctgggggtgatggtgcaggctgattctggatgcgtcatcaactggaaaggccgcgaacttaagtgtggttcagggatcttcgttactaatgaggtgcacacctggacggaacaatataagtttcaggccgacagtccgaaaagattgagcgcagccattggaaaggcttgggaggagggcgtgtgcggtataaggtccgccacacggctggaaaacatcatgtggaaacagatttctaacgagctcaatcatatcctgttagaaaacgacatgaagttcaccgtagtcgtgggcgatgttgtggggattctggcacagggcaaaaagatgatccgccctcaacccatggagcacaaatactcgtggaaaagctggggcaaggctaagataatcggggccgacgtccagaatactacctttattatcgatggaccaaacacacctgaatgtcccgacgatcagagagcgtggaatatttgggaggtggaggactatggcttcggtatctttactaccaacatatggcttaagttgagggattcccacacacaggtttgcgaccatcgtctcatgtcagccgctattaaagatagtaaggcagtgcacgccgacatggggtactggatcgaatctgagaaaaatgaaacgtggaagctggctcgggccagcttcattgaggtaaagacctgtatctggccaaaatcccatactctatggtcaaacggagtcctggaaagcgagatgataatccccaagatttatggcggtcctatctctcaacacaattaccgaccaggctatttcacacagaccgcagggccgtggcacctcggaaaactggagcttgattttgacttgtgcgaaggcactacagtggtggtcgatgagcattgcgggaacagaggaccctccctgaggaccacgactgttaccggcaagattatccacgaatggtgttgccgcagttgtacattacctccactccggttcaaaggtgaggacgggtgctggtacggaatggagataagacccgtgaaggaaaaggaggaaaatctggtaaaaagcatggtgtctgcgggctccggtgaggtcgactcatttagtcttggcctgttgtgtattagcatcatgatcgaagaggtgatgaggtcgcgctggtcccgaaagatgctcatgaccgggactctggccgttttcctactgctcattatgggacagctgacatggaacgatcttatccggttgtgcattatggtgggcgctaatgcctctgaccgtatggggatgggaaccacatacctggcattaatggctacttttaaaatgagacctatgttcgccgtcggcctcctgtttaggcgccttaccagccgggaggtgctgctactcacgataggtctgtcattggttgcaagtgtggaactgccaaactccttagaggaactcggggatggactggccatgggcatcatgattcttaagctgttgacagacttccaatctcatcagctctgggctaccctgctaagcctgacttttatcaaaaccacactttccctccactatgcgtggaagactatggccatggtcctgtcaattgtatccttgttccccctgtgtttaagtaccacgtctcagaagacaacctggctcccggtgctgcttggctccctggggtgcaaacctttggcaatgtttctcatcgctgagaataagatatggggaagaaaaagctggccactgaacgaaggtatcatggccgttggcgtggtctcgattctactgtcatctcttctcaagaacgatgtgcccctggccgggcctttgatcgctggaggcatgttaattgcatgttacgtaatcagtggttccagcgccgacctgtctctcgagaaagcggctgaggtgagctgggaagaggaagccgagcattccggggcatcacacaatatactggtcgaagttcaggatgacggaactatgaagattaaagatgaggagagggacgatacacttaccatcctgttgaaggccactctactggctgtgagtggcgtgtatcccctcagcatcccagcaacactgttcgtctggtacttttggcaaaagaaaaagcagcgatctggcgtgctttgggacaccccttcacccccagaagttgagcgcgccgtattagatgacgggatttatcggataatgcagagaggactgctcggtaggagccaggtgggcgtcggggtgttccaagaaaacgttttccacacgatgtggcatgtgactcgtggagcggtcttgatgtaccagggcaaacgcctggagccgagttgggctagcgtgaagaaagacctcatctcctatggtgggggatggcggctgcagggctcttggaataccggcgaggaagtacaggtcattgccgtggagcctgggaagaaccccaagaatgttcaaacagcaccaggaacctttaaaacacccgaaggtgaggtgggcgccatcgctcttgatttcaagcctgggacttcgggaagcccaattgtcaacagagaaggcaaaatcgtgggtctgtacgggaatggagttgtgaccacgtcaggcacatacgtctccgccatagcacaggctaaggccagtcaggagggccccttgcctgagatcgaagacgaggtgtttaggaaacgaaacctaactattatggatctgcacccggggtctggaaagacccggcgctatctcccagcgatcgtaagagaagccattaagaggaaattacggacactgatccttgcacccacccgagtggttgctagcgagatggccgaagctctgaagggtatgcctataagataccaaactaccgcagtcaaatccgagcatacaggcaaggagattgtggacctcatgtgccacgccacgttcactatgcgcttgctgtcaccagtgagggtccccaattataacatgatcatcatggatgaagcccattttaccgacccttctagcattgctgcgcgtgggtacatcagtacacgggtaggaatgggcgaggcagccgctatattcatgaccgccactccgcccggttccgtggaagcatttccacagagcaatgccgttattcaggatgaggaaagagacatccctgagaggtcttggaactcagggtatgagtggattacagatttccccggaaaaaccgtgtggtttgtcccatccatcaagagtggcaatgacatagctaactgtctccgcaagaatggcaaacgagtgattcagctgagcagaaagacgttcgatactgaataccagaaaaccaagaacaacgactgggactatgttgtgaccaccgatatctcggagatgggggcgaattttcgggccgacagggtcatcgatcctcgccgttgccttaaacccgtgattctaaaggacggaccagaaagagtaatcctggcaggtccgatgcctgtgactgttgcttctgccgcacagcggaggggccgcattgggcgaaaccacaataaggagggagatcagtacatatacatgggccagcccttgaacaatgacgaggatcacgcccattggacagaagctaaaatgttactggacaacatcaataccccagagggtattatccccgccctcttcgaacctgagagagaaaagtccgcggcaatcgatggggagtatcggctgaggggcgaggcccgcaaaacattcgtcgaacttatgagaaggggagacctgccagtgtggctcagctacaaggtggcttcagagggctttcaatatagtgatcggcgttggtgcttcgacggggaacgcaacaatcaggtcttggaggaaaacatggatgttgagatttggactaaagagggagaacgaaagaaactgagacccaggtggctagacgcccggacgtactctgaccctctggctctccgcgagtttaaggagttcgcagccggtagaaggtccgtgagcggcgatcttatactggagatcgggaagttaccgcagcacttgacccagcgggctcaaaatgccctggacaacctcgtaatgctgcataattcagaacagggaggccgagcatatagacacgcgatggaggagcttccagatacaattgaaactctgatgctcttggccctgatcgctgtgttaaccggtggggtcacactatttttcctgagtggccgcggactcggcaaaaccagcattgggcttctgtgtgtgatggcctcctctgttttgctgtggatggcaagcgtggagccccactggatcgctgcctccataatcctcgaatttttcctgatggtccttctcattcctgagcccgacaggcagcggactccacaggataaccaactggcatacgtagtgatcggattgctgtttatgattttaacggttgccgctaatgagatgggtctactggaaaccacaaagaaagacctcggcatcgggcatgtggcggtcgagaaccaccatcacgccactatgcttgatgtggacctgcatcctgcatcagcttggaccttgtatgccgtcgccacaaccataattactcccatgatgcgtcacacaatcgaaaacacgaccgcaaatatttctctgactgctatcgccaaccaggcggctatactcatgggactggataagggctggccaatcagtaaaatggacattggtgtgcctcttttagccctggggtgctactcgcaggttaatccgctcacattgaccgcagccgtgctgatgctagtagctcactacgcaatcattggccccggactgcaagccaaggcgaccagagaggctcagaagaggacagccgcaggcatcatgaaaaacccaactgtggatgggatagtcgccattgacctcgatcctgttgtgtatgacgctaagttcgaaaaacagcttggacagatcatgctgttgatcctgtgtacgagccaaattctcctgatgcgcaccacatgggccttatgcgagtccatcactcttgcaaccggccccctgacaaccctctgggagggttctccagggaagttttggaatactacgatagctgtctcaatggccaacattttccggggaagctacctagcgggcgccggtctggcattttccttgatgaaaagtctgggcgggggacgaagaggcacaggggctcagggagaaaccctcggcgagaagtggaagaggcagcttaatcagctgtctaaaagcgagttcaacatctataagcgctcaggtattatggaggtggaccggtccgaagccaaagaggggttgaagagaggagagactacccgtcatgcagtaagtaggggcacagctaaactgcggtggttcgtggaacgcaatctcgttaagcctgagggtaaggtgatcgatttaggctgtgggcgaggaggctggagctactattgcgccgggctgaaaaaggtcactgaagtgaaaggatacaccaagggcggtcccgggcacgaggaaccgataccaatggccacatatggatggaaccttgtcaaactgcattctggcaaggacgtgtttttcacgcctcccgagaaatgtgataccctactctgcgacatcggcgagtcctcaccaaatcccactattgaagaggggagaacactgagggttttgaagatggtagaaccttggctgcggggaaaccaattttgtatcaagattctcaatccgtacatgcccagcgtggtcgagacccttgagcagatgcagcgcaaacacggtggcatgctggtgagaaacccattatcgagaaattctactcacgaaatgtactgggttagttgcgggacaggaaacatcgtgtccgcggtcaatatgaccagccgaatgctgttgaaccggttcacgatggctcatcgtaagcctacctatgagagagatgtggacctcggcgcaggtacacgccacgtagccgtggaacccgaggttgctaacctggatattatcgggcagaggatagaaaatattaaacatgagcacaagtcaacttggcattacgacgaggataacccttataaaacctgggcctaccacggatcctatgaagtcaagccatctggcagcgcaagttccatggtgaatggcgtggtcaagctacttacaaaaccctgggacgttatccctatggtgactcaaatcgccatgaccgatacaaccccatttgggcagcagcgggtattcaaggagaaagtggacactagaacgcccaaggctaaacgcggaacagcgcaaattatggaagtcaccgccaggtggctgtggggttttctcagccgaaacaagaagccgcggatatgtactagagaggagttcaccaggaaagtgcgctctaatgcagctatcggcgccgtttttgtggacgagaaccagtggaactcagcaaaggaggccgtcgaagatgagcgtttctgggacctggtgcagaaagaacgggagttgcacaagcaggggaaatgcgctacatgcgtatacaacatgatgggaaagagagaaaagaaactgggcgagtttggtaaggccaaagggagtagggcgatttggtatatgtggctcggagcacgcttccttgagtttgaagccctgggcttcatgaatgaggatcattggttctcccgagaaaacagcttatctggcgttgagggggagggactgcacaagttgggttacatcctccgggacatttcgaaaatccctggcgggaatatgtacgctgatgacacggccggatgggataccagaataactgaagacgatctgcaaaacgaggcaaggatcacagacattatggaaccagagcatgctctacttgccacctcaatctttaagctgacttatcagaataaagtggtccgcgtgcagagacccgctaagaacggcacagtgatggatgtcattagccggagggaccagcgtggttccgggcaagttggaacctacggcctcaatacattcactaacatggaagcccagctgatccgacagatggagagtgagggcatatttttgccttctgaattagagacccagaacctggcagaacgcgtgctcgattggcttgagaagtatggggtagaaagactgaaacggatggcgattagcggagacgactgtgtggtcaagccaatcgatgacaggttcgccacggctctaaccgccctgaatgatatgggtaaagtgcgcaaggacatcccccaatgggagccgtccaaaggctggaacgattggcagcaggttcctttttgctcacaccacttccatcagctcattatgaaggacgggagagagatagtggtcccctgtcggaatcaagatgaattggtgggaagggcacgagtaagtcagggcgctggttggtctctgcgtgagacagcctgccttggaaagagctacgcacagatgtggcaactgatgtattttcacagacgcgacctccggttagccgcgaacgctatctgttccgccgttccagtggattgggtccctacttcaaggaccacatggagcattcatgcacaccatcagtggatgactaccgaagacatgctgtctgtgtggaatagagtttggatcgaggaaaacccctggatggaggataaaacgcacgtgtccagttggggagacgtcccatacttgggcaagcgcgaggaccagtggtgcggcagcctgattgggctcacagcccgggctacctgggcctcgaatatccaggtggcaataaaccaagtaaggcgacttatcggaaatgaaaactatctggattacatgacttccatgaaaagattcaagaatgagggtgaccccgaaggcgctctatggtga

SEQ ID NO: 13768 - RNA, 9879 nt, synthetic construct
  misc_feature 1..9879: note = derived and/or modified CDS sequence (opt3) from DENV-1__GQ199791__SS-prME
  source 1..9879: mol_type = other RNA
agcgtgaccatgctgctcatgcttatgcccacagccctggctttccacttgactacgagaggcggggagcctcatatgatcgtcaccaagcaggaaaggggaaaatccttactgtttaagacatctgcaggtgttaacatgtgcactctaattgccatggacctcggcgagctgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagagcaggacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattaccccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggaagcttcaaactggagaaggaagtggctgagacccagcacggtacggtccttgtgcagataaagtacgagggcacagacgcgccttgcaaaatcccattcttgacccaagatgaaaagggggttactcagaacggacgcctgattacagcaaatcccatcgtgaccgacaaagagaagcctgtaaacatagaagccgagccaccctttggcgagtcgtatattgtcatcggtgctggggaaaaagccctcaagctgtcttggttcaagaaaggctcctcaatcggaaagatgtttgaggcaactgccagaggcgctaggcggatggccattcttggggataccgcatgggacttcggaagtatcggtggcgtgtttacaagcgttgggaaactggtgcatcagattttcggaacggcgtacggcgtcttgttttccggtgtgtcttggaccatgaagatagggatcggcgtactcctgacttggttaggactgaatagccgatcaacaagtctatccatgacctgtattgctgtgggcctcgttacactgtaccttggggtcatggtgcaggccgatagcggatgcgtgatcaactggaaaggccgcgaattgaagtgtggttctgggatcttcgtcactaatgaggttcacacctggacggaacaatataagtttcaggcagactcaccgaaaagactgagtgccgctattggaaaggcctgggaggagggcgtgtgcggtataaggagcgcaacacggctcgaaaacatcatgtggaaacagatttccaacgagctgaatcatatcttactggaaaacgacatgaagttcaccgtggtagtcggcgatgtggttgggattcttgctcagggaaaaaagatgatccgccctcaacccatggagcacaaatactcttggaagtcgtggggcaaggccaaaataatcggggcggacgtgcagaatactacctttattatcgatggaccaaacacacctgaatgtcccgacgatcagagagcctggaatatttgggaggtcgaggactatggcttcggtatctttactaccaacatatggttgaagctcagggatagctacacacaggtgtgcgaccaccgtctgatgtccgctgcaattaaagattcaaaggccgttcatgctgacatggggtattggatcgaaagtgagaaaaatgaaacgtggaagctagcccgggcatctttcattgaggtgaagacctgtatctggccaaaaagccacactctgtggtccaacggagtactcgaatcagagatgataatccccaagatttacggcggtcctatcagccaacataattatcgaccaggctacttcacacagaccgcggggccgtggcacctgggaaaacttgagttggattttgacctgtgcgaaggcactacagtcgtggtggatgagcactgcgggaacagaggaccctctttaaggaccacgactgtcaccggcaagattatccatgaatggtgttgccgctcctgtacactccctccactgcggttcaaaggtgaggacgggtgctggtacggaatggagataagacccgttaaggaaaaggaggaaaatcttgtgaaaagtatggtaagcgccggctctggtgaggtggactccttttcactgggcttgctctgtattagtatcatgatcgaagaggtcatgaggagccgctggtcgcgaaagatgctgatgaccgggactctagctgtgttcctgctcctgattatgggacagcttacatggaacgatttgatccggctgtgcattatggttggcgccaatgcatccgaccgtatggggatgggaaccacatatttagctctcatggccacttttaaaatgagacctatgttcgcagtgggcctgctttttaggcgcctgacctctcgggaggtcctactcctgacgataggtttgagcctggtggcctcagttgaattaccaaacagtctcgaggaactgggggatggacttgctatgggcatcatgattctgaagttgctcacagacttccaatcccaccagctgtgggcgaccctactgtctcttacttttatcaaaaccacactcagcctgcattacgcctggaagactatggcaatggtgttgtccattgtctcactgttccccttatgtctcagcaccacgagtcagaagacaacctggctgccggtacttctgggctctttggggtgcaaacctctcactatgtttctgatcgctgagaataagatatggggaagaaaatcctggccactaaacgaaggtatcatggccgtgggcgttgtgagcattctgctttcgtcactcctgaagaacgatgtccccttggccgggcctttaatcgctggaggcatgctgattgcatgttatgtgatctctggtagttccgccgacctcagcctggagaaagcggctgaggtatcttgggaagaggaagccgagcacagcggggcatcccataatatacttgtggaagtccaggatgacggaacaatgaagattaaagatgaggagagggacgataccctgactatcttgctaaaggccacactgctcgctgtttcaggcgtgtaccccctgagtatcccagcaacccttttcgtgtggtatttttggcaaaagaaaaagcagcgaagcggcgtcttatgggacacgccttctcccccagaagtggagcgcgccgttctggatgacgggatttaccggataatgcagagaggactcttgggtaggtcccaggtaggcgtgggggtcttccaagaaaacgtgttccacactatgtggcacgttacccgtggagcggtgctgatgtatcagggcaaacgcctcgagccgtcatgggctagtgtcaagaaagacctgatcagctacggtgggggatggcggcttcagggctcctggaatacaggcgaggaagtgcaggtaattgccgtcgagcctgggaagaaccccaagaatgtgcaaaccgcaccaggaacatttaaaactcccgaaggtgaggttggcgccatcgctctggatttcaagcctgggacctctggatcgccaattgtgaacagagaaggcaaaatcgtcggtttgtacgggaatggagtggttacgacaagcggcacttatgtgtcagccatagcacaggctaaggcctcccaggagggccccctacctgagatcgaagacgaggtctttaggaaacgaaacctgaccattatggatctccatccggggagtggaaagacacggcgctacttaccagcgatcgtgagagaagccattaagaggaaactgcggacccttatcctggcacccactcgagtagtggcttctgagatggccgaagctctcaagggtatgcctataagatatcaaaccacagcagttaaaagcgagcacacgggcaaggagattgtcgacttgatgtgccatgccactttcaccatgcgcctgctctccccagtgagggtgcccaattacaacatgatcatcatggatgaagcccactttacagacccttcatctattgctgcgcgtgggtatatcagcacccgggtcggaatgggcgaggcagccgctatattcatgactgccacaccgcccggtagtgtagaagcatttccacagtccaatgccgtgattcaggatgaggaaagagacatccctgagaggagctggaactctgggtacgagtggattaccgatttccccggaaaaacggtttggtttgtgccatcaatcaagtccggcaatgacatagctaactgtctgcgcaagaatggcaaacgagtcattcagcttagtagaaagactttcgatacagaatatcaaaaaaccaagaacaacgactgggactacgtggttaccactgatatcagcgagatgggggcgaattttcgggccgacagggtgatcgatcctcgccgttgcctaaaacccgtcattctgaaggacggaccagaaagagtgatcttggcaggtccgatgcctgtaacagtggcttcggccgcacagcggaggggccgcattgggcgaaaccataataaggagggagatcagtacatatatatgggccagcccttaaacaatgacgaggatcacgcccactggaccgaagctaaaatgctgctcgacaacatcaatacaccagagggtattatccccgccctgttcgaacctgagagagaaaagtctgcggcaatcgatggggagtaccggcttaggggcgaggcccgcaaaactttcgttgaactgatgagaaggggagacctcccagtctggttgtcctataaggtggctagcgagggctttcaatactcagatcggcgttggtgcttcgacggggaacgcaacaatcaggtgctggaggaaaacatggatgtcgagatttggacgaaagagggagaacgaaagaaactaagacccaggtggctggacgcccggacctatagtgaccctctcgctcttcgcgagtttaaggaattcgcagccggtagaaggtctgtttccggcgatctgatattagagatcgggaagttgccgcagcatctgacacagcgggctcaaaatgccctcgacaacctggtgatgcttcacaatagcgaacagggaggccgagcatacagacatgcgatggaggagctgccagatactattgaaaccctcatgttgctggccttaatcgctgtactaacaggtggggtgaccctgtttttcctctcaggccgcggacttggcaaaactagtattggggtcctgtgtgtgatggccagctccgttttgctgtggatggcatctgtggagccccactggatcgctgccagcataatcctcgaatttttcctgatggtccttctcattcctgagcccgacaggcagcggacgccacaggataaccaactggcatatgtagtgatcggattgctgtttatgattttaaccgttgccgctaatgagatgggtctactggaaacaactaagaaagacctcggcatcgggcacgtggcggtcgagaaccatcaccatgccaccatgcttgatgtggacctgcaccctgcatccgcttggacattgtacgccgtcgccaccactataattacacccatgatgcgtcatacgatcgaaaacaccactgcaaatatttcactgacagctatcgccaaccaggcggctatactcatgggactggataagggctggccaatctctaaaatggacattggtgtgcctcttttagccctggggtgctacagtcaggttaatccgctcaccttgaccgcagccgtgctgatgctagtagctcactatgcaatcattggccccggactgcaagccaaggcgacaagagaggctcagaagaggactgccgcaggcatcatgaaaaacccaacggtggatgggatagtcgccattgacctcgatcctgttgtgtacgacgctaagttcgaaaaacagcttggacagatcatgctgttgatcctgtgtacctcgcaaattctcctgatgcgcacaacttgggccttatgcgagagcatcacccttgcaacaggccccctgaccactctctgggagggttccccagggaagttttggaatacgacaatagctgtctctatggccaacattttccggggatcatatctagcgggcgccggtctggcatttagcttgatgaaatccctgggcgggggacgaagaggcaccggggctcagggagaaactctcggcgagaagtggaagaggcagcttaatcagctgagtaaatctgaattcaacatctacaagcgcagcggtattatggaggtggaccggtcagaagccaaagaggggttgaagagaggagagaccacacgtcacgcagtatccaggggcactgctaaactgcggtggttcgtggaacgcaatctcgttaagcctgagggtaaggtgatcgatttaggctgtgggcgaggaggctggagttattactgcgccgggctgaaaaaggtcaccgaagtgaaaggatatacaaagggcggtcccgggcatgaggaaccgataccaatggccacgtacggatggaaccttgtcaaactgcacagcggcaaggacgtgtttttcacccctcccgagaaatgtgatactctactctgcgacatcggcgagtcttccccaaatcccacaattgaagaggggagaaccctgagggttttgaagatggtagaaccttggctgcggggaaaccaattttgtatcaagattctcaatccgtacatgccctcagtggtcgagactcttgagcagatgcagcgcaaacatggtggcatgctggtgagaaacccattaagcaggaattcgacacacgaaatgtattgggtttcttgcgggaccggaaacatcgtgagtgcggtcaatatgacgtcccgaatgctgttgaaccggttcaccatggctcaccgtaagcctacatacgagagagatgtggacctcggcgcaggtactcgccatgtagccgtggaacccgaggttgctaacctggatattatcgggcagaggatagaaaatattaaacacgagcataagagcacctggcactatgacgaggataacccttacaaaacatgggcctatcatggatcatacgaagtcaagccatccggctctgcaagcagtatggtgaatggcgtggtcaagctacttactaaaccctgggacgttatccctatggtgacccaaatcgccatgacagataccactccatttgggcagcagcgggtattcaaggagaaagtggacacgagaacacccaaggctaaacgcggaaccgcgcaaattatggaagtcactgccaggtggctgtggggttttctctcccgaaacaagaagccgcggatatgtaccagagaggaattcacaaggaaagtgcgcagcaatgcagctatcggcgccgtttttgtggacgagaaccagtggaattctgcaaaggaggccgtcgaagatgagcgtttctgggacctggtgcagaaagaacgggagttgcacaagcaggggaaatgcgctacgtgcgtatataacatgatgggaaagagagaaaagaaactgggcgagtttggtaaggccaaagggtcaagggcgatttggtacatgtggctcggagcacgcttccttgagtttgaagccctgggcttcatgaatgaggatcactggttcagtcgagaaaactccttaagcggcgttgagggggagggactgcataagttgggttacatcctccgggacatttctaaaatccctggcgggaatatgtatgctgatgacaccgccggatgggatactagaataacagaagacgatctgcaaaacgaggcaaagatcaccgacattatggaaccagagcacgctctacttgccacttcgatctttaaactgacataccagaataaggtggtcagggtgcagcgccccgctaagaacggcaccgtgatggatgtcatttcaagacgggaccagaggggtagcgggcaagttggaacatatggcctcaatactttcaccaacatggaagcccagctgatccgtcagatggagtccgagggcatatttttgcctagtgaattagagacgccaaacctggcagaacgagtgctcgattggcttgagaaatacggggtagaacgcctgaagagaatggcgatttctggagacgactgtgtggtcaaacccatcgatgaccggttcgccaccgctctaacagccctgaatgatatgggtaaggtgaggaaagacatcccgcagtgggagcctagcaagggctggaacgattggcaacaggttcccttttgctcccatcacttccaccagctcattatgaaggacgggcgcgagatagtggtcccatgtagaaatcaggatgaattggtgggacgggcaagggtatcacaaggcgctggttggagtctgcgagagactgcctgccttgggaaatcttatgcacagatgtggcagctgatgtactttcatcgtagagacctccgcttagccgcgaacgctatctgtagcgccgttcctgtggattgggtccccacctcccggacaacttggtcaattcacgcacatcaccaatggatgaccacggaagacatgctgagcgtgtggaatagggtttggatcgaggaaaacccatggatggaggataagacacatgtgtcttcctggggagacgtcccctatttgggcaaaagagaggaccagtggtgcggcagtctgattgggctcaccgcccgcgctacttgggccagcaatatccaggtggcaataaaccaggtacggaggcttatcggaaatgaaaactacctggattacatgacatcgatgaagcgattcaaaaatgagggtgaccctgaaggcgctttttggtga

SEQ ID NO: 13769 - RNA, 9879 nt, synthetic construct
  misc_feature 1..9879: note = derived and/or modified CDS sequence (opt3) from DENV-1__GQ199792__SS-prME
  source 1..9879: mol_type = other RNA
agcgtgaccatgctgctcatgcttatgcccaccgccctggctttccacttgactacgagaggaggggaacctcatatgatcgtctccaagcaggaaaggggaaaatctttactgtttaagacctcagccggtgttaacatgtgcacattaattgccatggacctcggcgaactgtgtgaagatactatgacctacaaatgcccacggataacagaggcggaaccggacgatgtggactgttggtgcaatgctaccgatgcctgggtaacttatgggacatgtagtcagaccggagagcaccgccgagacaagcgtagcgtggcacttgcaccccatgtcggcctgggtttggagacgagaactgaaacctggatgtcctctgagggggcttggaaacagatccagagggtggaaacatgggcactccggcaccctggattcactgttattgccctgtttctggctcatgccatcggcacctcgattacacagaagggcatcatattcatcctcttaatgctggtgaccccatcaatggcgatgcgctgcgtcgggattggaagcagagattttgtggagggtcttagtggcgcaacgtgggtagacgttgtgttggagcacgggtcctgtgtcactacaatggccaaggataaacccaccctggacatcgaattgctcaagactgaggtgacaaaccctgctgtgctgaggaaactttgcattgaagccaagatctctaataccacgaccgatagccggtgtccaacacaaggagaggcaactctggtcgaagaacaggacgctaacttcgtttgccgccgaacctttgtggatagaggctggggtaatgggtgtggattgttcggcaaaggctccctcataacatgcgccaagtttaagtgcgtaactaaactggaggggaagattgtgcagtacgaaaacttaaaatattcagtcatcgtgaccgttcacacaggagaccagcatcaagtgggtaatgagagtaccgaacacggcactacggcgacaattacaccccaggcccctactaccgagatccagctgacagactacggggcactcacccttgattgtagcccaaggactggactggacttcaacgaaatggtcttgctaacaatgaaggagaaatcttggctggtgcataagcagtggtttctcgatctgccgcttccctggacgtccggcgcttcaaccagccaagagacttggaatcggcaggacctgttggtaacattcaaaaccgcccacgctaagaagcaggaagttgtggtcctcggtagtcaagagggggccatgcacacagcactgactggcgccaccgaaatccagacgtctggaaccacaactatttttgctggccatttaaaatgccgtctgaagatggataaactaaccctcaaggggatgtcctatgtgatgtgtacaggtagcttcaaactggagaaggaagtcgcggagactcagcacggaaccgtgcttgttcagataaagtacgagggcacggacgcaccttgcaaaatcccattctcgacacaagatgaaaagggggtgacccagaacggacgcttgattactgccaatcccatcgtaacagacaaagagaagcctgtcaacatagaagctgagccaccctttggcgagtcttatattgtgatcggtgccggggaaaaagcactgaagctctcctggttcaagaaaggctcaagtatcggaaagatgtttgaggccaccgctagaggcgccaggcggatggcaattctgggggatactgcgtgggacttcggaagcatcggtggcgtttttacctccgtggggaaacttgtccatcagattttcggaacagcttacggcgtgctgttttctggtgtaagctggacgatgaagatagggatcggcgtgttgctcacctggctgggattaaattcacgaagtacttccctgagcatgacatgtattgccgttggcctagtcaccctctacctgggggtgatggtgcaggcagattctggatgcgtcatcaactggaaaggccgcgaacttaagtgtggttcagggatcttcgttacaaatgaggtgcacacttggaccgaacaatataagtttcaggccgacagtccgaaaagattgagcgctgccattggaaaggcatgggaggagggcgtgtgcggtataaggtccgctacgcggctggaaaacatcatgtggaaacagatttctaacgagctcaatcatatcctgttagaaaacgacatgaagctgacagtagtcgtgggcgatgttgccgggattcttggacagggcaaaaagatgatccgccctcaacccatggagtacaaatattcgtggaaaagctgggggaaggcgaaaataatcggagccgacgctcagaataccactttcattatcgatggcccaaacacccctgaatgtcccgacgatcagagagcatggaatatttgggaggtggaggactacggttttgggatcttcacaactaacatatggttgaagctcagggattcctatacccaggtctgcgaccaccgtctgatgtcagccgctattaaagatagtaaggccgtgcacgcagacatgggatactggatcgaatctgagaaaaatgaaacatggaagctagcgcgggccagctttattgaggttaagacgtgtatctggccaaaatcccataccctgtggtcaaacggcgtgctcgaaagcgagatgataatccccaagatttatggtggccctatctctcaacacaattaccgaccagggtacttcactcagacagctggaccgtggcatctgggcaaacttgagttggatttcgacctgtgcgaagggaccactgtagtcgtggatgagcactgcggaaacagaggcccctccttaaggacaaccacggtgactggtaagattatccacgaatggtgttgccgcagttgtaccctccctccactgcggtttagaggggaggacggatgctggtatggcatggagataaggcccgtcaaagaaaaggaggaaaatcttgttaagagcatggtgtctgccggttccggcgaggtagactcattcagtctggggttgctctgtattagcatcatgatcgaagaggtgatgcgctcgcgatggtcccggaaaatgctgatgacaggaaccctagcagtctttttcctgctcattatgggccagctgacttggaacgatcttatccgtttgtgcattatggtgggggctaatgcctctgacagaatgggaatgggcacaacctacctggcattaatggccacatttaagatgaggcctatgttcgctgttggtctcctgtttcgccggcttactagcagagaggtgctgctactcaccatagggctgtcattggtcgcgagtgtggaactgccaaactccttagaggaactcggagatggcctggccatgggcatcatgattcttaaactgttgacggacttccaatctcatcagctctgggcaacactgctaagcctgacctttatcaagactaccttctcccttcactatgcttggaaaacaatggccatggttctctcaattgtgagcctgtttcccttgtgtctgagtactacctctcagaagacgacatggttaccggtcctcctggggtcccttggatgcaagcctctgaccatgttcttgatcgccgagaataaaatatggggtaggaagtcctggccactcaacgaaggcatcatggctgtagggattgtgtcgatcctgctatcatctctgcttaaaaacgatgttcccctcgcaggacctctgattgccggcggtatgttgatcgcgtgttacgtgataagtgggtccagcgctgacttatctctggagaaggccgcagaggtcagctgggaagaggaagccgagcattccggagcttcacacaatattctcgtggaagtacaggatgacggcactatgaaaatcaaggatgaggagcgagacgatacactgaccatccttctgaaagcaactttgctagccgtgagtggcgtctatcccctgagcattccagcgacactctttgtttggtacttctggcaaaagaagaaacagcgctctggggtgctgtgggacaccccttcacccccagaagtggagcgggctgtccttgatgacggaatatatagaatcatgcagaggggtttactgggccgtagccaggtgggggttggagtattccaagaaaacgtgtttcatacgatgtggcacgtcactcgcggcgccgtgctcatgtaccagggtaagcggttggagccgagttgggcaagcgttaaaaaggacctgatttcctacgggggaggctggagactcaggggctcttggaatatgggggaggaagtgcaggtcatcgccgtggagcctggcaaaaatcccaagaatgtacagaccgctccaggtacattcaagacccccgaaggcgaggtcggggccattgcactggattttaaacctggaacatcgggcagcccaatcgtgaaccgagaaggtaagatagttgggctttatggaaatggcgtggtcactacctcaggcacgtacgtgtccgctatcgcccaagcgaaagccagtcaggaggggcccctgcctgagattgaagacgaggttttccggaagcgcaacttgacaatcatggatctacacccgggatctggtaaaactagaaggtatctgccagcaattgtgcgggaagctatcaagcgaaagctcagaaccttaatactggcccccacacgcgtcgtggctagcgagatggcagaagcccttaaaggcatgcctattaggtaccagaccactgccgtaaagtccgagcataccgggaaagagatcgtggacctgatgtgccacgctacatttacgatgcgtctcttgtcaccagttcgggtccccaattataacatgatcattatggatgaagcgcatttcactgacccttctagcatcgcagccagaggatacataagtaccagggtgggcatgggtgaggctgccgcaatttttatgacagccaccccgcccgggtccgtggaggctttcccacaaagcaatgcggtcatccaggatgaggaacgcgacattcctgagcgatcttggaactcaggatatgagtggatcactgattttcccggcaagacagtatggttcgtgccatccataaaaagtggcaatgacattgccaactgtctgagaaagaatgggaagcgggttatccagctcagcaggaaaacctttgatacggaataccagaagactaaaaacaacgactgggactacgtggtcacaaccgatatctcggagatgggagcaaatttccgcgctgaccgtgtgattgatcctagacggtgcctgaagcccgttatccttaaagacggtccagaaagggtgattctagccggcccgatgcctgtcaccgtggcatctgccgctcaacgccgagggagaataggacggaaccacaataaggagggcgatcagtatatctacatgggtcagcccctgaacaatgacgaggatcatgcccactggactgaagcgaagatgttgttagacaacattaatacaccagaggggatcatccccgcactgttcgaacctgagagggaaaaatccgccgctgtagatggcgagtatcgcctcagaggagaggccaggaagacctttgtggaactgatgcggcgtggcgaccttccagtttggctgagctacaaagtcgcttcagaggggttccagtatagtgatcgccgatggtgctttgacggagaaagaaacaatcaagtgctcgaggaaaacatggatgtggagatttggacaaaggagggtgaaaggaaaaagttgcggccccgctggctggacgcaagaacttactctgaccctctagccctgagggagttcaaagaatttgctgccggccggcgatccgtcagcggggatctcatacttgagatcggaaagctgccgcagcacttaacgcagagagcacagaatgcgttggacaacctggttatgctccataattcagaacaaggcggtcgcgcctataggcacgctatggaggagctgccagataccattgaaacacttatgctgctcgccttgatcgcagtgctgactgggggcgtaaccttattctttctaagtggacggggcctggggaagacaagcattggactcctttgtgtgatggcttcctctgtcctgttgtggatggccagcgtggagccccattggatcgcagcctccataatcctggagttctttctcatggttctgcttattcctgagcccgaccgtcagagaaccccacaggataaccagctcgcttacgtggtcatcggtctgttgttcatgattctgactgtagcggccaatgagatgggcttactagaaacgaccaaaaaggacctggggatcggacacgtggcagttgagaaccaccatcacgctgccatgctcgatgtggaccttcatcctgcctcagcatggacactgtacgctgtcgccactaccataattacacccatgatgaggcacaccatcgaaaacactacagcgaatatttctttgacggctatcgccaaccaagcagccatactgatgggcctcgataaaggttggccaatcagtaagatggacattggggtgcctctgcttgctttaggctgctattcgcaggtcaatccgctgaccctcactgcagccgtgttgatgctggttgcgcattacgctatcattggacccggcctacaggccaaagcaacacgcgaggcccaaaagcggaccgctgccgggatcatgaagaacccaaccgtggatggaatagtagcaattgacctggatcctgtggtctatgacgctaaatttgaaaagcagctcggccagatcatgcttctgatcttgtgtacaagccagattctgctcatgcgaactacgtgggccctgtgcgagtccatcaccttagcgacaggtccccttactaccctgtgggaggggtctccaggaaaattctggaatacaaccatagccgtttcaatggcaaacatttttagaggcagctacctcgctggtgccggcctagcattctccctgatgaagagtctagggggaggcaggcgcgggactggagctcaaggcgaaacgctgggtgagaaatggaagcggcagctcaatcagctttctaagagcgagttcaacacatataaaagatcagggatcatggaggtggaccgttccgaagccaaggagggactgaaaaggggcgagaccactaagcacgccgtcagtcggggtaccgcgaaattgcgctggtttgtggaacgaaatctggtaaagcctgagggcaaggtgattgatctcgggtgtggaagaggcgggtggagctactattgcgctggactaaagaaggttacagaagtgaaaggctacactaagggtgggcccggacacgaggaaccgatcccaatggcaacctacggctggaacctggtcaaacttcattctggcaaggacgtgttctttatacctcccgagaaatgtgatacactgctatgcgacatcggggagtcctcaccaaatcccacgattgaagagggaaggaccctccgggtcctgaagatggtggaaccttggttgcgcggtaaccagttctgtatcaagattctgaatccgtatatgcccagcgttgtagagactctcgagcaaatgcagagaaaacacggcgggatgcttgtgaggaacccactgtcgcgaaattctacacatgaaatgtactgggtcagttgcggaaccggcaacatcgtgtccgccgttaatatgactagccggatgttactgaaccgttttacaatggctcacagaaagcctacctatgagcgcgatgtggacttgggtacggggaccaggcacgtcgccgtggaacccgaggtagcaaacctcgatattatcggacagcggatagaaaatattaaacatgagcacaagtcaacatggcattacgacgaggataacccttataaaacttgggcctaccacggctcctatgaagtgaagccatctggcagcgctagttccatggttaatggggtcgtgaagctgctaaccaaaccctgggacgtgatccctatggtcacacagatcgcgatgactgataccacaccattcggacaacagagagtttttaaggagaaagtggacacccgcactcccaaggccaaaaggggtacggcacagattatggaagtaacagctcgatggctttggggcttcctgagccggaacaagaagccgagaatatgtaccagggaggaatttactcgcaaagtgcgttctaatgccgcaatcggggccgtcttcgtggacgagaaccaatggaactcagctaaggaggccgttgaagatgagcggttttgggacctcgtgcatagagaaagggagctgcacaaacagggaaagtgcgcgacctgcgtctacaacatgatgggcaaacgcgaaaagaagttgggtgagttcgggaaagcaaagggaagtcgagccatttggtacatgtggctgggcgctcggtttctcgagttcgaagcccttggcttcatgaatgaggatcactggttttccagagaaaacagcctgtctggggtggagggagagggtttacataaactgggctatatcttgagggacatttcgaagatccctgggggaaatatgtacgcagatgacacagctggctgggatacgcgcataaccgaagacgatctccagaacgaggccaaaatcactgacattatggaaccagagcacgctctgctagccaaggcaatcttcaaacttacatatcagaataaggtagttagagtgcaacggcccgcgaagaacggtaccgtcatggatgtgatttcaaggcgtgaccagcgagggagcggacaggtgggcacttacggcctgaatacatttaccaacatggaagcccagctcatccgccaaatggagtccgaggggatattcagtccttctgaactggagacaccaaacttggctgaaagagccttagattggctggagaaatatggagtcgaacggctcaagaggatggcaattagcggtgacgactgtgttgtgaaacccatcgatgaccgctttgctactgcccttaccgcactgaatgatatgggcaaggtaagaaaagacatcccgcagtgggagccttccaaggggtggaacgattggcaacaggtgcccttctgctcacatcactttcaccaactaattatgaaggacggacgggagatagtcgtgccatgtaggaatcaggatgaactggttggccgagcccgtgtgagtcagggtgcggggtggtctctcagagagacggcttgcttgggaaaaagctacgcccagatgtggcaactgatgtatttccatcgccgggaccttaggctggcagccaacgctatctgttccgccgtccctggcgattgggtgcccacctcaagaacaacttggagcattcacgcacatcaccagtggatgaccacagaagacatgctctctgtatggaatcgcgtttggatcgaggaaaacccatggatggaggataagactcatatttccagttgggaggacgtgccctacttaggcaaacgggaagaccagtggtgcgggagcctgatcggattgaccgctagggccacgtgggcgacaaatatacaagtcgctatcaaccaggtgcgaagactgattggtaatgagaactacctcgattatatgacctcgatgaagcggtttaaaaatgaatccgaccctgagggcgccctttggtga

SEQ ID NO: 13770 - RNA, 9879 nt, synthetic construct
  misc_feature 1..9879: note = derived and/or modified CDS sequence (opt3) from DENV-1__GQ199793__SS-prME
  source 1..9879: mol_type = other RNA
agcgtgaccatgctgctcatgcttatgcccacagccctggctttccacttgactacgagaggcggggagcctcatatgatcgtcaccaagcaggaaaggggaaaatccttactgtttaagacatctgcaggtgttaacatgtgcactctaattgccatggacctcggcgagctgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagagcaggacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattaccccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcaactacatcacaagagacctggaatcggcaggacctgttggtgacattcaaaactgctcacgccaagaagcaggaagtagttgtgctcggtagccaagagggggctatgcacaccgccctgacgggcgcaaccgaaatccagacaagtggaactaccacaatttttgccggccatttaaaatgccgtctgaagatggataaactaactctcaaggggatgtcttatgtcatgtgtaccggatccttcaaactggagaaggaagtggctgagacgcagcacggtacagtccttgtgcagataaagtacgagggcaccgacgcgccttgcaaaatcccattcagcactcaagatgaaaagggggttacacagaacggacgcttgattaccgcaaatcccatcgtgactgacaaagagaagcctgtaaacatagaagccgagccaccctttggcgagtcgtatattgtcatcggtgctggggaaaaagccctgaagctctcttggttcaagaaaggctcctcaatcggaaagatgtttgaggcaaccgccagaggcgctaggcggatggccattctgggggatacagcatgggacttcggaagtatcggtggcgtgtttacgagcgttgggaaacttgtgcatcagattttcggaaccgcgtacggcgtcctgttttccggtgtgtcttggactatgaagatagggatcggcgtattgctcacatggctgggattaaatagccgatcaaccagtctgtccatgacatgtattgctgtgggcctagttactctctacctgggggtcatggtgcaggccgatagcggatgcgtgatcaactggaaaggccgcgaacttaagtgtggttctgggatcttcgtcaccaatgaggttcacacgtggacagaacaatataagtttcaggcagactcaccgaaaagattgagtgccgctattggaaaggcctgggaggagggcgtgtgcggtataaggagcgcaacccggctggaaaacatcatgtggaaacagatttccaacgagctcaatcatatcctgttagaaaacgacatgaagttcactgtggtagtcggcgatgtggttgggattctggctcagggaaaaaagatgatccgccctcaacccatggagcacaaatactcttggaagtcgtggggcaaggccaaaataatcggggcggacgtgcagaataccacatttattatcgatggaccaaacactcctgaatgtcccgacgatcagagagcctggaatatttgggaggtcgaggactatggcttcggtatctttaccacaaacatatggcttaagttgagggatagctacacgcagatgtgcgaccaccgtctcatgtccgctgcaattaaagattcaaaggccgtgcatgctgacatggggtattggatcgaaagtgagaaaaatgaaacctggaagctggcccgggcatctttcattgaggttaagacttgtatctggccaaaaagccacacactatggtccaacggagtgctggaatcagagatgataatccccaagatttacggcggtcctatcagccaacataattatcgaccaggctacttcacccagactgcggggccgtggcacctcggaaaactggagcttgattttgacttgtgcgaaggcacaaccgtagtcgtggatgagcactgcgggaacagaggaccctctctgaggacgactaccgtgacaggcaagattatccatgaatggtgttgccgctcctgtaccttacctccactccggttcaaaggtgaggacgggtgctggtacggaatggagataagacccgtcaaggaaaaggaggaaaatctggttaaaagtatggtgagcgccggctctggtgaggtagactccttttcacttggcctgttgtgtattagtatcatgatcgaagaggtgatgaggagccgctggtcgcgaaagatgctcatgactgggacactggctgtcttcctactgctcattatgggacagctgacctggaacgatcttatccggttgtgcattatggtgggcgccaatgcatccgaccgtatggggatgggaacaacttatctggctttaatggccacctttaaaatgagacctatgttcgcagttggcctcctgtttaggcgccttacgtctcgggaggtgctgctactcacaataggtctgagcttggtcgcctcagtggaactgccaaacagtttagaggaactcggggatggactggctatgggcatcatgattcttaagctgttgaccgacttccaatcccaccagctctgggcgactctgctatctctgacctttatcaaaacaactcttagcctccattacgcctggaagaccatggcaatggttctgtccattgtgtcattgttccccctgtgtttaagcacgacaagtcagaagaccacttggctcccggtcctgcttggctctctggggtgcaaacctttgacaatgtttctcatcaccgagaataagatatggggaagaaaatcctggccactgaacgaaggtatcatggctgtaggcgtggttagcattctactgtcgtcacttctcaagaacgatgtgcccctggccgggcctttgatcgccggaggcatgttaattgcttgttatgtcatctctggtagttccgcagacctgagcctcgagaaagccgcggaggtgtcttgggaagaggaagctgagcacagcggggcctcccataatatactggtagaagtgcaggatgacggaactatgaagattaaagatgaggagagggacgatacacttaccatcctgttgaaggcaacgctactggccgtctcaggcgtttaccccctcagtatcccagctactctgttcgtgtggtatttttggcaaaagaaaaagcagcgaagcggcgtgctttgggacaccccttctcccccagaagtcgagcgcgcagtgttagatgacgggatttaccggataatgcagagaggactgctcggtaggtcccaggttggcgtaggggtgttccaagaaaacgtcttccacacaatgtggcacgtgacccgtggagccgttttgatgtatcagggcaaacgcctggagccgtcatgggcgagtgtgaagaaagacctcatcagctacggtgggggatggcggctgcagggctcctggaatgctggcgaggaagtccaggtgattgccgtagagcctgggaagaaccccaagaatgtccaaacagcaccaggaacttttaaaacccccgaaggtgaggtgggcgccatcgctcttgatttcaagcctgggacgtctggatcgccaattgttaacagagaaggcaaaatcgtgggtctgtacgggaatggagtcgtgacaactagcggcacctatgtttcagccatagcacaggctaaggcctcccaggagggccccttgcctgagatcgaagacgaggtgtttaggaaacgaaacctaacaattatggatctgcatccggggagtggaaagacccggcgctacctcccagcgatcgtcagagaagccattaagaggaaattacggactctgatccttgcacccacccgagtggtagcttctgagatggccgaagctctgaagggtatgcctataagatatcaaacaacggcagtgaaaagcgagcacactggcaaggagattgttgacctcatgtgccatgccaccttcacaatgcgcttgctgtccccagtcagggtgcccaattacaacatgatcatcatggatgaagcccactttaccgacccttcatctattgctgcgcgtgggtatatcagcactcgggtgggaatgggcgaggcagccgctatattcatgacagccaccccgcccggtagtgtcgaagcatttccacagtccaatgccgtaattcaggatgaggaaagagacatccctgagaggagctggaactctgggcatgagtggattacggatttccccggaaaaactgtgtggtttgttccatcaatcaagtccggcaatgacatagctaactgtctccgcaagaatggcaaacgagtgattcagctgagtagaaagacattcgataccgaataccaaaaaaccaagaacaacgactgggactatgtcgtgactacagatatcagcgagatgggggcgaattttcgggccgacagggttatcgatcctcgccgttgccttaaacccgtgattctaaaggacggaccagaaagagtcatcctggcaggtccgatgcctgtgaccgtagcttcggccgcacagcggaggggccgcattgggcgaaaccacaataaggagggagatcagtacatatacatgggccagcccttgaacaatgacgaggatcacgcccattggacagaagctaaaatgttactggacaacatcaatactccagagggtattatccccgccctcttcgaacctgagagagaaaagtctgcggcaatcgatggggagtatcggctgaggggcgaggcccgcaaaacgttcgtggaacttatgagaaggggagacctgccagtttggctctcctacaaggtcgctagcgagggctttcaatattcagatcggcgttggtgcttcgacggggaacgcaacaatcaggtgttggaggaaaacatggatgtggagatttggaccaaagagggagaacgaaagaaactgagacccaggtggctagacgcccggacatacagtgaccctctggctctccgcgagtttaaggaattcgcagccggtagaaggtctgtctccggcgatcttatactggagatcgggaagttaccgcagcacttgactcagcgggctcaaaatgccctggacaacctcgttatgctgcataatagcgaacagggaggccgagcatatagacacgcgatggaggagcttccagataccattgaaacactgatgctcttggccctgatcgctgtgttaaccggtggggtaactctatttttcctgtcaggccgcggactcggcaaaacgagtattgggcttctgtgtgtgatggccagctccgtcttgctgtggatggcatctgtggagccccactggatcgctgccagcataatcctcgaatttttcctgatggttcttctcattcctgagcccgacaggcagcggaccccacaggataaccaactggcatacgtggtcatcggattgctgtttatgattttaacagtagccgctaatgagatgggtctactggaaactaccaagaaagacctcggcatcgggcatgtggcggttgagaaccaccatcacgccacaatgcttgatgtggacctgcatcctgcatccgcttggaccttgtatgccgtcgccactacaataattacgcccatgatgcgtcacaccatcgaaaacactacagcaaatatttcactgaccgctatcgccaaccaggcggctatactcatgggactggataagggctggccaatctctaaaatggacattggtgtgcctcttttagccctggggtgctacagtcaggtcaatccgctcaccttgacagcagccgtgctgatgctagttgctcactacgcaatcattggccccggactgcaagccaaggcgactagagaggctcagaagaggacggccgcaggcatcatgaaaaacccaaccgtggatgggatagtagccattgacctcgatcctgtggtctatgacgctaagttcgaaaaacagcttggacagatcatgctgttgatcctgtgtacatcgcaaattctcctgatgcgcactacctgggccttatgcgagagcatcacacttgcaaccggccccctgactacgctctgggagggttccccagggaagttttggaatacaaccatagctgtttctatggccaacattttccggggatcatacctagcgggcgccggtctggcatttagcttgatgaaatccctgggcgggggacgaagaggcactggggctcagggagaaaccctcggcgagaagtggaagaggcagcttaatcagctgagtaaatctgaattcaacatctataagcgcagcggtattatggaggtggaccggtcagaagccaaagaggggttgaagagaggagagacaactcgtcatgcagtctccaggggcaccgctaaactgcggtggttcgtggaacgcaatctcgtaaagcctgagggtaaggtgatcgatttaggctgtgggcgaggaggctggagttactattgcgccgggctgaaaaaggttacagaagtgaaaggatacacgaagggcggtcccgggcacgaggaaccgataccaatggccacctatggatggaaccttgtcaaactgcatagcggcaaggacgtgtttttcactcctcccgagaaatgtgatacactactctgcgacatcggcgagtcttccccaaatcccaccattgaagaggggagaactctgagggtcttgaagatggtggaaccttggctgcggggaaaccaattttgtatcaagattctcaatccgtacatgccctcagttgtagagacacttgagcagatgcagcgcaaatacggtggcatgctggtgagaaacccattaagcaggaattcgacccacgaaatgtattgggtctcttgcgggacgggaaacatcgtgagtgcggttaatatgacctcccgaatgctgttgaaccggttcacaatggctcaccgtaagcctacttacgagagagatgtggacctcggcgcaggtacccgccatgtcgccgtggaacccgaggtagctaacctggatattatcgggcagaggatagaaaatattaaacacgagcataagagcacatggcactatgacgaggataacccttacaaaacttgggcctatcatggatcatacgaagtgaagccatccggctctgcaagcagtatggttaatggcgtcgtgaagctacttaccaaaccctgggacgtgatccctatggtcacacaaatcgccatgaccgatactacgccatttgggcagcagcgggttttcaaggagaaagtggacacaagaacccccaaggctaaacgcggaactgcgcaaattatggaagtaaccgccaggtggctgtggggttttctctcccgaaacaagaagccgcggatatgtacaagagaggaattcacgaggaaagtgcgcagcaatgcagctatcggcgccgtctttgtggacgagaaccagtggaattctgcaaaggaggccgttgaagatgagcgtttctgggacctggtgcagaaagaacgggagttgcacaagcaggggaaatgcgctacctgcgtctataacatgatgggaaagagagaaaagaaactgggcgagtttggtaaggccaaagggtcaagggcgatttggtacatgtggctcggagcacgcttccttgagtttgaagccctgggcttcatgaatgaggatcactggttcagtcgagaaaactccttaagcggcgtggagggggagggactgcataagttgggttacatcctccgggacatttctaaaatccctggcgggaatatgtatgctgatgacactgccggatgggatacaagaataaccgaagacgatctgcaaaacgaggcaaagatcactgacattatggaaccagagcacgctctacttgccacatcgatctttaaactgacctaccagaataaggtagttagggtgcagcgccccgctaagaacggcacagtcatggatgtgatttcaagacgggaccagaggggtagcgggcaagtgggaacttatggcctcaataccttcacgaacatggaagcccagctgatccgtcagatggagtccgagggcatatttttgcctagtgaattagagaccccaaacctggcagaacgagtcctcgattggcttgagaaatacggggttgaacgcctgaagagaatggcgatttctggagacgactgtgtggtaaaacccatcgatgaccggttcgccacagctctaactgccctgaatgatatgggtaaggtgaggaaagacatcccgcagtgggagcctagcaagggctggaacgattggcaacaggtccccttttgctcccatcacttccaccagctcattatgaaggacgggcgcgagatagtggttccatgtagaaatcaggatgaattggtgggacgggcaagggtctcacaaggcgctggttggagtctgcgagagaccgcctgccttgggaaatcttatgcacagatgtggcagctgatgtactttcatcgtagagacctccgcttagccgcgaacgctatctgtagcgccgtgcctgtagattgggttcccacatcccggactacctggtcaattcacgcacatcaccaatggatgacgacagaagacatgctgagcgtgtggaatagggtctggatcgaggaaaacccatggatggaggataagacccatgtgtcttcctggggagacgttccctatttgggcaaaagagaggaccagtggtgcggcagtctgattgggctcactgcccgcgctacatgggccagcaatatccaggtggcaataaaccaggtccggaggcttatcggaaatgaaaactacctggattacatgacctcgatgaagcgattcaaaaatgagggtgaccctgaaggcgctctatggtga

SEQ ID NO: 13771 - RNA, 9879 nt, synthetic construct
  misc_feature 1..9879: note = derived and/or modified CDS sequence (opt3) from DENV-1__GQ199795__SS-prME
  source 1..9879: mol_type = other RNA
agcgtgaccatgctgctcatgcttatgcccaccgcactggctttccacttgactacgcggggaggggagcctcatatgatcgtctccaagcaggaaaggggaaaatctttactgtttaagacctcagccggtgttaacatgtgcacgctaattgccatggacctcggcgagctgtgtgaagatactatgacctacaaatgcccacggattacagagaccgaaccggacgatgtggactgttggtgcaatgcgactgatacatgggtgacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaggacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaggcccctacaaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccgggagcttcaaactggagaaggaagtcgccgagacgcagcacggtacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattgtgatcggtgccggggaaaaagctctgaagctctcctggttcaagaaaggctcaagtatcggaaagatgtttgaggccaccgcaagaggcgccaggcggatggctattctgggggatacagcctgggacttcggaagcatcggtggcgtttttacgtccgtggggaaacttgtccatcagattttcggaaccgcatacggcgtgctgttttctggtgtaagctggactatgaagatagggatcggcgtgttgctcacatggctgggattaaattcacgaagtacctccctgagcatgacatgtattgcggttggcctagtcactctctacctgggggtgatggtgcaggctgattctggatgcgtcatcaactggaaaggccgcgaacttaagtgtggttcagggatcttcgttaccaatgaggtgcacacgtggacagaacaatataagtttcaggccgacagtccgaaaagattgagcgcagccattggaaaggcttgggaggagggcgtgtgcggtataaggtccgccacccggctggaaaacatcatgtggaaacagatttctaacgagctcaatcatatcctgttagaaaacgacatgaagttcactgtagtcgtgggcgatgttgcagggattctggctcagggcaagaagatgatccgccctcaacccatggagtacaaatattcgtggaaaagctggggcaaggccaagataatcggggcggacgtgcagaataccacatttattatcgatggaccaaacactcctgaatgtcccgacgatcagagagcctggaatatttgggaggtcgaggactacggcttcggtatctttaccacaaacatatggcttaagttgagggattcctatacacaggtgtgcgaccaccgtctcatgtcagctgcaattaaagatagtaaggccgttcacgctgacatggggtactggatcgaatctgagaaaaatgaaacctggaagctggcccgggcatccttcattgaggtgaagacttgtatctggccaaaatcccatacactatggtcaaacggagtactggaaagcgagatgataatccccaagatttatggcggtcctatctctcaacacaattaccgaccaggctacttcacccaggcggccgggccgtggcatctcggaaaactggagcttgattttgacttgtgcgaaggcactacagtcgtggtggatgagcactgcgggaacagaggaccctccctgaggaccacgactgtcaccggcaagattatccacgaatggtgttgccgcagttgtacattacctccactccggttcagaggtgaggacgggtgctggtatggaatggagataaggcccgttaaagaaaaggaggaaaatctggtaaagagcatggtatctgctggctccggtgaggtggactcatttagtcttggcctgttgtgtattagcatcatgatcgaagaggtcatgcgctcgcgatggtcccggcgtatgctcatgaccgggactctggccgtgttctttctactgattatgggacagctcacatggaacgatctgatcagactttgcattatggttggcgcaaatgcttctgacaggatggggatgggaaccacatacttggccctgatggcaactttcaaaatgcgccctatgtttgccgtgggcttactcttccggagactgaccagcagggaggtccttctgctaacgataggtctctcactggtggctagtgttgaattgccaaactccctggaggaattaggggatggactcgcgatgggcatcatgattctgaaacttctgacagactttcaatctcatcagttgtgggccaccctcctgagcctaactttcatcaaaaccacattttccctgcactatgcatggaagactatggctatggtgctttcaattgtcagcctcttccccctgtgtttgagtaccacgtctcagaaaacaacctggctgccggtattactcggctccctggggtgcaagcctcttactatgtttctgatcgccgagaataagatatggggacgacgcagctggccattgaacgaaggtatcatggccgtgggcattgtttcgatcctcctgtcatctctactgaaaaacgatgtgccccttgctgggcctctcattgcaggaggcatgctgatcgcctgttacgtcataagtggttccagcgcggacttgtctttagagaaggctgccgaggtgagctgggaagaggaagcagagcattccggggcctcacacaatattctggtagaagtgcaggatgacggaacaatgaaaatcaaggatgaggagcgggacgataccctcactatcctgcttaaagctacactgttggcagtcagtggcgtttatcccctaagcattccagccaccctgttcgtgtggtacttctggcaaaagaaaaagcagagatctggcgtgctctgggacacgccttcacccccagaagtcgagagggcggtgctggatgacgggatatatcgtatcatgcagcgcggacttttaggtcggagccaggttggcgtaggggtgtttcaagaaaacgtcttccatactatgtggcacgtgaccagaggagctgttctgatgtaccagggcaagaggctcgagccgagttgggccagcgtgaaaaaggacttgatttcctacggtgggggatggcgactgcagggctcttggaatacaggcgaggaagtccaggtgatcgcagtagagcctgggaaaaaccccaagaatgtccaaaccgccccaggaacatttaaaactcccgaaggtgaggtgggcgctattgccctcgatttcaagcctgggacctcgggaagcccaatcgttaaccgggaaggcaagatagtgggtctgtatgggaatggagtcgtgacgacatcaggcacttacgtttccgcaatcgctcaggccaaagcgagtcaggagggcccccttcctgagattgaagacgaggtgtttcgcaagagaaacctgaccatcatggatttgcacccggggtctggaaaaacaaggcggtatctaccagccattgtccgagaagcaatcaagagaaaactgcgcaccctcatattagctcccactagggtggtagccagcgagatggctgaagcactgaagggtatgcctattcgttaccaaaccacagccgtgaagtccgagcatacgggcaaagagatcgttgaccttatgtgccacgccactttcaccatgcggctgctctcaccagtcagagtgcccaattataacatgatcattatggatgaagctcattttacagacccttctagcatcgcggcaagggggtacataagtacccgcgtgggaatgggcgaggccgctgccattttcatgactgcaacaccgcccggttccgtcgaagcctttccacagagcaatgctgtaatccaggatgaggaacgagacattcctgagagatcttggaactcagggtatgagtggatcaccgatttccccggaaagacggtgtggtttgttccatccataaaaagtggcaatgacattgcgaactgtttgcggaagaatggcaaaagggtgatccagctgagccgcaagactttcgatacagaataccaaaagaccaaaaacaacgactgggactacgtcgtgaccactgatatctcggagatgggggccaatttccgtgcagacagagttattgatcctcggaggtgcctcaagcccgtgatcctgaaagacggaccagaacgcgtcattcttgctggtccgatgcctgtgacagtagcctctgcagcccagcgaagaggccggatagggaggaaccacaataaggagggagatcagtatatctacatgggccagcccctaaacaatgacgaggatcatgctcactggaccgaagccaaaatgctgttggacaacattaatacaccagagggtatcatccccgcgttatttgaacctgagcgcgaaaagtccgcagccattgatggggagtatagactgaggggcgaggctcggaagactttcgtggaactcatgcgtcgcggagacctgccagtttggcttagctacaaagtcgcctcagagggctttcaatatagtgatcgaagatggtgcttcgacggggaaaggaacaatcaggtgctggaggaaaacatggatgtggagatatggacgaaggagggagaacggaaaaagctccgccccagatggttggacgctaggacctactctgaccctctggcactacgggagtttaaagagttcgccgctggtcgaagatccgtcagcggcgatctgatcctcgagattgggaaacttccgcagcacctgacacagcgcgcccaaaatgcattagacaacttggttatgctgcataattcagaacagggaggcagggcgtatcggcacgccatggaggagctcccagatactatcgaaaccctgatgcttctggctctcattgccgtgttgacaggtggggtaaccctgtttttcttaagtggccgtggactaggcaaaactagcatcgggctgctctgtgtgatggcatcctctgtccttctgtggatggctagcgtggagccccattggatagccgcatccatcattttggaatttttcctgatggttctcctgatccctgagcccgacagacagaggacgccacaggataaccaacttgcctacgtggtcattggactcctgtttatgatcttgaccgtagctgcgaatgagatgggtctgttagaaacaactaagaaggacctaggcatagggcacgtggccgttgagaaccaccatcacgcagctatgctggatgtggacctccatcctgcctcagcctggaccctttacgcagtcgctacaaccattatcactcccatgatgcgccacacaattgaaaacacgaccgccaatatctctctgactgcgatagctaaccaggccgcaatcttgatgggactggataaaggctggccaattagtaagatggacatcggtgtgcctctcctggcccttgggtgctattcgcaggtcaatccgttaacactgaccgctgcagtgctcatgttggttgcccattacgcgattatcggccccggactgcaagctaaagccacccgggaggcacagaagcgaacagccgctggcataatgaaaaacccaactgtggatgggattgtagccatcgacctagatcctgtggtctatgacgcaaagttcgaaaagcagctgggacagatcatgctccttattctgtgtacgagccaaatcttgctgatgagaaccacatgggctctctgcgagtccataactctggccaccggccccttaacaaccctttgggagggttctccagggaaattttggaatactacgattgcggtttcaatggccaacatcttcaggggaagctacctggcaggcgctggtctcgccttctccctaatgaagagtctgggcgggggacgccggggcacaggggcacagggagaaaccttgggcgagaaatggaagagacagctgaatcagctctctaaaagcgaatttaacacttataagcgttcaggtattatggaggtggacaggtccgaagctaaggaggggcttaaacggggagagaccacaaagcacgccgtcagtcgcggcactgccaaactgcgatggttcgtggaaagaaatttggtaaagcctgagggtaaagtgatcgatctgggctgtgggaggggaggctggagctactattgcgcggggctcaagaaggttaccgaagtgaaaggatacacaaagggcggtcccgggcacgaggacccgataccaatggctacgtacggatggaacttagtcaaactgcattctggcaaggatgtgtttttcatccctcccgaaaaatgtgacacccttctgtgcgatattggcgagtcctcaccaaatcccactatcgaggaagggcggacactacgcgtcctcaagatggtggagccttggctgagaggaaaccaattttgtattaaaatcttgaatccgtatatgcccagcgttgtagaaaccctggagcagatgcagaggaagcacggtggcatgctcgtgcgaaacccactttcgagaaattctactcatgagatgtactgggtcagttgcgggacaggaaacattgtgtccgcagttaatatgaccagccgtatgctgttaaacagattcacgatggcccaccgcaagcctacctatgaaagggacgtggatctgggcgctggtacacggcacgtcgccgtggagcccgaagtagcaaacttggacatcatagggcagagaattgagaatatcaaacatgaacacaagtcaacttggcattacgatgaggacaacccttataaaacctgggcctaccacggatcctatgaggtgaagccatctggcagcgctagttccatggttaatggcgtcgtgaaactcctgacaaagccctgggatgtgatccctatggtcactcaaattgcgatgaccgacacaaccccatttgggcagcagcgcgttttcaaggaaaaagtggacactaggacgcccaaggccaaacgaggaacagcacaaataatggaggtaaccgctaagtggctatggggttttcttagccggaacaaaaagccgagaatctgtactagggaagagttcacccgcaaggtgcgttctaatgccgcaattggcgccgtctttgtggatgaaaaccagtggaactcagctaaagaggccgttgaggacgaacggttctgggatctggtgcatagagagagggaactccacaagcaggggaaatgcgcgacatgcgtctacaacatgatgggaaagcgcgagaaaaagctgggcgaatttggtaaggcaaaagggagtcgagccatctggtacatgtggttgggagctcggttcctggagttcgaggccctcggctttatgaatgaagaccactggttctccagagagaacagcctttctggcgtggaaggggagggactgcataagttaggttatattctgagggatatctcgaaaatacctggcgggaatatgtacgcagacgatacggctggatgggacacccgcatcactgaggatgacttgcagaacgaagccagaattacagatatcatggagccagaacacgctctcctggccaagtcaatttttaaactaacctatcaaaataaggtagttcgggtgcagaggcccgccaagaatggcactgtcatggacgtgatcagccgtcgagatcagcgcggttccggacaggtgggaacatacggccttaataccttcacaaacatggaggcgcaactgataagacagatggaaagtgagggcatattttctcctagcgagctcgaaactccaaacctggccgagcgggtcttggactggttagaaaagtatggggttgagaggctgaagcgcatggctatctccggagacgattgtgtggtaaaacccatcgacgatagattcgccaccgcactcacggctcttaatgacatgggtaaggtgcggaaagatattccgcagtgggaaccttcaaagggctggaacgactggcagcaagtccccttttgcagtcatcacttccaccagctgataatgaaagatgggagggagatcgtggttccatgtcgaaatcaggacgagctagtgggacgtgccagagtctctcagggcgcaggttggagcctgcgcgaaaccgcctgcctcgggaagtcctacgcgcaaatgtggcagttgatgtattttcatcggagggatctgagacttgctgccaacgcaatttgttcagccgtgcctgtagactggatccccacaagccgcactacctggtctattcacgctcatcaccagtggatgacaactgaggatatgctgtccgtttggaatcgggtgtggatcgaagagaacccatggatggaagacaagacccatataagtagctggggagacgtcccctacctcggcaaaagggaggatcaatggtgcggctcgttaatcgggctgacggcccgagcaacatgggctaccaatattcaggtggccatcaaccaggttagacggttgattggaaatgagaactacctggactatatgacttccatgaagaggttcaaaaatgaatctgatcctgagggtgcgctctggtga

SEQ ID NO: 13772 - RNA, 9873 nt, synthetic construct
  misc_feature 1..9873: note = derived and/or modified CDS sequence (opt3) from DENV-1__FJ882547__SS-prME
  source 1..9873: mol_type = other RNA
agcgtgaccatgctgctcatgcttatgcccaccgcactggctttccacttgactacgaggggaggggaacctcatatgatcgtctccaagcaggaaaggggaaaatctttactgtttaagacctcagccggtgttaacatgtgcacattaattgccatggacctcggcgaactgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccgtgctgaggaaactttgcattgaagctaagatctctaatacgaccacagatagccggtgtccaactcaaggagaggccaccctggtcgaagaacaggacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatgtgtactggtagcttcaaactggagaaggaagtcgctgagacccagcacggaacggtgcttgttcagataaagtacgagggcacagacgcgccttgcaaaatcccattctcgacccaagatgaaaagggggtgactcagaacggacgcttgattacagcaaatcccatcgtaaccgacaaagagaagcctgtcaacatagaagccgagccaccctttggcgagtcttatattgtgatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtttttacatccgtggggaaacttgtccatcagattttcggaacggcgtacggcgtgctgttttctggtgtaagctggaccatgaagatagggatcggcgtgttgctcacttggctgggattaaattcacgaagtacatccctgagcatgacctgtattgctgttggcctagtcacactctacctgggggtgatggtgcaggccgattctggatgcgtcatcaactggaaaggccgcgaacttaagtgtggttcagggatcttcgttactaatgaggtgcacacctggacggaacaatataagtttcaggcagacagtccgaaaagattgagcgccgctattggaaaggcctgggaggagggcgtgtgcggtataaggtccgcaacacggctggaaaacatcatgtggaaacagatttctaacgagctcaatcatatcctgttagaaaacgacatgaagctgaccgtagtcgtgggcgatgttgctgggattcttggacagggcaaaaagatgatccgccctcaacccatggagtacaaatattcgtggaaaagctgggggaaggccaaaataatcggagcggacgcccagaatactaccttcattatcgatggcccaaacacacctgaatgtcccgacgatcagagagcttggaatatttgggaggtggaggactacggttttgggatcttcactaccaacatatggttgaagctcagggattcctatacacaggtctgcgaccaccgtctgatgtcagcagccattaaagatagtaaggctgtgcacgccgacatgggatactggatcgaatctgagaaaaatgaaacgtggaagctagcacgggcgagctttattgaggttaagacctgtatctggccaaaatcccatactctgtggtcaaacggcgtgctcgaaagcgagatgataatccccaagatttatggtggccctatctctcaacacaattaccgaccagggtacttcacacagaccgccggaccgtggcatctgggcaaacttgagttggatttcgacctgtgcgaagggactacagtagtcgtggatgagcactgcggaaacagaggcccctccttaaggaccacgactgtgaccggtaagattatccacgaatggtgttgccgcagttgtacactccctccactgcggtttagaggggaggacggatgctggtatggcatggagataaggcccgtcaaagaaaaggaggaaaatcttgttaagagcatggtgtctgctggttccggcgaggtagactcattcagtctggggttgctctgtattagcatcatgatcgaagaggtgatgcgctcgcgatggtcccggaaaatgctgatgaccggaactctagccgtctttttcctgctcattatgggccagctgacatggaacgatcttatccgtttgtgcattatggtgggggcaaatgcttctgacagaatgggaataggcaccacatacctggccttaatggcaacttttaagatgaggcctatgttcgccgttggtctcctgtttcgccggcttaccagcagagaggtgctgctactcacgatcgggctgtcattggtcgctagtgtggaactgccaaactccttagaggaactcggagatggcctggcgatgggcattatgatgcttaaactgttgacagacttccaatctcatcagctctgggccaccctgctaagcctgacttttatcaagaccacattctcccttcactatgcatggaaaactatggctatggttctctcaattgtgagcctgtttcccttgtgtctgagtaccacgtctcagaagacaacctggttaccggtcctcctggggtcccttggatgcaagcctctgactatgttcttgatcgccgagaataaaatatggggtaggaagtcctggccactcaacgaaggcatcatggccgtagggattgtgtcgatcctgctatcatctctgcttaaaaacgatgttcccctcgctggacctctgattgcaggcggtatgttgatcgcctgttacgtgataagtgggtccagcgcggacttatctctggagaaggctgccgaggtcagctgggaagaggaagcagagcattccggagcctcacacaatattctcgtggaagtacaggatgacggcacaatgaaaatcaaggatgaggagcgagacgataccctgactatccttctgaaagctacattgctagcagtgagtggcgtctatcccctgagcattccagccaccctctttgtttggtacttctggcaaaagaagaaacagcgctctggggtgctgtgggacacgccttcacccccagaagtggagcgggcggtccttgatgacggaatatatagaatcatgcagaggggtttactgggccgtagccaggtgggggttggagtattccaagaaaacgtgtttcatactatgtggcacgtcacccgcggcgctgtgctcatgtaccagggtaagcggttggagccgagttgggccagcgttaaaaaggacctgatttcctacgggggaggctggagactcaggggctcttggaatacaggggaggaagtgcaggtcatcgcagtggagcctggcaagaaccccaagaatgtacagaccgccccaggtacattcaagactcccgaaggcgaggtcggggctattgccctggattttaaacctggaacctcgggcagcccaatcgtgaaccgagaaggtaagatagttgggctttatggaaatggcgtggtcacgacatcaggcacttacgtgtccgcaatcgctcaagccaaagcgagtcaggaggggcccctgcctgagattgaagacgaggttttccggaagcgcaacttgaccatcatggatctacacccgggatctggtaaaacaagaaggtatctgccagccattgtgcgggaagcaatcaagcgaaagctcagaaccttaatactggctcccactcgcgtcgtggccagcgagatggctgaagcacttaaaggcatgcctattaggtaccagaccacagccgtaaagtccgagcatacggggaaagagatcgtggacctgatgtgccacgccacttttaccatgcgtctcttgtcaccagttcgggtccccaattataacatgatcattatggatgaagctcatttcacagacccttctagcatcgcggcaagaggatacataagtaccagggtgggcatgggtgaggccgctgccatttttatgactgcaacaccgcccgggtccgtggaagccttcccacaaagcaatgctgtcatccaggatgaggaacgcgacattcctgagcgatcttggaactcaggatatgagtggatcaccgattttcccggcaagacggtatggttcgtgccatccataaaaagtggcaatgacattgcgaactgtctgagaaagaatgggaagcgggttatccagctcagcaggaaaacttttgatacagaataccagaagaccaaaaacaacgactgggactacgtggtcaccactgatatctcggagatgggagccaatttccgcgcagaccgtgtgattgatcctagacggtgcctgaagcccgttatccttaaagacggtccagaaagggtgattctagctggcccgatgcctgtcacagtggcctctgcagcccaacgccgagggagaataggacggaaccacaataaggagggcgatcagtatatctacatgggtcagcccctgaacaatgacgaggatcatgctcactggaccgaagccaagatgttgttagacaacattaatacaccagaggggatcatccccgcgctgttcgaacctgagagggaaaaatccgcagccgtagatggcgagtatcgcctcagaggagaggctaggaagacttttgtggaactgatgcggcgtggcgaccttccagtttggctgagctacaaagtcgcctcagaggggttccagtatagtgatcgccgatggtgctttgacggagaaagaaacaatcaagtgctcgaggaaaacatggatgtggagatttggacgaaggagggtgaaggcaaaaagttgaggccccggtggctggacgctcgcacctactctgaccctctagcactgagagagttcaaagaatttgccgctgggaggcggtccgtcagcggagatctcatacttgagatcggcaagctgccgcagcacttaacacagcgagcccagaatgcattggacaacctggttatgctccataattcagaacaaggtgggagagcgtatcgccacgccatggaggagctgccagatactattgaaacccttatgctgctcgctttgatcgccgtgctgacaggcggagtaaccttattctttctaagtggcagggggctgggaaagactagcattggtctcctttgtgtgatggcatcctctgtcctgttgtggatggctagcgtggagccccattggatcgccgcatccataatcctggagttctttctcatggttctgcttattcctgagcccgaccggcagcgtacgccacaggataaccagctcgcctacgtggtcatcggcctgttgttcatgattctgaccgtagctgcgaatgagatggggttactagaaacaactaaaaaggacctgggaatcggccacgtggccgttgagaaccaccatcacgcagctatgctcgatgtggaccttcatcctgcctcagcctggaccctgtacgcagtcgctacaaccataattactcccatgatgagacacacaatcgaaaacacgaccgccaatatttctttgactgcgatcgctaaccaagccgcaatactgatgggtctcgataaagggtggccaatcagtaagatggacattggcgtgcctctgcttgccttaggatgctattcgcaggtcaatccgctgacactcaccgctgcagtgttgatgctggttgcccattacgcgatcattggccccgggctacaggctaaagccaccagggaggcacaaaagcgcacagccgctggaatcatgaagaacccaactgtggatggcatagtagccattgacctggatcctgtggtctatgacgcaaaatttgaaaagcagctcggtcagatcatgcttctgatcttgtgtacgagccagattctgctcatgcggaccacatgggctctgtgcgagtccatcactttagccaccgggccccttacaaccctgtgggagggatctccaggcaaattctggaatactacgatagcggtttcaatggccaacatttttcgaggtagctacctcgcaggcgctgggctagccttctccctgatgaagagtttgggaggcgggagaaggggaacaggcgcacaaggtgaaaccctgggggagaaatggaagcgccagctcaatcagctttctaagagcgagttcaacacttataaacggtcaggaatcatggaggtggacagatccgaagctaaggagggcctgaaacgtggtgagaccacaaagcacgccgtcagtaggggcactgccaaattgcggtggtttgtggaacgcaatctggtaaagcctgaggggaaggtgattgatctcggatgtggccgagggggatggagctactattgcgcgggcctaaagaaggttaccgaagtgaaaggttacacaaaagggggacccggccacgaggaaccgatcccaatggctacgtacggctggaacctggtcaaacttcattctgggaaggacgtgttctttatacctcccgagaaatgtgataccctgctatgcgacatcggagagtcctcaccaaatcccactattgaagagggtagaacactcagggtcctgaagatggtggaaccttggttgcggggcaaccagttctgtatcaagattctgaatccgtatatgcccagcgttgtagagaccctcgagcaaatgcagcgcaaacacgggggaatgcttgtgagaaacccactgtcgagaaattctactcatgaaatgtactgggtcagttgcggcacaggtaacatcgtgtccgcagttaatatgaccagccgaatgttactgaaccggtttacgatggcccaccgtaagcctacctatgagagagatgtggacttggggacaggaactcgccacgtcgctgtggaacccgaggtagccaacctcgatattatcggccagaggatagaaaatattaaacatgagcacaagtcaacctggcattacgacgaggataacccttataaaacatgggcataccacggctcctatgaagtgaagccatctgggagcgccagttccatggttaatggagtcgtgaagctgctaactaaaccctgggacgtgatccctatgagcccaatcgctatgaccgatacaacaccccttgcgcagcgggtcttcaaggagaaagttgacactagaacgccgaaggccaaacgcggtacagcacaaattatggaagtgaccgctaggtggctgtggggctttctctctcgaaacaagaagcctcggatatgtactagagaggagttcaccaggaaagtacgctcaaatgccgcaatcggggccgtgtttgtcgacgagaaccagtggaatagtgctaaggaggccgtggaagatgagcgtttctgggacctggttcatcgggaaagagagttgcacaaacagggaaagtgcgcgacatgcgtgtacaacatgatgggcaaaagggaaaagaagctgggtgagtttgggaaagcaaagggatcccgcgccatttggtacatgtggctcggcgctcgattccttgagtttgaagccctgggcttcatgaatgaggatcactggttcagccgggaaaactctttatcgggggtcgagggagagggtctgcataaattgggctatatcctcagagacatttcaaagatcccagggggaaatatgtacgcagatgacacggctggctgggataccaggataactgaagacgatctgcaaaacgaggccaaaatcacagacattatggaacccgagcacgctctacttgccaaggcaatctttaaactgacctatcagaataaggtggtacgcgttcagagacctgcgaagaacggtactgtgatggatgtcattagccggagggaccagcgtgggtccggacaagtgggcacatacggcctcaataccttcacaaacatggaagcccagctgatccgacagatggagagtgaggaaatattttctccaagcgagttggaaactcccaacttagctgagcgcgccctggattggctcgaaaaatatggggtggagagacttaagcggatggcaatttccggagacgactgtgtcgttaaaccgatcgatgacaggttcgctaccgccctgacggcactaaatgatatgggtaaggtgcgcaaagacatccctcagtgggagccctcaaagggctggaacgattggcaacaggtaccattttgcagtcatcacttccaccagctgattatgaaggacgggagagaaatagtggtcccttgtcggaatcaggatgagctcgtgggaagggcccgagtttctcaaggcgcgggttggagcttgcgtgaaaccgcttgcctggggaaatcctacgcccagatgtggcagcttatgtattttcatagacgcgacctgcggctcgcagccaacgctatctgttcagccgtgcccgtcgattgggtgccaacaagcaggactacctggtctattcacgcacatcaccagtggatgacaactgaggacatgttatccgtatggaatagagtttggatcgaagagaacccctggatggaggataagacccatattagtagctgggaagacgtgccttacctgggaaaacgcgaggaccaatggtgcggctcgttgatcggcctgacggctcgggccacatgggcgaccaatatacaggtcgctatcaaccaggtgaggcgactcattgggaatgaaaactaccttgattatatgacttccatgaagagattcaaaaatgagtctgacccagagggagccctgtggtga

SEQ ID NO: 13773 - RNA, 9879 nt, synthetic construct
  misc_feature 1..9879: note = derived and/or modified CDS sequence (opt3) from DENV-1__GQ199797__SS-prME
  source 1..9879: mol_type = other RNA
agcgtgaccatgctgctaatgcttatgcccaccgcactggctttccacttgactacgagaggcggggaacctcatatgatcgtctccaagcaggaaagggggaaatctttactgtttaagacctcagccggtgttaacatgtgcacactaattgcaatggacctcggcgagttctgtgaagatactatgacctacaaatgcccacggataacagaggcggaaccggacgatgtggactgttggtgcaatgctaccgatacttgggtaacatatgggacctgtagtcaaacgggggagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaagacgcaaactttgtttgccgccgaacattcgtggatagaggctggggtaatgggtgtggactgtttggcaaaggctccttgataacttgcgctaagttcaagtgcgtaaccaaactcgaggggaagacagtgcagtacgaaaacctgaaatattcagtcattgtgaccgttcacactggagaccagcatcaagtgggtaatgagagtacggaacacggcacaaccgccactatcacaccccaggcgcctagcacagagattcagttaaccgactacggggccctgactctcgattgttctccaaggacaggacttgactttaacgaaatggtcctgttgacgatgaaggagaaatcctggctagtgcataagcagtggttcctggatctcccgctgccctggacctcaggcgcaagcacaagtcaagagacatggaatcggaaagaccttctggtaacctttaagacagctcacgccaagaaacaggaagttgtggtcttgggttctcaggagggggctatgcacactgccctcaccggcgcaacggaaatccaaacctccggaacaactaccatcttcgccggccatctgaagtgccgtttaaaaatggataagctgacactaaaagggatgagctatgtgatgtgtactggatcgttcaagctcgagaaggaagtcgctgagacccagcacggtacggtgctggttcagattaaatacgagggcacagacgcgccttgcaagataccattttctacccaggatgaaaaaggggtgactcaaaacggacgccttatcacagcaaatcccattgtaaccgacaaggagaaacctgtcaacatcgaagccgagccacccttcggcgagtcctatatagtgattggtgctggggaaaaggccttgaagctgtcatggtttaaaaagggcagtagcatcggaaaaatgttcgaggcaactgccagaggcgctaggcggatggccatcctcggggataccgcatgggactttggatccattggtggcgttttcacatctgtggggaagctggtccatcagatctttggaacggcgtacggcgtgcttttcagcggtgtatcatggaccatgaaaattgggataggcgtgctgttgacttggctcggactgaatagtcgatccactagcttatctatgacctgtatcgctgttggcctggtcacactatacctcggggtgatggtgcaggccgattcaggatgcgtcattaactggaagggccgcgaactgaagtgtggtagtgggatctttgttactaatgaggtgcacacctggacggaacagtataaattccaagcagacagcccgaagagactttccgccgctatcggaaaagcctgggaggagggcgtgtgcggtattaggtctgcaacacggttggaaaacataatgtggaagcagatctcgaacgagctgaatcatattctcctggaaaacgacatgaaatttaccgtagtcgtgggcgatgttgctgggatcttagcccagggaaagaaaatgattcgccctcagcccatggagtacaagtatagctggaagtcctggggcaaagcgaagatcataggggccgacgtgcaaaatactaccttcatcattgatggaccaaacacacctgaatgtcccgacgatcagagagcttggaatatctgggaggtcgaggactacggctttggtattttcactaccaacatctggctgaaacttagggattcatatacacaggtgtgcgaccaccgtttgatgagtgcagccataaaggattctaaagctgttcacgccgacatggggtactggattgaaagcgagaagaatgaaacgtggaagctcgcacgggcgtccttcatcgaggtgaaaacctgtatttggccaaagtcacatactctgtggagcaacggagtactagaatctgagatgatcatacccaaaatctatggcggtcctatttcccagcacaattaccgaccaggctactttacacaaaccgccgggccgtggcatctgggaaagctcgagctggatttcgacctttgcgaaggcactacagtcgtggtggatgagcactgcgggaacagaggacccagtttgaggaccacgactgtcaccggcaaaatcattcacgaatggtgttgccgcagctgtacactgcctccattacggtttaagggtgaggacgggtgctggtatggaatggagatcagacccgttaaggaaaaagaggaaaatctcgtgaagtctatggtatccgctggctcaggtgaggtggacagtttcagcctgggccttctgtgtatatcgattatgatcgaagaggtcatgaggtcccgctggtctcgaaaaatgttgatgaccgggactctcgccgtgtttttcctgctaatcatgggacagctgacatggaacgatctcattcggctgtgcatcatggttggcgcaaatgctagcgaccgtatggggatgggaaccacataccttgccttgatggcaacttttaagatgagacctatgttcgccgtgggcctgttatttaggcgcctcacctcacgggaggtcctgcttctgacgattggtctaagtctcgtggcttccgttgaactgccaaactctttggaggaactgggggatggattagcgatgggcataatgatcctcaaactgcttacagacttccagagccatcaactgtgggccaccttgctctccctgacttttattaagaccacattctcactacactatgcatggaagactatggctatggtgctgagcatcgtcagtctttttcccctctgtctgtctaccacgtcccagaaaacaacctggttgccggtactgttaggcagcctcgggtgcaagcctctgactatgttccttattgccgagaataaaatctggggaagaaagtcgtggccactgaacgaaggtataatggccgtgggcatcgtttcaattttgctctctagtctgctcaagaatgatgtgcccctggctgggcctcttatcgcaggaggcatgctcattgcctgttacgtcatctccggtagctctgcggacctgagcttggagaaggctgccgaggtgtcctgggaagaggaagcagagcattcaggggccagtcacaatatattagtagaagtgcaggatgacggaacaatgaaaattaaggatgaggagagggacgataccctgactatcctcctgaaggctacacttctggcagtcagcggcgtttatcccttgtctatcccagccaccctattcgtgtggtacttttggcagaaaaagaaacaacgatccggcgtgctgtgggacacgccttcacccccagaagtcgagcgcgcggtgctcgatgacgggatttatcggataatgcagagaggactgcttggtaggagtcaggttggcgtaggggtgttccaggaaaacgtctttcatactatgtggcacgtgacccgtggagctgttttaatgtaccaaggcaagcgcctggagccgagctgggcctccgtgaaaaaggacctcatctcttacggtgggggatggcggttgcagggctcgtggaatacaggcgaggaagtccaggtgattgcagtagagcctgggaagaaccccaaaaatgtccagaccgccccaggaacattcaagactagcgaaggtgaggtgggcgctatcgccctggattttaaacccgggacctcaggatcccctattgttaacagagaaggcaagatcgtgggtctctatgggaatggagtcgtgacgacaagtggcacttacgtttctgcaatagctcaagccaaagcgagccaggagggcccactgcccgagatcgaagacgaggtgttcaggaagcgaaaccttaccattatggatctgcaccctgggtccggaaagacacggcgctatttgccggccatcgtcagagaagcaattaaaaggaagctacggaccctgatcctcgctccaactcgagtggtagcctcagagatggctgaagcattaaaaggtatgcccataagataccagaccacagccgtgaagtctgagcatacgggcaaagagattgttgacctgatgtgccacgccacttttaccatgcgccttctgagccctgtcagggtgccaaattataacatgatcatcatggatgaagctcatttcacagaccccagttccattgcggcacgtgggtacatcagcacccgggtgggaatgggcgaggccgctgccatatttatgactgcaacacctccgggttctgtcgaagccttcccccaatcaaatgctgtaattcaggatgaggaaagagacatcccagagaggtcctggaacagtgggtatgagtggattaccgattttcctggaaagacggtgtggttcgttcccagcatcaagtcgggcaatgacatagcgaactgtctccgcaaaaatggcaagcgagtgattcagttgtctagaaaaactttcgatacagaataccagaagaccaaaaacaacgactgggactacgtcgtgaccactgatatctccgagatgggggccaattttcgggcagacagggttatcgatccacgccgttgcctgaagcctgtgattctcaaggacggacccgaaagagtcatcctggctggtccaatgccggtgacagtagccagcgcagcccaacggaggggccgcattgggcgaaaccacaataaagagggagatcagtatatatacatgggccagcctcttaacaatgacgaggatcatgctcactggaccgaagccaagatgctactggacaacatcaatacacccgagggtattatcccagcgttgttcgaacccgagagagaaaaatcagcagccatcgatggggagtatcggttaaggggcgaggctcgcaagacttttgtggaactgatgagaaggggagacctccctgtttggctgagttacaaagtcgcctctgagggcttccagtattccgatcggcgttggtgctttgacggggaacgcaacaatcaagtgcttgaggaaaacatggatgtggagatttggacgaaggagggagaacgaaagaaactgagaccaaggtggctcgacgctcggacctacagcgaccccttggcactgcgcgagttcaaagaatttgccgctggtagaaggtcagtcagtggcgatctaatactggagatcgggaaactccctcagcaccttacacagcgggcccagaatgcactggacaacttagttatgttgcataatagcgaacaaggaggccgagcgtatagacacgccatggaggagctgccggatactattgaaaccatgatgctcctggctcttatcgccgtgctgacaggtggggtaaccctcttctttttgtccggccgcggactgggcaagacttctattgggttactatgtgtgatggcaagctccgtcctgctctggatggcttcagtggagccacattggatcgccgcatctataatccttgagttctttctgatggttttgctgattcccgagcctgacaggcagcggacgccccaggataaccagctcgcctacgtggtcatcggactgcttttcatgattctcaccgtagctgcgaatgagatgggtctgttggaaacaactaaaaaggacctgggcatcgggcacgtggccgttgagaaccaccatcacgcagctatgttagatgtggacctacatccagccagtgcctggaccctgtacgcagtcgctacaaccataattactcctatgatgcgtcacacaatcgaaaacacgaccgccaatatttcgctcactgcgatcgctaaccaagccgcaatacttatgggactggataaaggctggcccatcagcaagatggacattggtgtgccattgctggccctcgggtgctattcccaggtcaatcctctgacacttaccgctgcagtgttaatgctggttgcccattacgcgatcattggcccgggactccaggctaaggccaccagagaggcacagaagaggacagccgctggcatcatgaagaaccccactgtggatgggatagtagccattgacttggatccagtggtctatgacgcaaaatttgaaaagcagctgggacagatcatgctactgatcctctgtacgtctcagattcttctgatgcgcaccacatgggctttgtgcgagtcaatcactctggccaccggccctctcacaaccctgtgggagggtagccccgggaaattctggaatactacgatagcggtttccatggccaacattttccggggaagttacttagcaggcgctggtcttgccttttctctgatgaaaagcctcggcgggggacgaagaggcacaggggcacaaggagaaaccctaggcgagaagtggaaaaggcagctgaatcagttgtcaaagtccgagttcaacacttataaacgcagtggtatcatggaggtggaccggagcgaagctaaggaggggctgaaaagaggagagaccacaaagcacgccgtctctcgtggcactgccaagctcaggtggtttgtggaacggaatcttgtaaaaccagagggtaaggtgattgatctgggctgtgggcgcggaggctggtcctactattgcgcggggttgaaaaaggttaccgaagtgaaaggatacacaaagggcggtcctgggcacgaggaacccatcccgatggctacgtacggatggaacctggtcaaactccattcaggcaaggacgtgttctttataccacctgagaagtgtgataccttactgtgcgacatcggcgagagctcgcccaatccaactattgaagaggggcgaacacttagagtcctgaaaatggtggaaccctggctaaggggaaaccagttctgtatcaagattctcaatccttatatgccgtctgttgtagagaccctggagcaaatgcagcggaaacacggtggcatgttggtgcgcaaccccctgagtagaaattccactcatgaaatgtactgggtcagctgcgggacaggaaacatcgtgtcagcagttaatatgacctccaggatgctccttaaccgatttacgatggcccaccggaagccaacctatgagcgtgatgtggacctgggcgctggtacaagacacgtcgccgtggaacctgaggtagcaaacttagatattatcgggcagcgcatagaaaatattaaacatgagcacaagtctacttggcattacgacgaggataacccctataagacctgggcctaccacggaagctatgaagtgaaacctagtggctccgctagctctatggttaatggcgtcgtgaagctgttgacaaaaccatgggacgtgatccccatggtcactcagatcgcgatgaccgatacaacccctttcgggcaacagagggtttttaaggagaaagtggacactcggacgccaaaggccaagagaggaacagcacagattatggaagtaaccgctaaatggctctggggtttcctgtcacgcaacaagaaacccaggatatgtactcgagaggaatttacccggaaggtgagaagtaatgccgcaatcggcgccgtcttcgtggacgagaaccaatggaactccgctaaagaggccgttgaagatgagaggttttgggacctagtgcatcgcgaacgtgagcttcacaagcaggggaagtgcgcgacatgcgtctacaacatgatgggaaaacgggaaaagaaactgggcgagttcggtaaggcaaaagggagcagagccatttggtacatgtggctcggagctaggttcctggagtttgaagccttgggcttcatgaatgaggatcactggttttctcgcgaaaactcgctgtcaggcgtggagggggagggactccataaacttggttatatcctgcgagacattagcaaaatcccgggcgggaatatgtacgcagatgacacggctggatgggatacccggataactgaagacgatttacagaacgaggccaagatcacagacattatggaacctgagcacgctctgttggccaagtccatcttcaaactcacctatcagaataaggtagttagagtgcaaaggccagccaagaacggcactgtcatggatgtgattagtcgcagagaccagcggggttctggacaggtgggaacatacggcctgaatacctttacaaacatggaagcgcagctaatcaggcaaatggagagcgagggcatattctccccctcagaacttgagactcctaacctggcccgtcgagtcctcgattggctggaaaagcatggggttgagcgcttgaaaagaatggctattagtggagacgactgtgtggtaaagccaatcgatgaccggtttgccaccgcattaacggctctgaatgatatgggtaaggtgaggaaagacatcccccagtgggaaccgtctaagggctggaacgattggcagcaggtccctttctgcagccaccactttcatcaactcattatgaaagacgggcgcgagatagtggttccctgtagaaatcaggatgagcttgtgggacgggccagggtctcccagggcgcaggttggtcactgcgagaaaccgcctgcctaggaaagagctatgcgcagatgtggcaactgatgtacttccaccgtagagacctccgcttggctgccaacgcaatctgttctgccgtgccagtagattgggttcctacatcccggactacctggagtattcatgctcaccatcagtggatgacaactgaggacatgctgagcgtgtggaatagggtctggatcgaagagaacccctggatggaagataaaacccacatttcgtcctggggagacgtgccatatcttggcaagagagaggaccagtggtgcggctctctgatcgggctcacggcccgcgcaacatgggctaccaatatacaagttgccatcaaccaggtgcggaggttaattggaaatgagaactacctggattacatgacttcaatgaagcgatttaaaaatgaaagcgaccccgagggtgcgttgtggtga

SEQ ID NO: 13774 - RNA, 9879 nt, synthetic construct
  misc_feature 1..9879: note = derived and/or modified CDS sequence (opt3) from DENV-1__GQ199799__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagttctgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagagcaggacgcaaactttgtttgccgccgaacattcgtggatagaggctggggtaatgggtgtggactgtttggcaaaggctccttgataacttgcgctaagttcaagtgcgtaaccaaactcgaggggaagattgtgcagtacgaaaacctgaaatattcagtcatcgtgacagttcacaccggagaccagcatcaagtgggtaatgagagtactgaacacggcacgacagccaccattactccccaggcgcctagcaccgagatccagttaacagactacggggccctgaccctcgattgttctccaaggactggacttgactttaacgaaatggtcctgttgacaatgaaggagaaatcctggctagtgcataagcagtggttcctggatctcccgctgccctggacgtcaggcgcaagcaccagtcaagagacttggaatcggcaggaccttctggtaacatttaaaaccgctcacgccaagaagcaggaagttgtggtcttgggttctcaagagggggctatgcacacagccctcactggcgcaaccgaaatccagacgtccggaaccacaactattttcgccggccatctgaaatgccgtttaaagatggataaactgaccctaaaggggatgagctatgtgatgtgtacaggatcgttcaaactcgagaaggaagtcgctgagactcagcacggtaccgtgctggttcagataaagtacgagggcacggacgcgccttgcaaaatcccattttctacacaagatgaaaagggggtgacccagaacggacgccttattactgcaaatcccatcgtaacagacaaagagaagcctgtcaacatagaagccgagccacccttcggcgagtcctatattgtgatcggtgctggggaaaaagccttgaagctgtcatggtttaagaaaggcagtagcatcggaaagatgttcgaggcaaccgccagaggcgctaggcggatggccattctcggggatactgcatgggactttggatccatcggtggcgttttcacctctgtggggaaactggtccatcagatttttggaacagcgtacggcgtgcttttcagcggtgtatcatggacgatgaagatagggatcggcgtgctgttgacctggctcggactgaatagtcgatccactagcttatctatgacatgtattgctgttggcctggtcaccctatacctcggggtgatggtgcaggccgattcaggatgcgtcatcaactggaaaggccgcgaactgaagtgtggtagtgggatctttgttacaaatgaggtgcacacttggaccgaacaatataagttccaggcagacagcccgaaaagactttccgccgctattggaaaggcctgggaggagggcgtgtgcggtataaggtctgcaacgcggttggaaaacatcatgtggaaacagatttcgaacgagctgaatcatatcctcctggaaaacgacatgaagttaacagtagtcgtgggcgatgttgctgggattctggcccagggaaaaaagatgatccgccctcaacccatggagtacaaatatagctggaagtcctggggcaaggcgaaaataatcggggccgacgtgcagaataccacttttattatcgatggaccaaacacccctgaatgtcccgacgatcagagagcttggaatatttgggaggtcgaggactacggcttcggtatctttacaactaacatatggcttaagttgagggattcatatacccaggtgtgcgaccaccgtctcatgagtgcagccattaaagattctaaggctgttcacgccgacatggggtactggatcgaaagcgagaaaaatgaaacatggaagctggcacgggcgtccttcattgaggtgaagacgtgtatctggccaaaatcacataccctatggagcaacggagtactggaatctgagatgataatccccaagatttatggcggtcctatctcccaacacaattaccgaccaggctacttcactcagacagccgggccgtggcatctcggaaaactggagcttgattttgacttgtgcgaaggcaccactgtcgtggtggatgagcactgcgggaacagaggacccagtctgaggacaaccacggtcactggcaagattatccacgaatggtgttgccgcagctgtaccttacctccactccggttcaaaggtgaggacgggtgctggtatggaatggagataagacccgttaaggaaaaggaggaaaatctggtgaaatctatggtatccgctggctcaggtgaggtggacagttttagccttggcctgttgtgtatttcgatcatgatcgaagaggtcatgaggtcccgctggtctcgaaagatgctcatgacagggaccctggccgtgttctttctactgattatgggacagctcacttggaacgatctgatccggctttgcattatggttggcgcaaatgctagcgaccgtatggggatgggaacaacctacttggccctgatggcaacattcaaaatgagacctatgtttgccgtgggcttactcttcaggcgcctgacttcacgggaggtccttctgctaaccataggtctcagtctggtggcttccgttgaattgccaaactctctggaggaattaggggatggactcgcgatgggcatcatgattctgaagcttctgacggactttcaaccccatcagttgtgggccacactcctgagcctaaccttcatcagaactaccttttccctgcactatgcatggaaaacaatggctatggtgctttcaattgtcagcctcttcccgctgtgtttgagtactacctctcagaagacgacatggctgcctgtattactcggctccctggggtgcaagccacttaccatgtttctgatcgccgagaataaaatatggggaaggaagagctggcccttgaacgaaggtatcatggccgtgggcattgtttcgatcctcctgtcatctctactgaaaaacgatgtgcctcttgctgggcccctcattgcaggaggcatgctgatcgcctgttacgtcataagtggttccagcgcggacttgtctttagagaaggctgccgaggtgagctgggaagaggaagcagagcattccggggcctcacacaatattctggtagaagtgcaggatgacggaactatgaaaatcaaggatgaggagcgagacgatacactcaccatcctgcttaaagctactctgttggcagtcagtggcgtttatccactaagcattcctgccacactgttcgtgtggtacttctggcaaaagaagaaacagcgctctggcgtgctctgggacaccccctccccaccggaagtcgagcgggcggtgctggatgacgggatatatagaatcatgcagaggggacttttaggtcgttcacaggttggcgtaggggtgtttcaagaaaacgtcttccatacgatgtggcacgtgactcgcggagctgttctgatgtaccagggcaagcggctcgagcctagttgggccagcgtgaaaaaggacttgatttcctacggtgggggatggagactgcagggctcttggaataccggcgaggaagtccaggtgatcgcagtagagcccgggaaaaacccaaagaatgtccaaacagcccccggaacctttaagacatcggaaggtgaggtgggcgctattgccctcgatttcaaacctgggactagcggatcaccaatcgttaacagggaaggcaagatagtgggtctgtatgggaatggagtcgtgaccacgtccggcacatacgttagtgcaatcgctcaggccaaagcgtctcaggagggcccccttcctgagattgaagacgaggtgtttcgaaagcggaacctgactatcatggatttgcacccggggagcggaaaaacccgcagatatctaccagccattgtcagggaagcaatcaagcggcgactgagaacactcatattagctcccacccgcgtggtagcctccgagatggctgaagcactgaagggtatgcctattaggtaccaaactaccgccgtgaaatcagagcatacaggcaaggagatcgttgaccttatgtgccacgccacgttcactatgcgtctgctctctccagtccgggtgcccaattataacatgatcattatggatgaagctcattttaccgaccctagcagtatcgcggcaagagggtacatatccacaagggtgggaatgggcgaggccgctgccattttcatgaccgcaactccgcccggtagcgtcgaagcctttccacagtctaatgctgtaatccaggatgaggaacgcgacattcctgagcgatcatggaactccgggtatgagtggatcacagatttccccggaaaaaccgtgtggtttgttccaagtataaagagcggcaatgacattgcgaactgtttgagaaaaaatggcaagcgggtgatccagctgtcgaggaagacgttcgatactgaataccaaaaaacaaagaacaacgactgggactacgtcgtgaccaccgatatctctgagatgggggccaatttccgcgcagaccgtgttattgatcctagacggtgcctcaaacccgtgatcctgaaggacggaccagaaagggtcattcttgctggtccgatgcctgtgactgtagcctccgcagcccagcgccgaggcagaatagggcggaaccacaataaagagggagatcagtatatctacatgggccagcccctaaacaatgacgaggatcatgctcactggacagaagccaagatgctgttggacaacattaataccccagagggtatcatccccgcgttatttgaacctgagagggaaaagagcgcagccattgatggggagtatcgcctgagaggcgaggctaggaaaacattcgtggaactcatgcggcgtggagacctgccagtttggctttcatacaaggtcgccagtgagggctttcaatattctgatcgccgatggtgcttcgacggggaaagaaacaatcaggtgctggaggaaaacatggatgtggagatatggactaaagagggagaaaggaagaaactccggccccgctggttggacgctagaacgtactccgaccctctggcactaagggagtttaaggaattcgccgctggtcggcgaagcgtctcaggcgatctgatcctcgagattgggaaacttccgcagcacctgacccagagagcccaaaatgcattagacaacttggttatgctgcataatagtgaacagggaggccgcgcgtataggcacgccatggaggagctcccagatacaatcgaaactctgatgcttctggctctcattgccgtgttgaccggtggggtaacactgtttttcttaagcggccggggactaggcaagacctccatcgggctgctctgtgtgatggcatctagcgtccttctgtggatggcttccgtggagccccattggatagccgcatcaatcattttggaatttttcctgatggttctcctgatccctgagcccgaccgtcagagaactccacaggataaccaacttgcctacgtggtcattggactcctgtttatgatcttgacggtagctgcgaatgagatgggtctgttagaaaccacaaagaaagacctaggcatagggcacgtggccgttgagaaccaccatcacgcagctatgctggatgtggacctccatcctgcctctgcctggactctttacgcagtcgctaccacaattatcacccccatgatgaggcacactattgaaaacacaacggccaatatcagtctgaccgcgatagctaaccaggccgcaatcttgatgggactggataagggctggccaatttcgaaaatggacatcggtgtgcctctcctggcccttgggtgctatagccaggtcaatccgttaactctgacagctgcagtgctcatgttggttgcccattacgcgattatcggccccggactgcaagctaaggccacccgcgaggcacagaaacggaccgccgctggcataatgaagaacccaacagtggatgggattgtagccatcgacctagatcctgtggtctatgacgcaaagttcgaaaaacagctgggacagatcatgctccttattctgtgtacttcccaaatcttgctgatgcgaacgacctgggctctctgcgagtctataacactggccactggccccttaaccacactttgggagggttcaccagggaagttttggaataccactattgcggttagcatggccaacatcttcagaggatcctacctggcaggcgctggtctcgccttcagtctaatgaaatctctgggcgggggaaggcgcggcacgggggcacagggagaaacattgggcgagaagtggaaacggcagctgaatcagctcagcaagtcagaatttaacacctataagagatccggtattatggaggtggaccgtagtgaagctaaagaggggcttaagaggggagagactaccaaacacgccgtcagccggggcacagccaagctgcgctggttcgtggaacgaaatttggtaaaacctgagggtaaggtgatcgatctgggctgtgggagaggaggctggtcttactattgcgcggggctcaagaaagttactgaagtgaagggatacaccaaaggcggtcccgggcacgaggaaccgataccaatggctacatacggatggaacttagtcaagctgcattccggcaaagacgtgtttttcatccctcccgagaagtgtgatacgcttctgtgcgacattggcgagtcaagcccaaatcccaccatcgaagaggggaggactctacgggtcctcaaaatggtggaaccttggctgcgcggaaaccaattttgtattaagatcttgaatccgtatatgccctcggttgtagagacactggagcagatgcagagaaagcacggtggcatgctcgtgaggaacccactttctcgaaatagtacccatgaaatgtactgggtctcctgcgggactggaaacattgtgagcgcagttaatatgacatcacggatgctgttaaaccgtttcaccatggcccacagaaaacctacgtatgagcgcgatgtggacctgggcgctggtaccaggcacgtcgccgtggaacccgaggtagcaaacttggatatcatagggcagcggattgaaaatatcaagcatgagcacaaatccacatggcattacgacgaggataacccttataagacttgggcctaccacggatcttatgaagtgaaaccaagcggcagtgcttccagcatggttaatggcgtcgtgaagctcctgaccaagccctgggacgtgatccctatggtcacacaaattgcgatgactgataccacaccatttgggcagcagagagttttcaaagagaaggtggacacccgcactcccaaagccaagaggggaacggcacaaataatggaagtaacagctaaatggctatggggttttctttctcgaaacaagaagccgcggatctgtaccagagaggaattcactaggaaagtgcgctcaaatgccgcaattggcgccgtctttgtggacgagaaccagtggaatagtgctaaggaggccgttgaagatgagcgtttctgggacctggtgcatcgggaaagagagctccacaaacaggggaagtgcgcgacctgcgtctacaacatgatgggaaaaagggaaaagaagctgggcgagtttggtaaagcaaaggggtcccgcgccatctggtacatgtggttgggagctcgattcctggagttcgaagccctcggctttatgaatgaggatcactggttcagccgggaaaactctctttcgggcgtggagggggagggactgcataaattaggttatattctgagagacatctcaaagatacctggcgggaatatgtacgcagatgacacagctggatgggatacgaggatcaccgaagacgatttgcagaacgaggccaaaattactgacatcatggaaccagagcacgctctcctggccaagagcatttttaaactaacatatcaaaataaggtagttcgcgtgcagagacccgcaaagaacggcaccgtcatggatgtgatctcccggagggaccagcgtggtagtgggcaggtgggaacttacggccttaatacattcaccaacatggaagcgcaactgatacgacagatggagtctgagggcatttttagcccttccgaactcgagacaccaaacctggccgggcgcgtcttggattggttagaaaaacatggagttgagagactgaagcggatggctatctcaggtgacgactgtgtggtaaaacccatcgatgacaggttcgccactgcactcaccgctcttaatgatatgggcaaggtgcgcaaagacattccgcagtgggaacctagtaaggggtggaacgattggcagcaagtccccttttgctctcaccacttccatcagctgataatgaaggacggaagagagatcgtggttccatgtcggaatcaggatgagctagtgggcagggcccgagtcagccagggtgcagggtggtccctgcgtgaaacggcctgcctcggaaaatcatatgcgcaaatgtggcagttgatgtactttcacagacgcgacctgcggcttgctgccaacgcaatttgtagcgccgtgcctgtagattgggttcccacctctaggacaacttggtccatccatgctcaccatcagtggatgaccacagaggacatgctgagtgtgtggaatagagtctggattgaagagaacccatggatggaagataagactcacgtgagctcgtggggcgacgttccctatctcggcaaacgcgaggaccaatggtgcgggtccttaatcggactgaccgcccgggcaacgtgggctacaaatatacaggtggccatcaaccaggtcaggcgattgctgggtaatgagaactacctcgattacatgacctctatgaagagattcaaaaatgaatcagaccctgagggcgcgctttggtga

SEQ ID NO: 13775 - RNA, 9879 nt, synthetic construct
  misc_feature 1..9879: note = derived and/or modified CDS sequence (opt3) from DENV-1__GQ199800__SS-prME
  source 1..9879: mol_type = other RNA
agcgtgaccatgctgctcatgcttatgcccacagcactggctttccacttgactacgagaggaggggaacctcatatgatcgtctccaagcaggaaagggggaaatctttactgtttaagacctcagccggtgttaacatgtgcacactaattgccatggacctcggcgagttctgtgaagatactatgacctacaaatgcccacggataacagaagcggaaccggacgatgtggactgttggtgcaatgctaccgatacttgggtaacatatgggacctgtagtcaaacgggagagcaccgccgagacaagcgttccgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaagacgcaaactttgtttgccgccgaacattcgtggatagaggctggggtaatgggtgtggactgtttggcaaaggctccttgataacttgcgctaagttcaagtgcgtaaccaaactcgaggggaagattgtgcagtacgaaaacctgaaatattcagtcatcgtgacagttcacaccggagaccagcatcaagtgggtaatgagagtactgaacacggcacgacagccaccattactccccaggcgcctagcaccgagatccagttaacagactacggggccctgaccctcgattgttctccaaggactggacttgactttaacgaaatggtcctgttgacaatgaaggagaaatcctggctagtgcataagcagtggttcctggatctcccgctgccctggacgtcaggcgcaagcaccagtcaagagacttggaatcggcaggaccttctggtaacatttaaaaccgctcacgccaagaagcaggaagttgtggtcttgggttctcaagagggggctatgcacacagccctcactggcgcaaccgaaatccagacgtccggaaccacaactattttcgccggccatctgaaatgccgtttaaagatggataaactgaccctaaaggggatgagctatgtgatgtgtacaggatcgttcaaactcgagaaggaagtcgctgagactcagcacggtaccgtgctggttcagataaagtacgagggcacggacgcgccttgcaaaatcccatttcttacacaagatgaaaagggggtgacccagaacggacgcttgattactgcaaatcccatcgtaacagacaaagagaagcctgtcaacatagaagccgagccacccttcggcgagtcttatattgtgatcggtgctggggaaaaagccctgaagctctcctggtttaagaaaggctcaagtatcggaaagatgttcgaggcaaccgccagaggcgctaggcggatggccattctgggggatactgcatgggactttggaagcatcggtggcgttttcacctccgtggggaaacttgtccatcagatttttggaacagcgtacggcgtgctgttctctggtgtaagctggacgatgaagatagggatcggcgtgttgctcacctggctgggattaaattcacgaagtacttccctgagcatgacatgtattgctgttggcctagtcaccctctacctgggggtgatggtgcaggccgattctggatgcgtcatcaactggaaaggccgcgaacttaagtgtggttcagggatctttgttacaaatgaggtgcacacttggaccgaacaatataagttccaggcagacagtccgaaaagattgagcgccgctattggaaaggcctgggaggagggcgtgtgcggtataaggtccgcaacgcggctggaaaacatcatgtggaaacagatttctaacgagctcaatcatatcctgttagaaaacgacatgaagtttacagtagtcgtgggcgatgttgctgggattctggcccagggcaagaagatgatccgccctcaacccatggagtacaaatattcgtggaaaagctggggcaaggcgaagataatcggggccgacgtgcagaataccactttcattatcgatggaccaaacacccctgaatgtcccgacgatcagagagcttggaatatttgggaggtcgaggactacggctttggtatcttcacaactaacatatggcttaagttgagggattcctatacccaggtgtgcgaccaccgtctcatgtcagcagccattaaagatagtaaggctgttcacgccgacatggggtactggatcgaatctgagaaaaatgaaacatggaagctggcacgggcgagcttcattgaggtgaagacgtgtatctggccaaaatcccataccctatggtcaaacggagtactggaaagcgagatgataatccccaagatttatggcggtcctatctctcaacacaattaccgaccaggctactttactcagacagccgggccgtggcatctcggaaaactggagcttgatttcgacttgtgcgaaggcaccactgtcgtggtggatgagcactgcgggaacagaggaccctccctgaggacaaccacggtcactggcaagattatccacgaatggtgttgccgcagttgtaccttacctccactccggtttaaaggtgaggacgggtgctggtatggaatggagataagacccgttaaggaaaaggaggaaaatctggtgaaaagcatggtatctgctggctccggtgaggtggactcattcagtcttggcctgttgtgtattagcatcatgatcgaagaggtcatgaggtcgcgctggtcccgaaagatgctcatgacagggaccctggccgtgtttttcctactgattatgggacagctcacttggaacgatctgatccggctttgcattatggttggcgcaaatgcttctgaccgtatggggatgggaacaacctacttggccctgatggcaacatttaaaatgagacctatgttcgccgtgggcttactctttaggcgcctgactagccgggaggtccttctgctaaccataggtctctcactggtggctagtgttgaattgccaaactccctggaggaattaggggatggactcgcgatgggcatcatgattctgaaacttctgacggacttccaatctcatcagttgtgggccacactcctgagcctaacctttatcaaaactaccttctccctgcactatgcatggaagacaatggctatggtgctttcaattgtcagcctctttcccctgtgtttgagtactacctctcagaagacgacatggctgccggtattactcggctccctggggtgcaaacctcttaccatgttcctgatcgccgagaataagatatggggaagaaaaagctggccattgaacgaaggtatcatggccgtgggcattgtttcgatcctcctgtcatctctactgaagaacgatgtgccccttgctgggcctctcattgcaggaggcatgctgatcgcctgttacgtcataagtggttccagcgcggacttgtctttagagaaagctgccgaggtgagctgggaagaggaagcagagcattccggggcctcacacaatattctggtagaagtgcaggatgacggaactatgaagatcaaagatgaggagagggacgatacactcaccatcctgcttaaggctactctgttggcagtcagtggcgtttatcccctaagcattccagccacactgttcgtgtggtacttttggcaaaagaaaaagcagcgatctggcgtgctctgggacaccccttcacccccagaagtcgagcgcgcggtgctggatgacgggatatatcggatcatgcagagaggacttttaggtaggagccaggttggcgtaggggtgttccaagaaaacgtctttcatacgatgtggcacgtgactcgtggagctgttctgatgtaccagggcaaacgcctcgagccgagttgggccagcgtgaagaaagacttgatttcctacggtgggggatggcggctgcagggctcttggaataccggcgaggaagtccaggtgatcgcagtagagcctgggaagaaccccaagaatgtccaaacagccccaggaaccttcaaaacatcggaaggtgaggtgggcgctattgccctcgattttaagcccgggactagcggatcacctatcgttaacagagaaggcaaaatagtgggtctgtatgggaatggagtcgtgaccacgtccggcacatacgttagtgcaatcgctcaggccaaggcgtctcaggagggcccacttcccgagattgaagacgaggtgttcaggaaacgaaacctgactatcatggatttgcaccctgggagcggaaagacccggcgctatctaccggccattgtcagagaagcaatcaagaggaaactgcggacactcatattagctccaacccgagtggtagcctccgagatggctgaagcactgaagggtatgcccattagataccaaactaccgccgtgaaatcagagcatacaggcaaggagatcgttgaccttatgtgccacgccacgtttactatgcgcctgctctctcctgtcagggtgccaaattataacatgatcattatggatgaagctcatttcaccgaccccagcagtatcgcggcacgtgggtacatatccacacgggtgggaatgggcgaggccgctgccatttttatgaccgcaactcctccgggtagcgtcgaagccttcccccagtctaatgctgtaatccaggatgaggaaagagacattccagagaggtcatggaactccgggtatgagtggatcacagattttcctggaaaaaccgtgtggttcgttcccagtataaagagcggcaatgacattgcgaactgtttgcgcaagaatggcaaacgagtgatccagctgtcgagaaagacgttcgatactgaataccagaagacaaagaacaacgactgggactacgtcgtgaccaccgatatctctgagatgggggccaattttcgggcagacagggttattgatccacgccgttgcctcaaacctgtgatcctgaaggacggacccgaaagagtcattcttgctggtccaatgccggtgactgtagcctccgcagcccagcggaggggccgcatagggcgaaaccacaataaggagggagatcagtatatctacatgggccagcctctaaacaatgacgaggatcatgctcactggacagaagccaaaatgctgttggacaacattaatacccccgagggtatcatcccagcgttattcgaacccgagagagaaaagagcgcagccattgatggggagtatcggctgaggggcgaggctcgcaaaacatttgtggaactcatgagaaggggagacctgcctgtttggctttcatacaaggtcgccagtgagggcttccaatattctgatcggcgttggtgctttgacggggaacgcaacaatcaggtgctggaggaaaacatggatgtggagatatggactaaagagggagaacgaaagaaactcagaccaaggtggttggacgctcggacgtactccgaccccctggcactacgcgagttcaaggaatttgccgctggtagaaggagcgtctcaggcgatctgatcctcgagattgggaaacttcctcagcacctgacccagcgggcccaaaatgcattagacaacttggttatgctgcataatagtgaacagggaggccgagcgtatagacacgccatggaggagctcccggatacaatcgaaactctgatgcttctggctctcattgccgtgttgaccggtggggtaacactgttctttttaagcggccgcggactaggcaaaacctccatcgggctgctctgtgtgatggcatctagcgtccttctgtggatggcttccgtggagccacattggatagccgcatcaatcattttggagttctttctgatggttctcctgatccccgagcctgacaggcagcggactccccaggataaccaacttgcctacgtggtcattggactcctgttcatgatcttgacggtagctgcgaatgagatgggtctgttagaaaccacaaagaaagacctaggcatagggcacgtggccgttgagaaccaccatcacgcagctatgctggatgtggacctccatccagcctctgcctggactctttacgcagtcgctaccacaattatcacccctatgatgcgtcacactattgaaaacacaacggccaatatcagtctgaccgcgatagctaaccaggccgcaatcttgatgggactggataagggctggcccatttcgaaaatggacatcggtgtgccactcctggcccttgggtgctatagccaggtcaatcctttaactctgacagctgcagtgctcatgttggttgcccattacgcgattatcggcccgggactgcaagctaaggccaccagagaggcacagaagaggaccgccgctggcataatgaaaaaccccacagtggatgggattgtagccatcgacctagatccagtggtctatgacgcaaagtttgaaaaacagctgggacagatcatgctccttattctgtgtacttcccaaatcttgctgatgcgcacgacctgggctctctgcgagtctataacactggccactggccctttaaccacactttgggagggttcacccgggaagttctggaataccactattgcggttagcatggccaacatcttccggggatcctacctggcaggcgctggtctcgcctttagtctaatgaaatctctgggcgggggacgaagaggcacgggggcacagggagaaacattgggcgagaagtggaagaggcagctgaatcagctcagcaaatcagagttcaacacctataagcgctccggtattatggaggtggaccggagtgaagctaaagaggggcttaagagaggagagactaccaaacacgccgtcagccgtggcacagccaagctgaggtggtttgtggaacggaatttggtaaagccagagggtaaagtgatcgatctgggctgtgggcgcggaggctggtcttactattgcgcggggctcaagaaagttactgaagtgaagggatacaccaaaggcggtcctgggcacgaggaacccataccgatggctacatacggatggaacttagtcaagctgcattccggcaaagacgtgttctttatcccacctgagaagtgtgatacgcttctgtgcgacattggcgagtcaagccccaatccaaccatcgaagaggggcgaactctaagagtcctcaagatggtggaaccctggctgaggggaaaccaattctgtattaaaatcttgaatccttatatgccgtcggttgtagagacactggagcagatgcagcggaagcacggtggcatgctcgtgcgcaaccccctttctagaaatagtacccatgaaatgtactgggtctcctgcgggactggaaacattgtgagcgcagttaatatgacatcaaggatgctgttaaaccgatttaccatggcccaccggaaaccaacgtatgagcgtgatgtggacctgggcgctggtaccagacacgtcgccgtggaacctgaggtagcaaacttggatatcatagggcagcgcattgaaaatatcaagcatgagcacaaatccacatggcattacgacgaggataacccctataagacttgggcctaccacggatcttatgaagtgaagcctagcggcagtgcttccagcatggttaatggcgtcgtgaaactcctgaccaagccatgggacgtgatccccatggtcacacaaattgcgatgactgataccacacctttcgggcagcagagggtttttaaagagaaggtggacacccggactccaaaagccaagagaggaacggcacaaataatggaagtaacagctaagtggctatggggtttcctttctcgcaacaaaaagcccaggatctgtacccgagaggaatttactcggaaagtgagatcaaatgccgcaattggcgccgtcttcgtggacgagaaccagtggaatagtgctaaggaggccgttgaagatgagaggttttgggacctggtgcatcgcgaacgtgagctccacaaacaggggaagtgcgcgacctgcgtctacaacatgatgggaaagcgggagaaaaagctgggcgagttcggtaaagcaaaggggtccagagccatctggtacatgtggttgggagctaggttcctggagtttgaagccctcggcttcatgaatgaggatcactggtttagccgcgaaaactctctttcgggcgtggagggggagggactgcataaattaggttatattctgcgagacatctcaaagataccgggcgggaatatgtacgcagatgacacagctggatgggatacgcggatcaccgaagacgatttgcagaacgaggccaaaattactgacatcatggaacctgagcacgctctcctggccaagagcattttcaagctaacatatcaaaataaagtagttagagtgcagaggccagcaaagaacggcaccgtcatggatgtgatctcccgcagagaccagcggggtagtggacaggtgggaacttacggccttaatacatttaccaacatggaagcgcaactgataaggcagatggagtctgagggcattttcagcccctccgaactcgagacacctaacctggccgggcgtgtcttggattggttagaaaaacatggagttgagcgactgaagcgcatggctatctcaggtgacgactgtgtggtaaaaccaatcgatgacagatttgccactgcactcaccgctcttaatgatatgggcaaggtgcggaaggacattccccagtgggaaccgagtaaagggtggaacgattggcagcaagtccctttctgctctcaccactttcatcagctgataatgaaggacggaagggagatcgtggttccctgtcgcaatcaggatgagctagtgggcagagcccgggtcagccagggtgcagggtggtccctgagggaaacggcctgcctcggaaaatcatatgcgcaaatgtggcagttgatgtacttccaccgacgtgacctgagacttgctgccaacgcaatttgtagcgccgtgccagtagattgggttcctacctctcgcacaacttggtccatccatgctcaccatcagtggatgaccacagaggacatgctgagtgtgtggaatcgggtctggattgaagagaacccctggatggaagataagactcacatcagctcgtggggcgacgtgccatatctcggcaaaagggaggaccaatggtgcgggtccttaataggactgaccgccagagcaacgtgggctacaaatatccaggttgccattaaccaggtgcgccggttgatcggtaatgagaactacctggattacatgacctctatgaagaggtttaagaatgaatcagaccccgagggcgcgctctggtga

SEQ ID NO: 13776 - RNA, 9879 nt, synthetic construct
  misc_feature 1..9879: note = derived and/or modified CDS sequence (opt3) from DENV-1__FJ882548__SS-prME
  source 1..9879: mol_type = other RNA
agcgtgaccatgctgctcatgcttatgcccactgccctggctttccacttgactacgagaggaggggaacctcatatgatcgtctccaagcaggaaaggggaaaatctttactgtttaagacctcagcgggtgttaacatgtgcacactgattgccatggacctcggagagctgtgtgaagatactatgacctacaaatgcccacggataacagaggcggaaccggacgatgtggactgttggtgcaatgctaccgatacttgggtgacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccgtgctgaggaaactttgcattgaagctaagatctctaatacgaccacagatagccggtgtccaactcaaggagaggccaccctggtcgaagaacaggacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatgtgtactggcagcttcaaactggagaaggaagtcgctgagacccagcacggtacggtgcttgttcagataaagtacgagggcacagacgcgccttgcaaaatcccattctcgacccaagatgaaaagggggtgactcagaacggacgcttgattacagcaaatcccatcgtaaccgacaaagagaagcctgtcaacatagaagccgagccaccctttggcgagtcttatattgtgatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtttttacatccgtggggaaacttattcatcagatattcggaacggcgtacggcgtcctgttttctggtgtgagctggaccatgaagatcgggattggcgtattgctcacttggctgggattaaattcacgaagtacatccctgagcatgacctgtatcgctgtgggcctagttacactctacctgggggtcatggtgcaggccgattctggatgcgtgatcaactggaaaggccgcgaacttaagtgtggttcagggattttcgtcactaatgaggttcacacctggacggaacaatataagtttcaggcagacagtccgaaaagattgagcgccgctataggaaaggcctgggaggagggcgtgtgcggtatcaggtccgcaacacggctggaaaacattatgtggaaacagatctctaacgagctcaatcatattctgttagaaaacgacatgaagctgaccgtggtagtcggcgatgtggctgggatccttggacagggcaaaaagatgatacgccctcaacccatggagtacaaatattcgtggaaaagctgggggaaggccaagatcattggagcggacgcccagaatactaccttcatcattgatggcccaaacacacctgaatgtcccgacgatcagagagcttggaatatctgggaggttgaggactacggttttgggatattcactaccaacatttggttgaagctcagggattcctatacacaggtgtgcgaccaccgtctgatgtcagcagccatcaaagatagtaaggctgtccacgccgacatgggatactggattgaatctgagaaaaatgaaacgtggaagctagcacgggcgagctttatcgaggtgaagacctgtatatggccaaaatcccatactctgtggtcaaacggcgttctcgaaagcgagatgatcattcccaagatctatggtggccctatttctcaacacaattaccgaccagggtacttcacacagaccgccggaccgtggcatctgggcaaacttgagttggatttcgacctgtgcgaagggactacagtggtagtcgatgagcactgcggaaacagaggcccctccttaaggaccacgactgtgaccggtaagatcatacacgaatggtgttgccgcagttgtacactccctccactgcggtttagaggggaggacggatgctggtatggcatggagattaggcccgtgaaagaaaaggaggaaaatcttgtcaagagcatggtttctgctggttccggcgaggtggactcattcagtctggggttgctctgtatcagcatcatgattgaagaggtaatgcgctcgcgatggtcccggaaaatgctgatgaccggaactctagccgtgtttttcctgctcatcatgggccagctgacatggaacgatcttattcgtttgtgcataatggtcggggcaaatgcttttgacagaatgggaatgggcaccacatacctggccttaatggcaactttcaagatgaggcctatgtttgccgtgggtctcctgttccgccggcttacctctagagaggttctgctactcacgatcgggctgagcttggtggcttcagtcgaactgccaaacagtttagaggaactcggagatggcctggcgatgggcattatgatccttaaactgttgacagactttcaatcccatcagctctgggccaccctgctatctctgactttcattaagaccacatttagccttcactatgcatggaaaactatggctatggtgctctccatcgtttcactgttgcccctgtgtttaagcaccacgagtcagaagacaacctggctcccggtgctgcttgggtctctgggatgcaagcctttgactatgttcctcatagccgagaataaaatctggggtaggaagtcctggccactgaacgaaggcattatggccgtcgggatcgtaagcattctactgtcgtcacttctcaaaaacgatgtgcccctggctggacctttgatcgcaggcggtatgttaatagcctgttacgttatttctgggagttccgcggacctgagcctcgagaaggctgccgaggtgtcttgggaagaggaagcagagcatagcggagcctcccacaatatcctggtcgaagtgcaggatgacggcacaatgaaaatcaaggatgaggagcgagacgatacccttactattctgttgaaagctacactactggcagtatcaggcgtgtatcccctcagtataccagccaccctgtttgtctggtacttctggcaaaagaagaaacagcgcagcggggttctttgggacacgccttctcccccagaagtggagcgggcggtgttagatgacggaatctatagaattatgcagaggggtctgctcggccgttcccaggtcggggtgggagttttccaagaaaacgtatttcatactatgtggcacgtgacccgcggcgctgtcttgatgtaccagggtaagcggctggagccgtcatgggccagtgtgaaaaaggacctcatcagctacgggggaggctggagactgaggggctcctggaatacaggggaggaagttcaggtgattgcagtcgagcctggcaaaaatcccaagaatgtgcagaccgccccaggtacattcaagactcccgaaggcgaggtaggggctatcgcccttgattttaaacctggaacctctggctcgccaatagtcaaccgagaaggtaagatcgtggggctgtatggaaatggcgttgtgacgacaagcggcacttacgtctcagcaattgctcaagccaaagcgtcccaggaggggcccttgcctgagatcgaagacgaggtgttccggaagcgcaacctaaccattatggatctgcacccgggaagtggtaaaacaagaaggtatctcccagccatcgttcgggaagcaataaagcgaaagttaagaaccctgattcttgctcccactcgcgtggtcgcctctgagatggctgaagcactgaaaggcatgcctatcaggtaccagaccacagccgtaaagagcgagcatacggggaaagagatcgtagacctcatgtgccacgccacttttaccatgcgtttgctgtccccagtgcgggttcccaattataacatgattatcatggatgaagctcatttcacagacccttcatctatagcggcaagaggatacattagcaccagggtcggcatgggtgaggccgctgccatctttatgactgcaacaccgcccgggagtgtggaagccttcccacaatccaatgctgtgattcaggatgaggaacgcgacatccctgagcgaagctggaactctggacacgagtggataaccgattttcccggcaagacggtctggttcgtaccatcaattaaatccggcaatgacatcgcgaactgtctcagaaagaatgggaagcgggtgatccagctgagtaggaaaacttttgatacagaatatcagaagaccaaaaacaacgactgggactacgttgtgaccactgatattagcgagatgggagccaatttccgcgcagaccgtgtcatcgatcctagacggtgccttaagcccgtgattctaaaagacggtccagaaagggttatactggctggcccgatgcctgtgacagtcgcctcggcagcccaacgccgagggagaatcggacggaaccataataaggagggcgatcagtacatttatatgggtcagcccttgaacaatgacgaggatcacgctcactggaccgaagccaagatgttactggacaacatcaatacaccagaggggatcattcccgcactcttcgaacctgagagggaaaaatctgcagccgtggatggcgagtaccgcctgagaggagaggctaggaagacttttgtagaacttatgcggcgtggcgacctgccagtgtggctctcctataaagttgccagcgaggggttccagtactcagatcgccgatggtgctttgacggagaaagaaacaatcaagtcttggaggaaaacatggatgtggagatatggacgaaggagggtgaaaggaaaaagctgcggccccgctggctagacgctagaacctatagtgaccctctggcactcagggagttcaaagaatttgccgctggccggcgatctgtgtccggggatcttatcctggagattggaaagttaccgcagcatttgacacagagagcccagaatgcactggacaacctcgtcatgctgcacaatagcgaacaaggcggtcgcgcgtacaggcatgccatggaggagcttccagatactatcgaaaccctgatgctcttggctctgattgccgttttaacagggggcgtgaccctattctttctgtcaggacggggcctcgggaagacaagtatcggacttctgtgtgtaatggcaagctccgtgttgctgtggatggcttctgtcgagccccactggatagccgcaagcatcattctcgagttctttctgatggtgcttctcatccctgagcccgaccgtcagagaacgccacaggataaccagctggcctatgttgtgattggtttgctgttcatgatcttaaccgtcgctgcgaatgagatgggcctactggaaacaactaaaaaggacctcgggataggacacgtagccgtggagaaccatcaccatgcagctatgcttgatgttgacctgcaccctgcctccgcctggaccttgtacgcagtggctacaaccattatcactcccatgatgaggcatacaattgaaaacacgaccgccaatatctcactgactgcgatagctaaccaagccgcaatcctcatgggcctggataaaggttggccaatttctaagatggacatcggggtccctcttttagccctgggctgctacagtcaggtgaatccgctcacattgaccgctgcagtcctgatgctagtggcccactatgcgattatcggacccggcctgcaggctaaagccacccgcgaggcacaaaagcggacagccgctgggataatgaagaacccaactgttgatggaattgtggccatcgacctcgatcctgtagtgtacgacgcaaaatttgaaaagcagcttggccagatcatgctgttgattctgtgtacgtcgcagatcctcctgatgcgaaccacatgggctttatgcgagagcataactcttgccaccggtcccctgacaaccctctgggaggggtccccaggaaaattctggaatactacgattgcggtctctatggccaacatctttagaggctcatatctagcaggagctggcctggccttcagcttgatgaagtccctagggggtggcaggcgcgggacaggagcacaaggcgaaaccctcggtgagaaatggaagcggcagcttaatcagctgagtaagtctgagttcaacacttacaaaagaagcgggattatggaggttgaccgttcagaagctaaggagggattgaaaaggggcgagaccacaaagcacgccgtgtcccggggtactgccaaactgcgctggtttgtcgaacgaaatctcgtgaagcctgagggcaaggtaatcgatttagggtgtggaagaggcgggtggagttattactgcgcgggactgaaaaaggtgaccgaagttaaaggctatacaaagggtgggcccggacatgaggaaccgataccaatggctacgtacggctggaaccttgtgaaactgcacagcggcaaggacgtcttctttatccctcccgagaaatgtgataccctactctgcgacattggggagtcttccccaaatcccactatcgaagagggaaggacactgcgggtgttgaagatggtcgaaccttggctgcgcggtaaccagttctgtattaagatcctcaatccgtacatgccctcagtggttgagacccttgagcaaatgcagagaaaacatggcgggatgctggtaaggaacccattaagccgaaattcgactcacgaaatgtattgggtgtcttgcggaacaggcaacattgtcagtgcagtgaatatgacctcccggatgctgttgaaccgttttacgatggcccacagaaagcctacctacgagcgcgatgttgacctcggtacagggactaggcatgtggctgtcgaacccgaggtggccaacctggatatcataggacagcggattgaaaatatcaaacacgagcataagagcacctggcactatgacgaggataacccttacaaaacatgggcatatcatggctcatacgaagtaaagccatccggctctgccagcagtatggtgaatggggttgtcaagctacttactaaaccctgggacgtgatccctatggtgacccagattgctatgacagataccactccattcggacaacagagagtctttaaggagaaagttgacacgcgcacacccaaggcgaaaaggggtaccgcccagataatggaagtgactgcacgatggctgtggggcttcctctcccggaacaagaagccgagaatctgtaccagggaggaatttacacgcaaagtacgtagcaatgctgccattggggcagtgttcgtcgacgagaaccaatggaactctgccaaggaggctgtggaagatgagcggttttgggacctggttcacagagaaagggagttgcacaaacagggaaagtgcgccacgtgcgtgtataacatgatgggcaaacgcgaaaagaagctgggtgagttcgggaaagcgaagggatcacgagcaatctggtacatgtggctcggcgcccggtttcttgagttcgaagctctgggcttcatgaatgaggatcattggtttagtagagaaaactccttaagcggggtcgagggagagggtctgcacaaattgggctacattctcagggacatctctaagatacctgggggaaatatgtatgccgatgacaccgcaggctgggatactcgcatcacagaagacgatctgcagaacgaggctaaaattaccgacatcatggaaccagagcatgccctacttgctaaggccattttcaaactgacttaccagaataaggtggtaagagttcaacggcccgcaaagaacggtacagtgatggatgtcatctcgaggcgtgaccagcgagggtcaggacaggtgggcacctatggcctcaatacatttactaacatggaagcgcagctgatacgccaaatggagagcgaggggattttctcccctagtgaattggagaccccaaacttagccgaaagagctctggattggctcgagaaatacggagtggaacggcttaagaggatggccatctctggtgacgactgtgtcgttaaacccatcgatgaccgctttgcaacggctctgaccgccctaaatgatatgggcaaggtgagaaaagacattccgcagtgggagcctagcaaggggtggaacgattggcagcaggtacccttctgctcccaccactttcatcaactgataatgaaggacggacgggagatcgtggtcccatgtaggaatcaggatgaactcgtgggccgagcacgtgtttcacagggtgccgggtggagtttgagagagacagcgtgcctgggaaaatcttatgctcagatgtggcaacttatgtacttccaccgccgggacctgaggctcgccgcaaacgccatttgtagcgctgtgcctgtcgattgggtgcccacttccagaaccacatggtcaatccatgcccaccatcagtggatgactaccgaagacatgttaagcgtatggaatcgcgtttggattgaggaaaacccatggatggaggataagacgcacatctcttcctgggaggacgtgccctatctgggcaaacgggaagaccagtggtgcggcagtttgatagggctgacagcaagggctacctgggccactaatatccaagtcgcgattaaccaggtgcgaagactcatcggaaatgagaactaccttgattacatgacaagcatgaagcggtttaaaaatgaatcggaccctgagggtgctctgtggtga

SEQ ID NO: 13777 - RNA, 9879 nt, synthetic construct
  misc_feature 1..9879: note = derived and/or modified CDS sequence (opt3) from DENV-1__GQ199801__SS-prME
  source 1..9879: mol_type = other RNA
agcgtgaccatgctgctcatgcttatgcccacagcactggctttccacttgactacgagaggcggggaacctcatatgatcgtctccaagcaggaaagggggaaatctttactgtttaagacctcagccggtgttaatatgtgcacactaattgccatggacctcggcgaactgtgtgaagatactatgacctacaaatgcccacggataacagaagcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccgtgctgaggaaactttgcattgaagctaagatctctaatacgaccacagatagccggtgtccaactcaaggagaggccaccctggtcgaagaacaagacgcaaacttcgtttgccgccgaacatttgtggatagaggctggggtaatgggtgtggattgttcggcaaaggctccctcataacttgcgctaagtttaagtgcgtaaccaggctggaggggaaaattgtgcagtacgaaaacttaaagtattcagtcatcgtgacagttcacaccggagaccagcatcaagtgggtaatgagagtactgaacacggcacgacagccaccattactccccaggcgcctagcaccgagatccagctgacagactacggggccctcacccttgattgttctccacggactggactggacttcaacgaaatggtcttgctaacaatgaaagagaagtcctggctggtgcataaacagtggtttctcgatctgccgcttccctggacgtcaggcgcaagcaccagtcaagagacttggaatcgtcaggacctgttggtaacattcaagaccgctcacgccaaaaagcaggaagttgtggtcctcggttctcaagagggggctatgcacacagccctgactggcgcaaccgaaatccagacgtccggaaccacaactatttttgccggccatttaaagtgccgcctgaaaatggataagctaaccctcaaagggatgagctatgtgatgtgtacaggatcgttcaagctggagaaagaagtcgctgagactcagcacggtaccgtgcttgttcagataaagtacgagggcacggacgcgccttgcaagatcccattctctacacaagatgaaaaaggggtgacccagaacggaagattgattactgcaaatcccatcgtaacagacaaggagaaacctgtcaacatagaagccgagccaccctttggcgagtcctatattgtgatcggtgctggggaaaaggccctgaaactctcatggttcaagaagggcagtagcatcggaaaaatgtttgaggcaaccgccaggggcgctcggcgaatggccattctgggggatactgcatgggacttcggatccatcggtggcgtttttacctctgtggggaaacttgtccatcagattttcggaacagcgtacggcgtgctgtttagcggtgtatcatggacgatgaaaatagggatcggcgtgttgctcacctggctgggattaaatagtcgctccactagcctgtctatgacatgtattgctgttggcctagtcaccctctacctgggggtgatggtgcaggccgattcaggatgcgtcatcaactggaagggcagagaacttaaatgtggtagtgggatcttcgttacaaatgaggtgcacacttggaccgaacaatataagtttcaggcagacagcccgaagaggttgtccgccgctattggaaaagcctgggaggagggcgtgtgcggtatacggtctgcaacgcgcctggaaaacatcatgtggaagcagatttcgaacgagctcaatcatatcctgttagaaaacgacatgaaattcacagtagtcgtgggcgatgttgctgggattctggcccagggaaagaaaatgatcagacctcaacccatggagtacaagtatagctggaaatcctggggcaaggcgaagataatcggggccgacgtgcagaataccacttttattatcgatggaccaaacacccctgaatgtcccgacgatcagagggcttggaatatttgggaggtcgaggactacggcttcggtatctttacaactaacatatggcttaaattgcgtgattcatatacccaggtgtgcgaccaccggctcatgagtgcagccattaaggattctaaagctgttcacgccgacatggggtactggatcgaaagcgagaagaatgaaacatggaaactggcacgagcgtccttcattgaggtgaagacgtgtatctggccaaagtcacataccctatggagcaacggagtactggaatctgagatgataatccccaaaatttatggcggtcctatctcccaacacaattacagaccaggctacttcactcagacagccgggccgtggcatctcggaaagctggagcttgattttaacttgtgcgaaggcaccactgtcgtggtggacgagcactgcgggaataggggacccagtctgcgcacaaccacggtcactggcaaaattatccacgaatggtgttgccggagctgtaccttacctccactcagattcaagggtgaggatgggtgctggtatggaatggagataaggcccgttaaagaaaaggaggaaaacctggtgaagtctatggtatccgctggctcaggtgaggtggacagttttagccttggcctgttgtgtatttcgatcatgatcgaagaggtcatgcgctcccgatggtctaaaaagatgctcatgacagggaccctggccgtgttctttctactgattatgggacagctcacttggaatgacctgatccggctttgcattatggttggcgcaaacgctagcgatcgtatggggatgggaacaacctacttggccctgatggcaacattcaaaatgagacctatgttagccgtgggcctcctgtttaggcgccttacttcacgggaggtcctgctactcaccataggtctgagtttggtggcttccgttgaactgccaaattctttagaggaactcggggacggactggcgatgggcatcatgattcttaagctgttgacggatttccaaagccatcagctctgggccacactgctatccctgacctttatcaaaactacctattcacttcactacgcatggaagacaatggctatggtgctcagcattgtcagtctgttccccttgtgtctgtctactacctcccagaagacgacatggttaccggtactcctgggcagccttgggtgcaaacctctgaccatgtttttgatcgccgagaacaagatatggggaagaaaatcgtggccactcaacgaaggtatcatggccgtgggcattgtttcaatcctgctatctagtctgcttaagaatgacgtgcccctcgctgggcctctgattgcaggaggcatgttgatcgcctgttatgtcatatccggtagctctgcggatttaagcctggagaaagctgccgaggtgtcctgggaagaggaagcagagcattcaggggccagtcacaacattctcgtagaagtgcaggacgatggaactatgaagatcaaagacgaggagagggatgacacactgaccatccttctgaaggctactttgctagcagtcagcggcgtttaccccctgtctattccagccacactcttcgtgtggtatttttggcaaaagaaaaagcagcgatccggcgtgctgtgggataccccttcacccccagaagtcgagcgcgcggtgcttgacgatgggatataccggatcatgcagagaggattactgggtaggagtcaggttggcgtaggggtgttccaagaaaatgtcttccatacgatgtggcacgtgactcgtggagctgttctcatgtaccagggcaaacgcttggagccgagctgggcctccgtgaagaaagacctgatttcttatggtgggggatggcggctccagggctcgtggaacaccggcgaggaagtccaggtgatcgcagtagagcctgggaagaatcccaagaacgtccaaacagccccaggaacctttaaaacaagcgaaggtgaggtgggcgctattgccctggacttcaagcccgggacttcaggatcccctatcgttaatagagaaggcaaaatagtgggtctttacgggaacggagtcgtgaccacgagtggcacatatgtttctgcaatcgctcaggccaaggcgagccaggagggcccactgcccgagattgaaaatgaggtgtttaggaaacgaaacttgactatcatggatctacaccctgggtccggaaagacccggcgctacctgccggccattgtcagagaagcaatcaagaggaaactccggacattaatactggctccaacccgagtggtagcctcagagatggctgaagcacttaagggtattcccatcagatatcaaactaccgccgtgaaatctgagcatacaggcaaggagatcgttgacctgatgtgccacgccacgttcactatgcgcctcttgagccctgtcagggtgccaaattacaacatgattatcatggatgaagctcattttaccgaccccagttccatagcggcacgtgggtatattagcacacgggtgggaatgggcgaggccgctgccatcttcatgaccgcaactcctccgggttctgtcgaagcctttccccagtcaaatgctgtaattcaggatgaggaaagagacatcccagagaggtcctggaacagtgggtacgagtggataacagatttccctggaaaaaccgtgtggtttgttcccagcattaagtcgggcaatgacatcgcgaactgtctgcgcaagaacggcaaacgagtgatccagctctctagaaagacgttcgatactgaataccagaagacaaagaataacgactgggattatgtcgtgaccaccgacatttccgagatgggggccaattttcgggcagacagggttatcgatccacgccgttgcctgaaacctgtgattcttaaggacggacccgaaagagtcatactagctggtccaatgccggtgactgtagccagcgcagcccagcggaggggccgcatcgggcgaaaccacaataaggagggagatcagtacatttatatgggccagcctctgaacaatgacgaggatcatgctcactggacagaagccaaaatgttgttagacaacatcaatacccccgagggtatcattccagcgctgttcgaacccgagagagaaaagtcagcagccatagatggggagtaccggctcaggggcgaggctcgcaaaacattcgtggaactgatgagaaggggagaccttcctgtttggctgagttataaggtcgcctctgagggctttcaatactccgatcggcgttggtgcttcgacggggaacgcaacaatcaggtgctcgaggaaaacatggatgtggagatctggactaaagagggagaacgaaagaaattgagaccaaggtggctggacgctcggacgtatagcgatcccctagcactgcgcgagtttaaggagttcgccgctggtagaaggtcagtcagtggcgacctcattcttgagatcgggaagctgcctcagcacttaacccagcgggcccaaaatgcattggacaacctggttatgctccataatagcgaacagggaggccgagcgtacagacacgccatggaggagctgccggatacaattgaaactcttatgctgctcgctttgatcgccgtgctgaccggtggggtaacattatttttcctatccggccgcggactgggcaaaacctctatagggctcctttgtgtgatggcaagctccgtcctgttgtggatggcttcagtggagccacattggatcgccgcatctattatcctggaatttttcctcatggttctgcttattcccgagcctgacaggcagcggactccccaggataaccaactcgcctacgtggtcatcggactgttgtttatgatactgacggtagctgcgaacgagatgggtttactagaaaccacaaagaaagacctgggcattgggcacgtggccgttgagaatcaccatcacgcagctatgctcgatgtggaccttcatccagccagtgcctggactctgtatgcagtcgctaccacaatcattacccctatgatgcgtcacactatcgaaaacacaacggccaatatatcgttgaccgcgatcgctaaccaggccgcaattctgatgggactcgataagggctggcccatcagcaaaatggacattggtgtgccactgcttgccttagggtgctactcccaggtcaatcctctgactctcacagctgcagtgttgatgctggttgcccattatgcgatcataggcccgggactacaagctaaggccaccagagaggcacagaagaggaccgccgctggcattatgaaaaaccccacagtggatgggatcgtagccatcgacctggatccagtggtctacgacgcaaagttcgaaaaacagctcggacagattatgcttctgatcttgtgtacttctcaaatactgctcatgcgcacgacctgggctctgtgcgagtcaattacattagccactggccctcttaccacactgtgggagggtagccccgggaagttttggaataccactatcgcggtttccatggccaacattttccggggaagttatctcgcaggcgctggtctagccttttctctgatgaagtcattgggcgggggacgaagaggcacgggggcacagggagaaacactgggcgagaagtggaagaggcagctcaatcagcttagcaaatccgagttcaacacctacaagcgcagtggtatcatggaggtggatcggagcgaagctaaagaggggctgaagagaggagagactaccaaacacgccgtctctcgtggcacagccaagttgaggtggttcgtggaacggaatctggtaaagccagagggtaaagtgatagacctcggctgtgggcgcggaggctggtcctattactgcgcggggttaaagaaagttactgaagtgaagggatacaccaaaggcggtcctgggcacgaggaacccatcccgatggctacatatggatggaacctggtcaaacttcattcaggcaaagacgtgtttttcattccacctgagaagtgtgatacgctgctatgcgacatcggcgagagctcgcccaatccaaccattgaagaggggcgaactctcagagtcctgaagatggtggaaccctggttgaggggaaaccaattttgtatcaaaattctgaatccttacatgccgtctgttgtagagacactcgagcagatgcagcggaagcacggtggcatgcttgtgcgcaaccccctgagtagaaattccacccatgaaatgtattgggtcagctgcgggactggaaacatcgtgtcagcagttaacatgacatccaggatgttactgaatcgattcaccatggcccaccggaaaccaacgtacgagcgtgatgtggacttgggcgctggtaccagacacgtcgccgtggaacctgaggtagcaaacctcgatataattgggcagcgcatcgaaaatatcaagcatgagcacaaatctacatggcattatgacgaggataacccctacaagacttgggcctatcacggaagctacgaagtgaagcctagtggctccgctagctctatggttaatggcgtcgtgaaactgctaaccaagccatgggacgtgattcccatggtcacacaaatagcgatgactgataccacaccttttgggcagcagagggttttcaaagagaaggtggacacccggactccaaaagccaagagaggaacggcacaaatcatggaagtaacagctaagtggctttggggttttctgtcacgcaacaaaaagcccaggatttgtacccgagaggagttcactcggaaagtgagaagtaatgccgcaatcggcgccgtctttgtggatgagaaccagtggaactccgctaaggaggccgttgaagacgagaggttctgggacctcgtgcatcgcgaacgtgagctgcacaaacaggggaagtgcgcgacctgcgtctacaacatgatgggaaagcgggagaagaagttgggcgagtttggtaaagcaaaggggagcagagccatttggtatatgtggctgggagctaggttcctcgagtttgaagcccttggcttcatgaatgaggatcactggttctctcgcgaaaactcgctgtcaggcgtggagggggagggattacataaactgggttacatcttgcgagacataagcaagatcccgggcgggaatatgtatgcagatgacacagctggatgggatacgcggattaccgaagacgatctccagaacgaggccaaaatcactgacattatggaacctgagcacgctctgctagccaagtccatctttaaacttacataccaaaataaagtagttagagtgcagaggccagcaaagaacggcaccgtcatggatgtgataagtcgcagagaccagcggggttctggacaggtgggaacttatggcctgaacacattcaccaatatggaagcgcaactcattaggcagatggagagcgagggcatcttttccccctcagaactggagacacctaacttggccgggcgtgtcttagattggctggaaaaacatggagttgagcgactcaagcgcatggctatcagtggtgacgattgtgtggtaaaaccaattgacgacagattcgccactgcacttaccgctctgaatgatatgggcaaggtgcggaaggacataccccagtgggaaccgtctaaagggtggaacgattggcagcaagtccctttttgcagccaccacttccatcagctaatcatgaaggacggaagggagattgtggttccctgtcgcaatcaggatgagctggtgggcagagcccgggtctcccagggtgcagggtggtcactcagggaaacggcctgcttgggaaaaagctacgcgcaaatgtggcagctgatgtattttcaccgacgtgaccttagactggctgccaacgcaatctgttctgccgtgccagtagattgggttcctacctcccgcacaacttggagtattcatgctcaccatcagtggatgaccacagaggacatgctcagcgtgtggaatcgggtctggatcgaagagaacccctggatggaagataagactcacatatcgtcctggggcgacgtgccatacttaggcaaaagggaggatcaatggtgcgggtctctgatcggattgaccgccagagcaacgtgggctacaaatattcaggttgccatcaaccaggtgcgccggctgattggtaatgagaactacctcgactatatgacctcaatgaagaggttcaagaatgaaagcgaccccgagggcgcgctttggtga

SEQ ID NO: 13778 - RNA, 9879 nt, synthetic construct
  misc_feature 1..9879: note = derived and/or modified CDS sequence (opt3) from DENV-1__GQ199802__SS-prME
  source 1..9879: mol_type = other RNA
agcgtgaccatgctgctcatgcttatgcccacggccctggctttccacttgactacgagaggaggggaacctcatatgatcgtctccaagcaggaaagaggaaaatctttactgtttaagacctcagccggtgttaatatgtgcacactaattgccatggacctcggcgaactgtgtgaagatactatgacctacaaatgcccacggattacagagaccgaaccggacgatgtggactgttggtgcaatgcgactgatacatgggtaacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccgggagcttcaaactggagaaggaagtcgccgagacgcagcacggtacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattgtgatcggtgccggggaaaaagctctgaagctctcctggttcaagaaaggctcaagtatcggaaagatgtttgaggccaccgcaagaggcgccaggcggatggctattctgggggatacagcctgggacttcggaagcatcggtggcgtttttacgtccgtggggaaacttgtccatcagattttcggaaccgcatacggcgtgctgttttctggtgtaagctggactatgaagatagggatcggcgtgttgctcacatggctgggattaaattcacgaagtacctccctgagcatgacatgtattgcggttggcctagtcactctctacctgggggtgatggtgcaggctgattctggatgcgtcatcaactggaaaggccgcgaacttaagtgtggttcagggatcttcgttaccaatgaggtgcacacgtggacagaacaatataagtttcaggccgacagtccgaaaagattgagcgcagccattggaaaggcttgggaggagggcgtgtgcggtataaggtccgccacccggctggaaaacatcatgtggaaacagatttctaacgagctcaatcatatcctgttagaaaacgacatgaagttcactgtagtcgtgggcgatgttgcagggattctggctcagggcaaaaagatgatccgccctcaacccatggagtacaaatattcgtggaaaagctggggcaaggccaagataatcggggcggacgtgcagaataccacatttattatcgatggaccaaacactcctgaatgtcccgacgatcagagagcctggaatatttgggaggtcgaggactacggcttcggtatctttaccacaaacatatggcttaagttgagggattcctatacacaggtgtgcgaccaccgtctcatgtcagctgcaattaaagatagtaaggccgttcacgctgacatggggtactggatcgaatctgagaaaaatgaaacctggaagctggcccgggcatccttcattgaggtgaagacttgtatctggccaaaatcccatacactatggtcaaacggagtactggaaagcgagatgataatccccaagatttatggcggtcctatctctcaacacaattaccgaccaggctacttcacccaggcggccgggccgtggcatctcggaaaactggagcttgattttgacttgtgcgaaggcactacagtcgtggtggatgagcactgcgggaacagaggaccctccctgaggaccacgactgtcaccggcaagattatccacgaatggtgttgccgcagttgtacattacctccactccggttcaaaggtgaggacgggtgctggtatggaatggagataagacccgttaaggaaaaggaggaaaatctggtgaaaagcatggtatctgctggctccggtgaggtggactcatttagtcttggcctgttgtgtattagcatcatgatcgaagaggtcatgaggtcgcgctggtcccgacggatgctcatgaccgggactctggccgtgttctttctactgattatgggacagctcacatggaacgatctgatccgtctttgcattatggttggcgcaaatgcttctgacagaatggggatgggaaccacatacttggccctgatggcaactttcaagatgaggcctatgtttgccgtgggcttactcttccgccggctgaccagcagagaggtccttctgctaacgataggtctctcactggtggctagtgttgaattgccaaactccctggaggaattaggggatggactcgcgatgggcatcatgattctgaaacttctgacagactttcaatctcatcagttgtgggccaccctcctgagcctaactttcatcaagaccacattttccctgcactatgcatggaaaactatggctatggtgctttcaattgtcagcctcttccccctgtgtttgagtaccacgtctcagaagacaacctggctgccggtattactcggctccctggggtgcaagcctcttactatgtttctgatcgccgagaataaaatatggggaaggcgaagctggccattgaacgaaggtatcatggccgtgggcattgtttcgatcctcctgtcatctctactgaagaacgatgtgccccttgctgggcctctcattgcaggaggcatgctgatcgcctgttacgtcataagtggttccagcgcggacttgtctttagagaaagctgccgaggtgagctgggaagaggaagcagagcattccggggcctcacacaatattctggtagaagtgcaggatgacggaacaatgaagatcaaagatgaggagcgcgacgataccctcactatcctgcttaaggctacactgttggcagtcagtggcgtttatcccctaagcattccagccaccctgttcgtgtggtacttctggcagaaaaagaagcagcggtctggcgtgctctgggacacgccttcacccccagaagtcgagagagcggtgctggatgacgggatatataggatcatgcagcgtggacttttaggtcgcagccaggttggcgtaggggtgtttcaagaaaacgtcttccatactatgtggcacgtgacccggggagctgttctgatgtaccagggcaaaagactcgagccgagttgggccagcgtgaagaaagacttgatttcctacggtgggggatggaggctgcagggctcttggaatacaggcgaggaagtccaggtgatcgcagtagagcctgggaagaaccccaaaaatgtccaaaccgccccaggaacatttaagactcccgaaggtgaggtgggcgctattgccctcgatttcaagcctgggacctcgggaagcccaatcgttaaccgagaaggcaaaatagtgggtctgtatgggaatggagtcgtgacgacatcaggcacttacgtttccgcaatcgctcaggccaaggcgagtcaggagggcccccttcctgagattgaagacgaggtgtttcggaaacgcaacctgaccatcatggatttgcacccggggtctggaaagacaagaaggtatctaccagccattgtccgggaagcaatcaaacgaaagctgagaaccctcatattagctcccactcgcgtggtagccagcgagatggctgaagcactgaagggtatgcctattaggtaccaaaccacagccgtgaaatccgagcatacgggcaaggagatcgttgaccttatgtgccacgccactttcaccatgcgtctgctctcaccagtccgggtgcccaattataacatgatcattatggatgaagctcattttacagacccttctagcatcgcggcaagagggtacataagtaccagggtgggaatgggcgaggccgctgccattttcatgactgcaacaccgcccggttccgtcgaagcctttccacagagcaatgctgtaatccaggatgaggaacgcgacattcctgagcgatcttggaactcagggtatgagtggatcaccgatttccccggaaaaacggtgtggtttgttccatccataaagagtggcaatgacattgcgaactgtttgaggaaaaatggcaagcgggtgatccagctgagcaggaagactttcgatacagaataccagaaaaccaagaacaacgactgggactacgtcgtgaccactgatatctcggagatgggggccaatttccgcgcagaccgtgttattgatcctagacggtgcctcaaacccgtgatcctgaaggacggaccagaaagggtcattcttgctggtccgatgcctgtgacagtagcctctgcagcccagcgccgaggcagaatagggcggaaccacaataaagagggagatcagtatatctacatgggccagcccctaaacaatgacgaggatcatgctcactggaccgaagccaagatgctgttggacaacattaatacaccagagggtatcatccccgcgttatttgaacctgagagggaaaagtccgcagccattgatggggagtatcgcctgagaggcgaggctaggaaaactttcgtggaactcatgcggcgtggagacctgccagtttggcttagctacaaggtcgcctcagagggctttcaatatagtgatcgccgatggtgcttcgacggggaaagaaacaatcaggtgctggaggaaaacatggatgtggagatatggacgaaagagggagaaaggaagaaactccggccccgctggttggacgctagaacctactctgaccctctggcactaagggagtttaaggagttcgccgctggtcggcgatccgtcagcggcgatctgatcctcgagattgggaaacttccgcagcacctgacacagagagcccaaaatgcattagacaacttggttatgctgcataattcagaacagggaggccgcgcgtataggcacgccatggaggagctcccagatactatcgaaaccctgatgcttctggctctcattgccgtgttgacaggtggggtaaccctgtttttcttaagtggccggggactaggcaagactagcatcgggctgctctgtgtgatggcatcctctgtccttctgtggatggctagcgtggagccccattggatagccgcatccatcattttggaatttttcctgatggttctcctgatccctgagcccgaccgtcagagaacgccacaggataaccaacttgcctacgtggtcattggactcctgtttatgatcttgaccgtagctgcgaatgagatgggtctgttagaaacaactaagaaagacctaggcatagggcacgtggccgttgagaaccaccatcacgcagctatgctggatgtggacctccatcctgcctcagcctggaccctttacgcagtcgctacaaccattatcactcccatgatgaggcacacaattgaaaacacgaccgccaatatctctctgactgcgatagctaaccaggccgcaatcttgatgggactggataagggctggccaattagtaaaatggacatcggtgtgcctctcctggcccttgggtgctattcgcaggtcaatccgttaacactgaccgctgcagtgctcatgttggttgcccattacgcgattatcggccccggactgcaagctaaggccacccgcgaggcacagaaacggacagccgctggcataatgaagaacccaactgtggatgggattgtagccatcgacctagatcctgtggtctatgacgcaaagttcgaaaaacagctgggacagatcatgctccttattctgtgtacgagccaaatcttgctgatgcgaaccacatgggctctctgcgagtccataactctggccaccggccccttaacaaccctttgggagggttctccagggaagttttggaatactacgattgcggtttcaatggccaacatcttcagaggaagctacctggcaggcgctggtctcgccttctccctaatgaaaagtctgggcgggggaaggcgcggcacaggggcacagggagaaaccttgggcgagaagtggaaacggcagctgaatcagctctctaagagcgaatttaacacttataagagatcaggtattatggaggtggaccgttccgaagctaaagaggggcttaagaggggagagaccacaaaacacgccgtcagtcggggcactgccaagctgcgctggttcgtggaacgaaatttggtaaaacctgagggtaaggtgatcgatctgggctgtgggagaggaggctggagctactattgcgcggggctcaagaaagttaccgaagtgaagggatacacaaaaggcggtcccgggcacgaggaaccgataccaatggctacgtacggatggaacttagtcaagctgcattctggcaaagacgtgtttttcatccctcccgagaagtgtgatacccttctgtgcgacattggcgagtcctcaccaaatcccactatcgaagaggggaggacactacgggtcctcaaaatggtggaaccttggctgcgcggaaaccaattttgtattaagatcttgaatccgtatatgcccagcgttgtagagaccctggagcagatgcagagaaagcacggtggcatgctcgtgaggaacccactttcgcgaaattctactcatgaaatgtactgggtcagttgcgggacaggaaacattgtgtccgcagttaatatgaccagccggatgctgttaaaccgtttcacgatggcccacagaaaacctacctatgagcgcgatgtggacctgggcgctggtacaaggcacgtcgccgtggaacccgaggtagcaaacttggatatcatagggcagcggattgaaaatatcaagcatgagcacaaatcaacttggcattacgacgaggataacccttataagacctgggcctaccacggatcctatgaagtgaaaccatctggcagcgctagttccatggttaatggcgtcgtgaagctcctgacaaagccctgggacgtgatccctatggtcactcaaattgcgatgaccgatacaaccccatttgggcagcagagagttttcaaagagaaggtggacactcgcacgcccaaagccaagaggggaacagcacaaataatggaagtaaccgctaaatggctatgggtgtttcttagccgaaacaagaagccgcggatctgtactagagaggagttcaccaggaaagtccgctctaatgccgcaattggtgccgtgtttgttgacgagaaccagtggaactcagctaaggaggccgtggaagatgagcgtttctgggacctggtccatcgggaaagagagctccacaaacagggcaagtgcgcgacatgcgtgtacaacatgatggggaaaagggaaaagaagctgggagagtttggcaaagcaaagggtagtcgcgccatctggtacatgtggttgggggctcgattcctggagttcgaagccctcggatttatgaatgaggatcactggttctcccgggaaaacagcctttctggcgtagagggcgaggggctgcataaattaggatatattctgagagacatctcgaagatacctggtggcaatatgtacgcagatgacacggctgggtgggataccaggatcactgaagacgatttgcagaacgaggcccgcattacagacatcatggaaccagagcacgctctcctggccaaatcaatttttaagctaacctatcaaaataaagttgtgagagtccagcggcccgcaaagaacggaactgtgatggatgtgatcagcaggcgtgaccagcgaggctccggtcaggtcgggacatacggacttaataccttcacaaacatggaagcgcaactgatacgccagatggagagtgagggcatattttctcctagcgaactcgagactccaaacctggccgaaagagttttggattggttagagaagtatggcgtggaacggctgaaaaggatggctatctccggggacgactgtgtagtgaagcccatcgatgaccgcttcgccaccgcactcacggctcttaatgatatgggaaaagtcagaaaggacattccgcagtgggagccttcaaaaggttggaacgattggcagcaagtgcccttttgcagtcatcacttccaccagctgataatgaaggacggccgggagatcgttgtgccatgtaggaatcaggatgagctagtcgggcgagcccgtgtgtctcagggagcaggctggagcctgagagagaccgcctgcctcggtaagtcctacgcgcaaatgtggcagttgatgtattttcatcgccgggacctgaggcttgctgccaacgcaatttgttcagccgtacctgttgattggatccccacaagcagaactacctggtctattcacgctcatcaccagtggatgacaactgaagacatgctgtccgtgtggaatcgcgtctggatcgaggaaaacccatggatggaggataaaacccatataagtagctggggagacgtgccctacctcggaaagcgggaggaccaatggtgcggctcgttaatcggcctgacggccagggcaacatgggctaccaatattcaggttgccatcaaccaggtgcgaagattgattgggaatgaaaactacctggattatatgacttccatgaaacggttcaagaatgagtctgaccctgaaggagcgctctggtga

SEQ ID NO: 13779 - RNA, 9879 nt, synthetic construct
  misc_feature 1..9879: note = derived and/or modified CDS sequence (opt3) from DENV-1__JF937597__SS-prME
  source 1..9879: mol_type = other RNA
agcgtgaccatgctgctcatgcttatgcccacagcactggctttccacttgactacgagaggaggggaacctcatatgatcgtctccaagcaggaaaggggaaaatctttactgtttaagacctcagccggtgttaacatgtgcacattaattgccatggacctcggcgaactgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaattgctcaagacagaggtgaccaaccctgccgtgctgaggaaactttgcattgaagctaagatctctaatacgaccacagatagccggtgtccaactcaaggagaggccaccctggtcgaagaacaggacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatgtgtactggatcgttcaaactggagaaggaagtcgctgagacccagcacggtacggtgcttgttcagataaagtacgagggcacagacgcgccttgcaaaatcccattctcgacccaagatgaaaagggggtgactcagaacggacgcttgattacagcaaatcccatcgtaaccgacaaagagaagcctgtcaacatagaagccgagccaccctttggcgagtcttatattgtgatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtttttacatccgtggggaaacttgtccatcagattttcggaacggcgtacggcgtgctgttttctggtgtaagctggaccatgaagatagggatcggcgtgttgctcacttggctgggattaaattcacgaagtacatccctgagcatgacctgtattgctgttggcctagtcacactctacctgggggccatggtgcaggcagattctggatgcgtgatcaactggaaaggccgcgaacttaagtgtggttcagggatcttcgtcactaatgaggttcacacctggacggaacaatataagtttcaggccgacagtccgaaaagattgagcgctgccattggaaaggcatgggaggagggcgtgtgcggtataaggtccgctacacggctggaaaacatcatgtggaaacagatttctaacgagctcaatcatatcctgttagaaaacgacatgaagctgaccgtggtagtcggcgatgtggccgggattcttggacagggcaaaaagatgatccgccctcaacccatggagtacaaatattcgtggaaaagctgggggaaggcgaaaataatcggagccgacgctcagaatactaccttcattatcgatggcccaaacacacctgaatgtcccgacgatcagagagcatggaatatttgggaggttgaggactacggttttgggatcttcactaccaacatatggttgaagctcagggattcctatacacaggtgtgcgaccaccgtctgatgtcagccgctattaaagatagtaaggccgtccacgcagacatgggatactggatcgaatctgagaaaaatgaaacgtggaagctagcgcgggccagctttattgaggtgaagacctgtatctggccaaaatcccatactctgtggtcaaacggcgttctcgaaagcgagatgataatccccaagatttatggtggccctatctctcaacacaattaccgaccagggtacttcacacagaccgctggaccgtggcatctgggcaaacttgagttggatttcgacctgtgcgaagggactacagtggtagtcgatgagcactgcggaaacagaggcccctccttaaggaccacgactgtgaccggtaagattatccacgaatggtgttgccgcagttgtacactccctccactgcggtttagaggggaggacggatgctggtatggcatggagataaggcccgtgaaagaaaaggaggaaaatcttgtcaagagcatggtttctgccggttccggcgaggtggactcattcagtctggggttgctctgtattagcatcatgatcgaagaggtaatgcgctcgcgatggtcccggaaaatgctgatgaccggaactctagcagtgtttttcctgctcattatgggccagctgacatggaacgatcttatccgtttgtgcattatggtcggggctaatgcctctgacagaatgggaatgggcaccacatacctggcattaatggccacttttaagatgaggcctatgttcgctgtgggtctcctgtttcgccggcttaccagcagagaggttctgctactcacgatagggctgtcattggtggcgagtgtcgaactgccaaactccttagaggaactcggagatggcctggccatgggcatcatgattcttaaactgttgacagacttccaatctcatcagctctgggcaaccctgctaagcctgacttttatcaagaccacattctcccttcactatgcttggaaaactatggccatggtgctctcaattgttagcctgtttcccttgtgtctgagtaccacgtctcagaagacaacctggttaccggtgctcctggggtcccttggatgcaagcctctgactatgttcttgatcgccgagaataaaatatggggtaggaagtcctggccactcaacgaaggcatcatggctgtcgggattgtatcgatcctgctatcatctctgcttaaaaacgatgtgcccctcgcaggacctctgattgccggcggtatgttgatcgcgtgttacgttataagtgggtccagcgctgacttatctctggagaaggccgcagaggtgagctgggaagaggaagccgagcattccggagcttcacacaatattctcgtcgaagtgcaggatgacggcacaatgaaaatcaaggatgaggagcgagacgataccctgactatccttctgaaagcaacattgctagccgtaagtggcgtgtatcccctgagcattccagcgaccctctttgtctggtacttctggcaaaagaagaaacagcgctctggggttctgtgggacacgccttcacccccagaagtggagcgggctgtgcttgatgacggaatatatagaatcatgcagaggggtttactgggccgtagccaggtcggggtgggagttttccaagaaaacgtatttcatactatgtggcacgtgacccgcggcgccgtcctcatgtaccagggtaagcggttggagccgagttgggcaagcgtgaaaaaggacctgatttcctacgggggaggctggagactcaggggctcttggaatacaggggaggaagttcaggtgatcgccgtcgagcctggcaaaaatcccaagaatgtgcagaccgctccaggtacattcaagactcccgaaggcgaggtaggggccattgcactggattttaaacctggaacctcgggcagcccaatcgtcaaccgagaaggtaagatagtggggctttatggaaatggcgttgtgacgacatcaggcacttacgtctccgctatcgcccaagcgaaagccagtcaggaggggcccctgcctgagattgaagacgaggtgttccggaagcgcaacttgaccatcatggatctacacccgggatctggtaaaacaagaaggtatctgccagcaattgttcgggaagctatcaagcgaaagctcagaaccttaatactggcccccactcgcgtggtcgctagcgagatggcagaagcccttaaaggcatgcctattaggtaccagaccacagccgtgaagtccgagcatacggggaaagagatcgtagacctgatgtgccacgctacttttaccatgcgtctcttgtcaccagtgcgggttcccaattataacatgatcattatggatgaagcgcatttcacagacccttctagcatcgcagccagaggatacataagtaccagggtcggcatgggtgaggctgccgcaatttttatgactgccacaccgcccgggtccgtggaggctttcccacaaagcaatgcggtgatccaggatgaggaacgcgacattcctgagcgatcttggaactcaggatatgagtggatcaccgattttcccggcaagacggtctggttcgtaccatccataaaaagtggcaatgacattgccaactgtctgagaaagaatgggaagcgggtgatccagctcagcaggaaaacttttgatacagaataccagaagaccaaaaacaacgactgggactacgttgtgaccactgatatctcggagatgggagcaaatttccgcgctgaccgtgtcattgatcctagacggtgcctgaagcccgtgatccttaaagacggtccagaaagggttattctagccggcccgatgcctgtgacagtcgcatctgccgctcaacgccgagggagaataggacggaaccacaataaggagggcgatcagtatatctacatgggtcagcccctgaacaatgacgaggatcatgcccactggaccgaagcgaagatgttgttagacaacattaatacaccagaggggatcatccccgcactgttcgaacctgagagggaaaaatccgccgctgtggatggcgagtatcgcctcagaggagaggccaggaagacttttgtagaactgatgcggcgtggcgaccttccagtgtggctgagctacaaagttgcttcagaggggttccagtatagtgatcgccgatggtgctttgacggagaaagaaacaatcaagtcctcgaggaaaacatggatgtggagatttggacgaaggagggtgaaaggaaaaagttgcggccccgctggctggacgcaagaacctactctgaccctctagccctgagggagttcaaagaatttgctgccggccggcgatccgtgagcggggatctcatacttgagatcggaaagctgccgcagcacttaacacagagagcacagaatgcgttggacaacctggtcatgctccataattcagaacaaggcggtcgcgcctataggcacgctatggaggagctgccagatactattgaaacccttatgctgctcgccttgatcgcagttctgacagggggcgtgaccttattctttctaagtggacggggcctggggaagactagcattggactcctttgtgtaatggcttcctctgtgctgttgtggatggccagcgtcgagccccattggatcgcagcctccataatcctggagttctttctcatggtgctgcttattcctgagcccgaccgtcagagaacgccacaggataaccagctcgcttacgttgtgatcggtctgttgttcatgattctgaccgtcgcggccaatgagatgggcttactagaaacaactaaaaaggacctggggatcggacacgtagcagtggagaaccaccatcacgctgccatgctcgatgttgaccttcatcctgcctcagcatggaccctgtacgctgtggccacaaccataattactcccatgatgaggcacacaatcgaaaacacgaccgcgaatatttctttgactgctatcgccaaccaagcagccatactgatgggcctcgataaaggttggccaatcagtaagatggacattggggtccctctgcttgctttaggctgctatagccaggtgaatccgctgacactcaccgcagccgtcttgatgctggtggcgcattacgctatcattggacccggcctacaggccaaagcaacccgcgaggcccaaaagcggacagctgccgggatcatgaagaacccaactgttgatggaatagtggcaattgacctggatcctgtagtgtatgacgctaaatttgaaaagcagctcggccagatcatgcttctgatcttgtgtacgagccagattctgctcatgcgaaccacatgggccctgtgcgagtccatcactttagcgaccggtccccttacaaccctgtgggaggggtctccaggaaaattctggaatactacgatagccgtctcaatggcaaacatttttagaggcagctacctcgctggtgccggcctagcattctccctgatgaagagtctagggggaggcaggcgcgggacaggagctcaaggcgaaaccctgggtgagaaatggaagcggcagctcaatcagctttctaagagcgagttcaacacttataaaagatcagggatcatggaggttgaccgttccgaagccaaggagggactgaaaaggggcgagaccacaaagcacgccgtgagtcggggtactgcgaaattgcgctggtttgtcgaacgaaatctggtgaagcctgagggcaaggtaattgatctcgggtgtggaagaggcgggtggagctactattgcgctggactaaagaaggtgaccgaagttaaaggctacacaaagggtgggcccggacacgaggaaccgatcccaatggcaacgtacggctggaacctggtgaaacttcattctggcaaggacgtcttctttatacctcccgagaaatgtgataccctgctatgcgacatcggggagtcctcaccaaatcccactattgaagagggaaggacactccgggtgctgaagatggtcgaaccttggttgcgcggtaaccagttctgtatcaagattctgaatccgtatatgcccagcgtggttgagaccctcgagcaaatgcagagaaaacacggcgggatgcttgtaaggaacccactgtcgcgaaattctactcatgaaatgtactgggtgagttgcggaacaggcaacatcgtctccgccgtgaatatgaccagccggatgttactgaaccgttttacgatggctcacagaaagcctacctatgagcgcgatgttgacttgggtacagggactaggcacgtggccgtcgaacccgaggtggcaaacctcgatattatcggacagcggatagaaaatattaaacatgagcacaagtcaacctggcattacgacgaggataacccttataaaacatgggcctaccacggctcctatgaagtaaagccatctggcagcgctagttccatggtgaatggggttgtcaagctgctaactaaaccctgggacgtgatccctatggtgacccagatcgcgatgacagataccactccattcggacaacagagagtctttaaggagaaagttgacacgcgcacacccaaggccaaaaggggtaccgcacagattatggaagtgactgctcgatggctttggggcttcctgagccggaacaagaagccgagaatatgtaccagggaggaatttacacgcaaagtacgttctaatgccgcaatcggggccgtgttcgtcgacgagaaccaatggaactcagctaaggaggccgtggaagatgagcggttttgggacctcgttcatagagaaagggagctgcacaaacagggaaagtgcgcgacgtgcgtgtacaacatgatgggcaaacgcgaaaagaagttgggtgagttcgggaaagcaaagggaagtcgagccatttggtacatgtggctgggcgctcggtttctcgagttcgaagcccttggcttcatgaatgaggatcactggttttccagagaaaacagcctgtctggggtcgagggagagggtttacataaactgggctatatcttgagggacatttcgaagatccctgggggaaatatgtacgcagatgacaccgctggctgggatactcgcataacagaagacgatctccagaacgaggccaaaatcaccgacattatggaaccagagcacgctctgctagccaaggcaatcttcaaacttacttatcagaataaggtggtaagagttcaacggcccgcgaagaacggtacagtgatggatgtcatttcaaggcgtgaccagcgagggagcggacaggtgggcacctacggcctgaatacatttactaacatggaagcccagctcatccgccaaatggagtccgaggggatattcagtccttctgaactggagaccccaaacttggctgaaagagccttaaattggctggagaaatatggagtggaacggctcaagaggatggcaattagcggtgatgactgtgtcgttaaacccatcgacgatcgctttgctacggcccttaccgcactgaacgacatgggcaaggtgagaaaagatatcccgcagtgggagccttccaaggggtggaatgactggcagcaggtacccttctgctcacatcactttcaccaactaattatgaaggatggacgggagatagtggtcccatgtaggaaccaggacgaactggtgggccgagcccgtgttagtcagggtgcggggtggtctctcagagagacagcttgcttgggaaaaagctacgcccagatgtggcaactgatgtatttccatcgccgggatcttaggctggcagccaatgctatctgttccgccgtgcctgtcgactgggtgcccacttcaagaaccacatggagcattcacgcacatcaccagtggatgactaccgaagatatgctctctgtatggaaccgcgtttggatcgaggaaaatccatggatggaggacaagacgcatatttccagttgggaggatgtgccctacttaggcaaacgggaagaccagtggtgcggcagcctgatcgggttgacagctagggccacctgggcgactaacatacaagtcgctatcaatcaggtgcgaagactgattggaaacgagaattacctcgactatatgacatcgatgaagcggtttaaaaacgaatccgatcctgagggtgccctttggtga

SEQ ID NO: 13780 - RNA, 9879 nt, synthetic construct
  misc_feature 1..9879: note = derived and/or modified CDS sequence (opt3) from DENV-1__GQ868609__SS-prME
  source 1..9879: mol_type = other RNA
agcgtgaccatgctgctcatgcttatgcccaccgccctggctttccacttgactacgagaggaggggaacctcatatgatcgtaaccaagcaggaaaggggaaaatccttactgtttaagacatctgccggtgttaatatgtgcactctaattgccatggacctcggcgaactgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaggacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggtagcttcaaactggagaaggaagtggctgagacccagcacggaacggtccttgtgcagataaagtacgagggcacagacgcgccttgcaaaatcccattctcgacccaagatgaaaagggggttactcagaacggacgcttgattacagcaaatcccatcgtgaccgacaaagagaagcctgtaaacatagaagccgagccaccctttggcgagtcttatattgtcatcggtgctggggaaaaagccctgaagctctcctggttcaagaaaggctcaagtatcggaaagatgtttgaggcaactgccagaggcgctaggcggatggccattctgggggataccgcatgggacttcggaagcgtgggtggcgtttttacatccgtggggaaacttgtccatcagatcttcggaacggcgtacggcgtgctgttttctggtgtaagctggaccatgaagattgggataggcgtgttgctcacttggctgggattaaattcacgaagtacatccctgagcatgacctgtatcgctgttggcctagtcacactctacctgggggtgatggtgcaggccgattctggatgcgtcattaactggaaaggccgcgaacttaagtgtggttcagggatcttcgttactaatgaggtgcacacctggacggaacaatataagtttcaggcagacagtccgaaaagattgagcgccgctatcggaaaggcctgggaggagggcgtgtgcggtattaggtccgcaacacggctggaaaacataatgtggaaacagatctctaacgagctcaatcatattctgttagaaaacgacatgaagttcaccgtagtcgtgggcgatgttgtggggatcctggctcagggcaaaaagatgattcgccctcaacccatggagcacaaatactcgtggaaaagctggggcaaggccaagatcataggggcggacgtccagaatactacctttatcattgatggaccaaacacacctgaatgtcccgacgatcagagagcctggaatatctgggaggtggaggactatggcttcggtatttttactaccaacatctggcttaggttgcgtgattcctacacacaggtttgcgaccaccggctcatgtcagctgcaataaaggatagtaaagccgtgcatgctgacatggggtattggattgaatctgagaagaatgaaacgtggaaactggcccgagcatccttcatcgaggtaaagacctgtatttggccaaagtcccacactctatggtcaaacggagtcctggaaagcgagatgatcatacccaaaatctacggcggtcctatttctcaacataattatagaccaggctacttcacacagaccgcggggccgtggcacctcggaaagctggagcttgattttgacttgtgcgaaggcactacagtggtggtcgatgagcactgcgggaacaggggaccctccctgcgcaccacgactgttaccggcaaaatcattcatgaatggtgttgccggagttgtacattacctccactcagattcaagggtgaggacgggtgctggtacggaatggagatcaggcccgtgaaagaaaaggaggaaaatctggtaaagagcatggtgtctgccggctccggtgaggtcgactcatttagtcttggcctgttgtgtataagcattatgatcgaagaggtgatgcgctcgcgatggtcccggaaaatgctcatgaccgggactctggctgttttcctactgctcatcatgggacagctgacatggaacgatcttattcgtttgtgcatcatggtgggcgccaatgcatctgacagaatggggatgggaaccacatatctggctttaatggccacttttaagatgaggcctatgttcgcagtcggcctcctgtttcgccggcttaccagcagagaggtgctgctactcacgattggtctgtcattggttgccagtgtggaactgccaaactccttagaggaactcggggatggactggctatgggcataatgatccttaaactgttgacagacttccaatctcaccagctctgggcgaccctgctaagcctgacttttattaagaccacactttccctccattacgcctggaaaactatggcaatggtcctgtcaatcgtcagcttgttccccctgtgtttaagtaccacgtctcagaagacaacctggctcccggtgctgcttggctccctggggtgcaagcctttgactatgtttctcattacagagaataaaatctggggaagaaagagctggccactgaacgaaggtataatggctgttggcgtggtctcgatcctactgtcatctcttctcaaaaacgatgtgcccctggccgggcctttgattgccggaggcatgttaatcgcttgttatgtaattagtggttccagcgcagacctgtctctcgagaaggccgcggaggtgagctgggaagaggaagctgagcactccggggcctcacataatatcctggtcgaagttcaggatgacggaaccatgaaaataaaggatgaggagcgagacgatactcttacaattctgttgaaagcaaccctactggccgtgagtggcgtgtaccccctcagcatcccagctacgctgttcgtctggtatttttggcaaaagaagaaacagcgctctggcgtgctttgggacactccttcacccccagaagttgagcgggcagtattagatgacgggatctacagaattatgcagaggggactgctcggtcgtagccaggtgggcgtcggggtgttccaagaaaacgttttccacaccatgtggcacgtgacacgcggagccgtcttgatgtatcagggcaagcggctggagccgagttgggcgagcgtgaaaaaggacctcatatcctacggtgggggatggagactgcagggctcttggaataccggcgaggaagtacaggtcatcgctgtggagcctgggaaaaaccccaagaatgttcaaacagccccaggaacttttaagacccccgaaggtgaggtgggcgcaattgcccttgatttcaaacctgggacgtcgggaagcccaatcgtcaacagggaaggcaagattgtgggtctgtacgggaatggagttgtgacaacttcaggcacctatgtctccgctatcgcccaggcaaaagctagtcaggagggccccttgcctgagatagaagacgaggtgtttcgaaagcggaacctaacaatcatggatctgcatccggggtctggaaaaacccgcagatacctcccagccattgtaagggaagcgatcaagcggaagttacgaactctgattcttgcccccaccagagtggttgcaagcgagatggctgaagccctgaaaggtatgcctatccgctatcaaacaacggctgtcaagtccgagcacactggcaaagagatagtggacctcatgtgccatgcaaccttcacaatgaggttgctgtcaccagtgcgtgtccccaattacaacatgattatcatggatgaagcccactttaccgacccttctagcatcgccgctcgggggtatattagtactagagtaggaatgggcgaggcggcagccatcttcatgacagctaccccgcccggttccgtggaagcctttccacagagcaatgcagttatacaggatgaggaaagggacattcctgagcgctcttggaactcagggtacgagtggatcacggatttccccggaaagactgtgtggtttgtcccatccattaaaagtggcaatgacatcgccaactgtctccgaaagaatggcaagagagtgatacagctgagccggaaaacattcgataccgaatatcaaaagaccaaaaacaacgactgggactacgttgtgactacagatatttcggagatgggggctaattttagggcggaccgcgtcatcgatcctcgtagatgccttaagcccgtgatcctaaaagacggaccagaacgggtaattctggccggtccgatgcctgtgaccgttgcatctgctgcccagaggcgcggccgaatcgggagaaaccataataaggagggagatcagtacatttatatgggccagcccttgaacaatgacgaggatcacgcacactggacagaagccaagatgttactggacaacataaatactccagagggtatcattcccgctctcttcgaacctgagcgggaaaaatccgccgcgatcgatggggagtacaggctgcgcggcgaggcaagaaagacgttcgtcgaacttatgaggcggggagacctgccagtgtggctcagctataaagtggcctcagagggctttcaatacagtgatcgtcgctggtgcttcgacggggaacgaaacaatcaggtcttggaggaaaacatggatgttgagatctggaccaaggagggagaaaggaaaaagctgaggccccggtggctagacgctcgcacatattctgaccctctggccctcagagagtttaaagagttcgctgcaggtaggcggtccgtgagcggcgatcttattctggagatagggaagttaccgcagcatttgactcagcgagcccaaaatgctctggacaacctcgtaatgctgcacaattcagaacagggaggcagagcctaccgccatgcaatggaggagcttccagataccatcgaaacactgatgctcttggcgctgattgccgtgttaaccggtggggtcactctatttttcctgagtggcaggggactcggcaagacgagcatcgggcttctgtgtgtgatggcttcctctgttttgctgtggatggccagcgtggagccccactggattgcagcttccatcatactcgaatttttcctgatggtccttctcatccctgagcccgaccggcagcgtaccccacaggataaccaactggcctatgtagtgattggattgctgtttatgatcttaacagttgcagccaatgagatgggtctactggaaactaccaaaaaggacctcggcattgggcacgtggctgtcgagaaccatcaccatgcgacaatgcttgatgtggacctgcaccctgcctcagcatggaccttgtacgctgtcgccactacaatcataacgcccatgatgagacataccattgaaaacactacagccaatatctctctgaccgcaattgctaaccaggccgcgatcctcatgggactggataaaggctggccaataagtaagatggacatcggtgtgcctcttttagctctggggtgctactcgcaggttaatccgctcaccttgacagccgcagtgctgatgctagtagcccactatgctattatcggccccggactgcaagcaaaagccactagggaggcgcagaagcgcacggctgccggcattatgaagaacccaaccgtggatgggatcgtcgcaatagacctcgatcctgttgtgtacgacgccaaattcgaaaagcagcttggacagattatgctgttgatcctgtgtacaagccaaatcctcctgatgcggactacctgggctttatgcgagtccattacacttgccaccggccccctgactacgctctgggagggttctccagggaaattttggaatacaaccatcgcagtctcaatggctaacatattccgaggaagctatctagccggcgcgggtctggccttttccttgatgaagagtctgggcgggggaagaaggggcactggggcacagggagaaaccctcggcgagaaatggaagcgccagcttaatcagctgtctaagagcgagttcaacatttacaaacggtcaggtatcatggaggtggacagatccgaagctaaggaggggttgaaacgtggagagacaactaggcacgccgtaagtcggggcaccgcaaagctgcgctggttcgtggaacgaaatctcgttaaacctgagggtaaggtgattgatttaggctgtgggagaggaggctggagctattactgcgctgggctgaagaaagtcacagaagtgaagggatatacgaaaggcggtcccgggcatgaggaaccgatcccaatggccacctacggatggaaccttgtcaagctgcactctggcaaagacgtgtttttcactcctcccgagaagtgtgatacactactctgcgacataggcgagtcctcaccaaatcccaccatcgaagaggggaggactctgcgggttttgaaaatggtagaaccttggctgcgcggaaaccaattttgtattaagatcctcaatccgtacatgcccagcgtggtcgagacacttgagcagatgcagagaaagcatggtggcatgctggtgaggaacccattatcgcgaaattctacccacgaaatgtattgggttagttgcgggacgggaaacattgtgtccgccgtcaatatgaccagccggatgctgttgaaccgtttcacaatggcgcacagaaaacctacttacgagaaggatgtggacctcggcgctggtacccgccatgtagcagtggaacccgaggttgccaacctggatatcattgggcagaggatcgaaaatataaaacacgagcataagtcaacatggcactatgacgaggataacccttacaaaacttgggcttatcatggatcctacgaagtcaagccatctggcagcgccagttccatggtgaatggcgtggtcaagctacttaccaaaccctgggacgttattcctatggtgacacaaatcgcaatgaccgatactacgccatttgggcagcagcgggtattcaaggagaaagtggacacaagaacccccaaggccaaacgcggaactgctcaaatcatggaagtcaccgcgaggtggctgtggggttttctcagccgaaacaagaagccgcggatttgtacaagagaggagttcacgaggaaagtgcgctctaatgccgcaataggcgctgtttttgtggacgagaaccagtggaactcagccaaggaggcagtcgaagatgagcgtttctgggacctggtgcagaaagaacgggagttgcacaagcaggggaaatgcgcaacctgcgtatataacatgatgggaaagagagaaaagaaactgggcgagtttggtaaggctaaagggagtagggccatctggtacatgtggctcggagcgcgcttccttgagtttgaagcactgggcttcatgaatgaggatcactggttctcccgagaaaacagcttatctggcgttgagggggagggactgcataagttgggttacattctccgggacatctcgaaaattcctggcgggaatatgtatgccgatgacactgctggatgggatacaagaatcaccgaagacgatctgcaaaacgaggccaagataactgacatcatggaaccagagcacgcactacttgctacatcaatttttaaactgacctaccagaataaggtggtcagggtgcagcgccccgccaagaacggcacagtgatggatgtcatcagcagacgggaccagaggggttccgggcaagttggaacttatggcctcaataccttcacgaacatggaagctcagctgattcgtcagatggagagtgagggcatctttttgccttctgaattagagaccccaaacctggccgaacgagtgctcgattggcttgagaaatacggggtagaacgcctgaagagaatggcaataagcggagacgactgtgtggtcaaacccattgatgaccggttcgcgacagccctaactgctctgaatgatatgggtaaggtgaggaaagacatcccgcagtgggagccttccaagggctggaacgattggcaacaggttcccttttgctcacatcacttccaccagctcatcatgaaggacgggcgcgagattgtggtcccatgtagaaatcaggatgaattggtgggacgggccagggtaagtcaaggcgcaggttggtctctgcgagagaccgcttgccttgggaaaagctatgcccagatgtggcagctgatgtactttcatcgtagagacctccgcttagcagccaacgcgatatgttccgctgttcctgtggattgggtccccacatcacggactacctggagcatccacgcccatcaccaatggatgacgacagaagacatgctgtctgtgtggaatagggtttggattgaggaaaacccatggatggaggataagacccatgtgtccagttggggagacgtcccctatttgggcaaaagagaggaccagtggtgcggcagcctgatcgggctcactgcacgcgccacatgggcttcgaatattcaggtggccatcaaccaggtacggaggcttataggaaatgaaaactacctggattacatgacctccatgaagcgattcaaaaatgagggtgaccctgaaggcgcactatggtga

SEQ ID NO: 13781 - RNA, 9879 nt, synthetic construct
  misc_feature 1..9879: note = derived and/or modified CDS sequence (opt3) from DENV-1__GQ199803__SS-prME
  source 1..9879: mol_type = other RNA
agcgtgaccatgctgctcatgcttatgcccaccgcactggctttccacttgactatcagaggaggggagcctcatatgattgtctccaagcaggaaaggggaaaatctttactgtttaagacgtcagccggtgttaatatgtgcaccttaatagccatggacctcggagagctgtgtgaagatacaatgacttacaaatgcccacggatcaccgaggcggaaccggacgatgtggactgttggtgcaatgctacagatacctgggtaacttatgggacatgtagtcagaccggagagcaccgccgagacaagcgtagcgtggcccttgcaccccatgtcggcctgggtttggagacgagaactgaaacctggatgtcctctgagggggcctggaaacagattcagagggtggaaacatgggctctccggcaccctggattcactgttatcgcactgtttctggcccatgctattggcacctcgatcacacagaagggcataatcttcattctcttaatgctggtgaccccatcaatggccatgcgctgcgtcgggatcggaagcagagattttgtggagggtcttagtggcgcgacgtgggtagacgttgtgttggagcacgggtcctgtgtcactacaatggcaaaggataaacccaccctggacattgaattgctcaagactgaggtgacaaaccctgccgtgctgaggaaactttgcatcgaagctaagatatctaataccacgaccgatagccggtgtccaacacaaggagaggccactctggtcgaagaacaggacgcaaacttcgtttgccgccgaacctttgtggatagaggctggggtaatgggtgtggattgttcggcaaaggctccctcattacatgcgctaagtttaagtgcgtaactaaactggaggggaagatcgtgcagtacgaaaacttaaaatattcagtcattgtgaccgttcacacaggagaccagcatcaagtgggtaatgagagtaccgaacacggcactacggccacaatcacaccccaggcgcctactaccgagatccagctgacagactacggggccctcacccttgattgtagcccaaggactggactggacttcaacgaaatggtcttgctaacaatgaaggagaaatcttggctggtgcataagcagtggtttctcgatctgccgcttccctggacgtccggcgcatcaaccagccaagagacttggaatcggcaggacctgttggtaacattcaaaaccgctcacgccaagaagcaggaagttgtggtcctcggtagtcaagagggggctatgcacacagccctgactggcgcaaccgaaattcagacgtctggaaccacaactatatttgccggccatttaaaatgccgtctgaagatggataaactaaccctcaaggggatgtcctatgtgatgtgtacaggcagcttcaaactggagaaggaagtcgctgagactcagcacggtaccgtgcttgttcagatcaagtacgagggcacggacgcgccttgcaaaattccattctcgacacaagatgaaaagggggtgacccagaacggacgcttgatcactgcaaatcccatagtaacagacaaagagaagcctgtcaacattgaagccgagccaccctttggcgagtcttatatcgtgatcggtgctggggaaaaagccctgaagctctcctggttcaagaaaggctcaagtattggaaagatgtttgaggcaaccgccagaggcgctaggcggatggccatcctgggggatactgcatgggacttcggaagcattggtggcgtttttacctccgtggggaaacttgtccatcagatattcggaacagcgtacggcgtgctgttttctggtgtaagctggacgatgaagatcgggattggcgtgttgctcacctggctgggattaaattcacgaagtacttccctgagcatgacatgtatcgctgttggcctagtcaccctctacctgggggtgatggtgcaggccgattctggatgcgtcatcaactggaaaggccgcgaacttaagtgtggttcagggattttcgttacaaatgaggtgcacacttggaccgaacaatataagtttcaggcagacagtccgaaaagattgagcgccgctataggaaaggcctgggaggagggcgtgtgcggtatcaggtccgcaacgcggctggaaaacattatgtggaaacagatctctaacgagctcaatcatattctgttagaaaacgacatgaagctgacagtagtcgtgggcgatgttgctgggatccttggacagggcaaaaagatgatacgccctcaacccatggagtacaaatattcgtggaaaagctgggggaaggccaaaatcattggagcggacgcccagaataccactttcatcattgatggcccaaacacccctgaatgtcccgacgatcagagagcttggaatatctgggaggtggaggactacggttttgggatattcacaactaacatttggttgaagctcagggattcctatacccaggtctgcgaccaccgtctgatgtcagcagccatcaaagatagtaaggctgtgcacgccgacatgggatactggattgaatctgagaaaaatgaaacatggaagctagcacgggcgagctttatcgaggttaagacgtgtatatggccaaaatcccataccctgtggtcaaacggcgtgctcgaaagcgagatgatcattcccaagatctatggtggccctatttctcaacacaattaccgaccagggtacttcactcagacagccggaccgtggcatctgggcaaacttgagttggatttcgacctgtgcgaagggaccactgtagtcgtggatgagcactgcggaaacagaggcccctccttaaggacaaccacggtgactggtaagatcatacacgaatggtgttgccgcagttgtaccctccctccactgcggtttagaggggaggacggatgctggtatggcatggagattaggcccgtcaaagaaaaggaggaaaatcttgttaagagcatggtgtctgctggttccggcgaggtagactcattcagtctggggttgctctgtatcagcatcatgattgaagaggtgatgcgctcgcgatggtcccggaaaatgctgatgacaggaaccctagccgtctttttcctgctcatcatgggccagctgacttggaacgatcttattcgtttgtgcataatggtgggggcaaatgcttctgacagaatgggaatgggcacaacctacctggccttaatggcaacatttaagatgaggcctatgttcgccgttggtctcctgtttcgccggcttactagcagagaggtgctgctactcaccatcgggctgtcattggtcgctagtgtggaactgccatcctctttagaggaactcggagatggcctggcgatgggcattatgatccttaaactgttgacggacttccaaagccatcagctctgggccacactgctatccctgacctttattaagactgcattctcacttcactatgcttggaaaaccatggccatggttctcagcatcgtgagtctgtttcccttgtgtctgtctacaacttcccagaagaccacgtggttaccggtcctcctggggagccttggatgcaagcctctgacaatgttcttgatagccgagaacaaaatctggggtaggaagtcgtggccactcaatgaaggcattatggctgtagggatcgtgtcaattctgctatctagtctgcttaaaaacgatgttcccctcgcaggacctctgatcgccggcggtatgttgatagcgtgttacgtgatttccgggagctctgctgacttaagcctggagaaggccgcagaggtctcctgggaagaggaagccgagcattcaggagctagtcacaacatcctcgtggaagtacaggatgacggcaccatgaaaatcaaggatgaggagcgagacgatactctgacaattcttctgaaagcaaccttgctagccgtgagcggcgtctatcccctgtctataccagcgactctctttgtttggtacttctggcaaaagaagaaacagcgctccggggtgctgtgggacacaccttcacccccagaagtggagcgggctgtccttgatgacggaatctatagaattatgcagaggggtttactgggccgtagtcaggtgggggttggagtattccaagaaaatgtgtttcataccatgtggcacgtcacgcgcggcgccgtgctcatgtaccagggtaagcggttggagccgagctgggcatccgttaaaaaggacctgatctcttacgggggaggctggagactcaggggctcgtggaacactggggaggaagtgcaggtcattgccgtggagcctggcaaaaatcccaagaacgtacagaccgctccaggtacattcaagacccccgaaggcgaggtcggggccatcgcactggattttaaacctggaacaagcggctcaccaatagtgaatcgagaaggtaagatcgttgggctttatggaaacggcgtggtcactacctccggcacgtacgtgagtgctattgcccaagcgaaagcctctcaggaggggcccctgcctgagatcgaagacgaggttttccggaagcgcaatttgacaattatggatctacacccgggaagcggtaaaactagaaggtatctgccagcaatcgtgcgggaagctataaagcgaaagctcagaaccttaattctggcccccacacgcgtcgtggcttccgagatggcagaagcccttaaaggcatgcctatcaggtaccagaccactgccgtaaagtcagagcataccgggaaagagatcgtggacctgatgtgccacgctacatttacgatgcgtctcttgtctccagttcgggtccccaactataatatgattatcatggatgaagcgcatttcactgaccctagcagtatagcagccagaggatacatttccaccagggtgggcatgggtgaggctgccgcaatctttatgacagccaccccgcccgggagcgtggaggctttcccacaatctaacgcggtcattcaggatgaggaacgcgacatccctgagcgatcatggaactccggatatgagtggataactgattttcccggcaagacagtatggttcgtgccaagtattaaaagcggcaacgacatcgccaattgtctgagaaagaacgggaagcgggttatccagctctcgaggaaaacctttgatacggaataccagaagactaaaaataacgactgggactacgtggtcacaaccgatatttctgagatgggagcaaacttccgcgctgaccgtgtgatcgatcctagacggtgcctgaagcccgttattcttaaagacggtccagaaagggtgatactagccggcccgatgcctgtcaccgtggcatccgccgctcaacgccgagggagaatcggacggaatcacaacaaggagggcgatcagtatatttacatgggtcagcccctgaataacgacgaggatcatgcccactggactgaagcgaagatgttgttagacaatatcaacacaccagaggggatcattcccgcactgttcgaacctgagagggagaaaagcgccgctgtagatggcgagtatcgcctcagaggagaggccaggaagacctttgtggaactgatgcggcgtggcgaccttccagtttggctgtcatacaaagtcgctagtgaggggttccagtattctgatcgccgatggtgctttgacggagaaagaaataaccaagtgctcgaggaaaatatggatgtggagatatggacaaaggagggtgacaggaaaaagttgcggccccgctggctggacgcaagaacttactccgatcctctagccctgagggagttcaaagagtttgctgccggccggcgaagcgtctcaggggacctcatccttgaaattggaaagctgccgcagcacttaacgcagagagcacagaacgcgttggataatctggttatgctccataacagtgagcaaggcggtcgcgcctataggcacgctatggaagaactgccagacaccatcgagacacttatgctgctcgccttgattgcagtgctgactgggggcgtaaccttattctttctaagcggacggggcctggggaagacatccatcggactcctttgtgtgatggcttctagcgtcctgttgtggatggcctccgtggaaccccattggatagcagcctcaatcattctggagttctttctcatggttctgcttatccctgaacccgatcgtcagagaaccccacaggacaatcagctcgcttacgtggtcattggtctgttgttcatgatcctgactgtagcggccaacgagatgggcttactagagacgaccaaaaaggatctggggataggacacgtggcagttgaaaatcaccatcacgctgccatgctcgacgtggatcttcatcctgcctctgcatggacactgtacgctgtcgccactaccattatcacacccatgatgaggcacaccattgagaacactacagcgaacatcagtttgacggctatagccaatcaagcagccatcctgatgggcctcgacaaaggttggccaatttcgaagatggatatcggggtgcctctgcttgctttaggctgctatagccaggtcaacccgctgaccctcactgcagccgtgttgatgctggttgcgcattacgctattatcggacccggcctacaggccaaagcaacacgcgaagcccaaaagcggaccgctgccgggataatgaagaatccaaccgtggacggaattgtagcaatcgatctggaccctgtggtctatgacgctaaatttgagaagcagctcggccagatcatgcttctgattttgtgtacatcccagatcctgctcatgcgaactacgtgggccctgtgcgaatctataaccttagcgacaggtccccttactaccctgtgggaggggtcaccaggaaaattctggaacacaaccattgccgttagcatggcaaatatctttagaggctcctacctcgctggtgccggcctagcattcagtctgatgaagtctctagggggaggcaggcgcgggactggagctcaaggcgagacgctgggtgaaaaatggaagcggcagctcaaccagcttagcaagtcagagttcaatacatataaaagatccgggattatggaagtggatcgtagtgaggccaaggaaggactgaaaaggggcgagaccactaagcacgccgtcagccggggtaccgcgaaattgcgctggtttgtggagcgaaacctggtaaagcctgaaggcaaggtgatcgacctcgggtgtggaagaggcgggtggtcttactattgcgctggactaaagaaggttacagaggtgaaaggctacactaagggtgggcccggacacgaagaaccgataccaatggcaacctacggctggaatctggtcaaacttcattccggcaaggatgtgttctttatccctcccgaaaaatgtgacacactgctatgcgatattggggagtcaagcccaaaccccacgatcgaggaaggaaggaccctccgggtcctgaagatggtggagccttggttgcgcggtaatcagttctgtattaagatcctgaacccgtatatgccctcggttgtagaaactctcgagcaaatgcagagaaaacacggcgggatgcttgtgaggaatccactgtctcgaaacagtacacatgagatgtactgggtctcctgcggaaccggcaatattgtgagcgccgttaacatgacttcacggatgttactgaatcgttttacaatggctcacagaaagcctacctatgaacgcgacgtggatttgggtacggggaccaggcacgtcgccgtggagcccgaagtagcaaacctcgacatcataggacagcggattgagaacatcaaacatgaacacaagtccacatggcattacgatgaggacaatccttataaaacttgggcctaccacggctcttatgaggtgaagccaagcggcagtgcttccagcatggttaacggggtcgtgaagctgctaaccaaaccctgggatgtgatccctatggtcacacagattgcgatgactgacaccacaccattcggacaacagagagtttttaaggaaaaagtggacacccgcactcccaaggccaaaaggggtacggcacagataatggaggtaacagctcgatggctttggggcttcctgtctcggaataagaagccgagaatctgtaccagggaagagtttactcgcaaagtgcgttcaaacgccgcaattggggccgtcttcgtggatgaaaatcaatggaacagtgctaaggaggccgttgaggacgaacggttttgggatctcgtgcatagagagagggaactgcacaaacagggaaagtgcgcgacctgcgtctacaatatgatgggcaaacgcgagaagaagttgggtgagttcgggaaagcaaagggatcccgagccatctggtacatgtggctgggcgctcggtttctcgagttcgaggcccttggcttcatgaacgaagaccactggtttagcagagaaaattctctgtcgggggtggaaggagagggtttacataaactgggctatattttgagggatatctcaaagatacctgggggaaacatgtacgcagacgatacagctggctgggacacgcgcatcaccgaggatgacctccagaatgaagccaaaattactgatatcatggagccagaacacgctctgctagccaaggcaattttcaaacttacatatcagaacaaggtagttagagtgcaacggcccgcgaagaatggtaccgtcatggacgtgatcagcaggcgtgatcagcgagggtccggacaggtgggcacttacggcctgaacacatttaccaatatggaggcccagctcatacgccaaatggaaagtgaggggattttctctcctagcgagctggaaacaccaaacttggctgagagagccttagactggctggaaaaatatggagtcgagcggctcaagaggatggcaatctccggtgacgattgtgttgtgaaacccatcgacgatcgctttgctactgcccttaccgcactgaacgacatgggcaaggtaagaaaagatattccgcagtgggaaccttcaaaggggtggaatgactggcaacaggtgcccttctgcagtcatcactttcaccaactaataatgaaggatggacgggagatcgtcgtgccatgtaggaaccaggacgagctggttggccgagcccgtgtgtctcagggtgcggggtggagcctcagagaaacggcttgcttgggaaaatcctacgcccagatgtggcaactgatgtatttccatcgccgggatcttaggctggcagccaatgctatttgttcagccgtccctgtggactgggtacccaccagcagaacaacttggtctatccacgcacatcaccagtggatgaccacagaggatatgctctccgtttggaaccgcgtgtggattgaagagaatccatggatggaagacaagactcatatcagtagctgggaggacgtcccctacttaggcaaacgggaggatcagtggtgcggctcgctgatagggttgaccgctagggccacgtgggcgacaaacatccaagtggctattaatcaggttcgaagactgatcggaaacgaaaattacctcgactatatgacctccatgaagcggtttaaaaacgagtctgatcctgaaggtgccctttggtga

SEQ ID NO: 13782 - RNA, 9879 nt, synthetic construct
  misc_feature 1..9879: note = derived and/or modified CDS sequence (opt3) from DENV-1__GQ199804__SS-prME
  source 1..9879: mol_type = other RNA
agcgtgaccatgctgctcatgcttatgcccacagccctggctttccacttgactacgagaggaggggagcctcatatgatcgtctccaagcaggaaagaggaaaatctttactgtttaagacctcagccggtgttaatatgtgcacactaattgccatggacctcggcgagctgtgtgaagatactatgacctacaaatgcccacggataacagagaccgaaccggacgatgtggactgttggtgcaatgcgactgatacatgggtgacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgtgatcggcacctcgattacgcagaagggcatcatattcatcctcttaatgctggtcactccatcaatggccatgcgctgcgtggggattggaagcagagattttgtagagggtcttagtggcgctacatgggttgacgtggtcttggagcacgggtcctgtgtgaccactatggccaaggataaacccacactggacatcgaactactcaagaccgaggtgacgaaccctgcggtcctgaggaaactttgcattgaagcaaagatctctaataccacaactgatagccggtgtccaacccaaggagacgccacactggttgaggaacaggatgctaacttcgtgtgccgccgaacttttgtagacagaggctggggtaatgggtgtggattgttcggcaaaggctccctcataacctgcgccaagtttaagtgcgtgacaaaactggaggggaagattgtccagtacgagaacttaaaatattcagtgatcgttaccgtgcacactggagaccagcatcaagtcggtaatgaaagtacggagcacggcacaaccgcaactattacaccccaagctcctaccaccgaaatccagctgactgattacggggccctcacacttgactgtagcccaaggacgggactggatttcaacgagatggtgttgctaaccatgaaggaaaaatcttggctggtacataagcagtggtttctcgacctgccgcttccctggacttccggcgcgtcaacaagccaagagacctggaatcggcaggatctgttggttacattcaaaactgcccacgcaaagaagcaggaggtggtcgtgctcggtagtcaagaaggggctatgcacaccgccctgacgggcgctaccgagatccagacatctggaactaccacaatttttgccggccatttaaaatgccgtctgaagatggacaaactaactctcaaggggatgtcctatgtcatgtgtaccgggagcttcaaactggaaaaggaggtggcagaaacgcagcacggtacagttcttgtgcagataaagtacgagggcaccgatgccccttgcaaaatcccattctcgactcaagacgagaagggggtaacacagaacggacgcttgattaccgctaatcccatcgtcactgataaagaaaagcctgtgaacatagaggcggaaccaccctttggcgagtcttatattatcatcggtgcaggggagaaagccctgaagctctcctggttcaagaaaggctcaagtattggaaagatgtttgaagctaccgccagaggcgcaaggcggatggccatcctgggggacacagcttgggatttcggaagcattggtggcgtttttacgtccgtggggaaacttgtccatcagatattcggaaccgcctacggcgtgctgttttctggtgtaagctggactatgaagatcgggattggcgtgttgctcacatggctgggattaaattcacgaagtacctccctgagcatgacatgtatcgcagttggcctagtcactctctacctgggggtgatggtgcaggcggactctggatgcgtcatcaactggaaaggccgcgagcttaagtgtggttcagggattttcgttaccaatgaagtgcacacgtggacagagcaatataagtttcaggctgacagtccgaaaagattgagcgccgcaataggaaaggcctgggaagagggcgtgtgcggtatcaggtccgctacccggctggagaacattatgtggaaacagatctctaacgaactcaatcatattctgttagagaacgatatgaagttcactgtagtcgtgggcgacgttgccgggatcctggcacagggcaaaaagatgatacgccctcaacccatggaatacaaatattcgtggaagtcctggggcaaggctaaaatcattggggccgatgtgcagaataccacatttatcattgacggaccaaacactcctgagtgtcccgatgaccagagagcgtggaatatctgggaagtcgaggattacggcttcggtatatttaccacaaacatttggcttaagttgagggactcctatacgcaagtgtgcgatcaccgtctcatgtcagccgctatcaaagacagtaaggcagttcacgccgatatggggtactggattgagtctgagaaaaatgagacctggaagctggctcgggccagcttcatcgaagtgaagacttgtatatggccaaaatcccatacactatggtcaaacggagtactggagagcgaaatgatcattcccaagatctatggcggtcctatttctcaacacaattaccgaccaggctacttcacccagactgcagggccgtggcatctcggaaaactggagcttgactttgatttgtgcgagggcacaaccgtcgtggtggacgaacactgcgggaacagaggaccctccctgaggacgactaccgtcacaggcaagatcatacacgagtggtgttgccgcagttgtaccttacctccactccggttcagaggtgaagacgggtgctggtatggaatggagattaggcccgttaaagagaaggaagagaatctggtaaagagcatggtatctgcgggctccggtgaagtggattcatttagtcttggcctgttgtgtatcagcatcatgattgaggaagtcatgcgctcgcgatggtcccggaaaatgctcatgactgggacactggccgtgttctttctactgatcatgggacagctcacctggaacgacctgattcgtctttgcataatggttggcgctaatgcctctgatagaatggggatgggaacaacttacttggcactgatggctaccttcaagatgaggcctatgtttgccgtgggcttactcttccgccggctgacgagcagagaggtccttctgctaacaatcggtctctcactggtggcaagtgttgagttgccaaactccctggaagagttaggggacggactcgccatgggcattatgatcctgaaacttctgaccgattttcaatctcatcagttgtgggctactctcctgagcctaaccttcattaagacaactttttccctgcactatgcgtggaaaaccatggccatggtgctttcaatcgtcagcctcttccccctgtgtttgagtacgacatctcagaagaccacttggctgccggtattactcggctccctggggtgcaagcctcttacaatgtttctgatagcagaaaataaaatctggggaaggcgaagctggccattgaacgagggtattatggctgtgggcatcgtttcgattctcctgtcatctctactgaagaacgacgtgccccttgccgggcctctcatcgccggaggcatgctgatagcttgttacgtcattagtggttccagcgcagatttgtctttagaaaaagccgcggaggtgagctgggaggaagaggctgaacattccggggcctcacacaatatcctggtagaggtgcaggacgatggaaccatgaagatcaaagacgaagaacgcgatgacactctcacaattctgcttaaggcaaccctgttggccgtcagtggcgtttatcccctaagcataccagctacgctgttcgtgtggtacttctggcagaaaaagaagcagcggtctggcgtgctctgggatactccttcacccccagaggtcgaaagagcagtgctggacgacgggatctataggattatgcagcgtggacttttaggtcgcagccaggttggcgtaggggtgtttcaagagaacgtcttccataccatgtggcacgtgacacggggagccgttctgatgtaccagggcaaaagactcgaaccgagttgggcgagcgtgaagaaagatttgatctcctacggtgggggatggaggctgcagggctcttggaataccggcgaggaggtccaggtgattgctgtagaacctgggaagaaccccaaaaatgtccaaacagccccaggaacttttaagacccccgagggtgaagtgggcgcaatcgccctcgacttcaagcctgggacgtcgggaagcccaatagttaaccgagagggcaaaatcgtgggtctgtatgggaatggagtcgtgacaacttcaggcacctacgtttccgctattgcccaggcaaaggctagtcaggaaggcccccttcctgagatcgaggatgaagtgtttcggaaacgcaacctgacaattatggacttgcacccggggtctggaaagaccagaaggtatctaccagccatcgtccgggaggcgataaaacgaaagctgagaactctcattttagcccccacccgcgtggtagcaagcgaaatggctgaggccctgaagggtatgcctatcaggtaccaaacaacggctgtgaaatccgaacatactggcaaggagatcgttgatcttatgtgccacgcaaccttcacaatgcgtctgctctcaccagtccgggtgcccaattataacatgattatcatggacgaggcccattttaccgatccttctagcatagccgctagagggtacattagtactagggtgggaatgggcgaagcggcagccatcttcatgacagctaccccgcccggttccgtcgaggcctttccacagagcaatgcagtaattcaggacgaagaacgcgatatccctgaacgatcttggaactcagggtatgagtggataacggacttccccggaaaaactgtgtggtttgttccatccattaagagtggcaatgatatcgccaactgtttgaggaaaaatggcaagcgggtgatccagctgagcaggaagacattcgacaccgagtaccagaaaaccaagaacaacgactgggattacgtcgtgactacagacatttcggaaatgggggctaatttccgcgcggatcgtgttatcgaccctagacggtgcctcaaacccgtgattctgaaggatggaccagagagggtcatacttgccggtccgatgcctgtgaccgtagcatctgctgcccagcgccgaggcagaatcgggcggaaccacaataaagaaggagaccagtatatttacatgggccagcccctaaacaatgatgaggaccatgcacactggacagaggccaagatgctgttggataacatcaatactccagaaggtatcattcccgctttatttgagcctgaaagggagaagtccgccgcgatagacggggaatatcgcctgagaggcgaggcaaggaaaacgttcgtggagctcatgcggcgtggagatctgccagtttggcttagctacaaggtcgcctcagaaggctttcaatatagtgaccgccgatggtgcttcgatggggagagaaacaatcaggtgctggaagagaacatggacgtggaaatctggaccaaagagggagagaggaagaaactccggccccgctggttggacgctagaacatactctgatcctctggccctaagggaatttaaggagttcgctgcaggtcggcgatccgtcagcggcgacctgattctcgaaatcgggaaacttccgcagcacctgactcagagagcccaaaatgctttagataacttggttatgctgcataattcagagcagggaggccgcgcctataggcacgcaatggaggaactcccagacaccattgagacactgatgcttctggcgctcatcgccgtgttgaccggtggggtaactctgtttttcttaagtggccggggactaggcaagacgagcatagggctgctctgtgtgatggcttcctctgtccttctgtggatggccagcgtggaaccccattggatcgcagcttccattatcttggagtttttcctgatggttctcctgattcctgaacccgatcgtcagagaaccccacaggacaaccaacttgcctacgtggtcatcggactcctgtttatgatattgacagtagcagccaatgagatgggtctgttagagactaccaagaaagatctaggcattgggcacgtggctgttgaaaaccaccatcacgcggccatgctggacgtggatctccatcctgcatcagcttggacactttacgccgtcgccaccactatcattacacccatgatgaggcacacgatcgagaacaccactgcaaatatatctctgacagctatcgccaaccaggcggctattttgatgggactggacaagggctggccaatcagtaaaatggatattggtgtgcctctcctggcccttgggtgctattcgcaggtcaatccgttaaccctgaccgcagccgtgctcatgttggttgctcattacgcaatcataggccccggactgcaagccaaggcgacacgcgaagctcagaaacggactgccgcaggcattatgaagaacccaacggtggacgggatcgtagccatcgatctagaccctgtggtctatgacgctaagttcgagaaacagctgggacagattatgctccttatcctgtgtaccagccaaatattgctgatgcgaacaacttgggccctctgcgaatccattaccctggcaacaggccccttaaccactctttgggagggttctccagggaagttttggaatacgacaatcgctgtttcaatggccaacattttcagaggaagctacctggcgggcgccggtctcgcattctccctaatgaaaagtctgggcgggggaaggcgcggcaccggggctcagggagagactttgggcgaaaagtggaaacggcagctgaatcagctctctaagagcgagtttaacacctataagagatcaggtatcatggaagtggatcgttccgaggccaaagaagggcttaagaggggagagacaactaaacacgcagtcagtcggggcaccgctaagctgcgctggttcgtggagcgaaatttggtaaaacctgaaggtaaggtgatagacctgggctgtgggagaggaggctggagctactattgcgccgggctcaagaaagttacagaggtgaagggatacacgaaaggcggtcccgggcacgaggagccgatcccaatggccacctacggatggaacttagtcaagctgcattctggcaaagatgtgtttttcattcctcccgaaaagtgtgacactcttctgtgcgatatcggcgagtcctcaccaaatcccacaattgaggaagggaggaccctacgggtcctcaaaatggtggagccttggctgcgcggaaaccaattttgtatcaagattttgaatccgtatatgcccagcgttgtagaaactctggagcagatgcagagaaagcacggtggcatgctcgtgaggaacccactttcgcgaaattctacacatgagatgtactgggtcagttgcgggaccggaaacatcgtgtccgcggttaatatgacgagccggatgctgttaaaccgtttcaccatggctcacagaaaacctacatatgaacgcgacgtggatctgggcgcaggtactaggcacgtcgccgtggagcccgaagtagctaacttggacataattgggcagcggatcgagaatatcaagcatgaacacaaatcaacctggcattacgatgaggacaacccttataagacatgggcctaccacggatcctatgaggtgaaaccatctggcagcgcaagttccatggttaatggcgtcgtgaagctcctgactaagccctgggatgtgattcctatggtcacccaaatagccatgacagacaccactccatttgggcagcagagagttttcaaagaaaaggtggacacgcgcacacccaaagctaagaggggaaccgcgcaaatcatggaggtaactgccaaatggctatggggttttcttagccgaaacaagaagccgcggatttgtaccagagaagagttcacaaggaaagtgcgctctaatgcagctatcggcgccgtctttgtggatgaaaaccagtggaactcagcaaaggaggccgttgaggacgaacgtttctgggatctggtgcatcgggagagagaactccacaaacaggggaagtgcgctacgtgcgtctacaacatgatgggaaaaagggagaagaagctgggcgaatttggtaaagccaaggggagtcgcgcgatttggtacatgtggttgggagcacgattcctggagttcgaggccctcggctttatgaatgaagaccactggttctcccgggagaacagcctttctggcgtggaaggggagggactgcataaattaggttatatcctgagagatatatcgaagatccctggcgggaatatgtacgctgacgataccgccggatgggacactaggattacagaggatgacttgcagaacgaagcacgcatcaccgatattatggagccagaacacgctctcctggccaaatcaatctttaagctaacttatcaaaataaagtagttagagtgcagcggcccgctaagaacggcacagtcatggacgtgataagcaggcgtgatcagcgaggttccggacaggtgggaacctacggccttaatacattcactaacatggaggcccaactgattcgccagatggaaagtgagggcatcttttctcctagcgagctcgaaaccccaaacctggcagagagagtcttggactggttagaaaagtatggggttgagcggctgaaaaggatggcgatctccggagacgattgtgtggtaaagcccattgacgatcgcttcgccacggctctcaccgcccttaatgacatgggtaaagtgagaaaggatataccgcagtgggaaccttcaaaaggctggaacgactggcagcaagtccccttttgcagtcatcacttccaccagctgatcatgaaggatgggcgggagattgtggttccatgtaggaatcaggacgagctagtgggacgagcacgtgtctctcagggcgctggttggagcctgagagaaacagcctgcctcgggaagtcctacgcacaaatgtggcagttgatgtattttcatcgccgggatctgaggcttgccgcgaacgctatctgttcagccgtgcctgtagactggattcccactagcagaaccacatggtctatccacgcacatcaccagtggatgactaccgaggatatgctgtccgtttggaatcgcgtgtggatagaagagaacccatggatggaagacaaaacgcatatcagtagctggggagacgtcccctacctcggcaagcgggaggatcaatggtgcggctcgttaattgggctgacagccagggctacctgggccactaatatccaggtggcaattaaccaggttcgaagattgatcggaaatgagaactacctggactatatgacatccatgaaacggttcaagaatgaatctgatcctgagggtgctctctggtga

SEQ ID NO: 13783 - RNA, 9879 nt, synthetic construct
  misc_feature 1..9879: note = derived and/or modified CDS sequence (opt3) from DENV-1__GQ199805__SS-prME
  source 1..9879: mol_type = other RNA
agcgtgaccatgctgctcatgcttatgcccaccgccctggctttccacttgactacgaggggaggggaacctcatatgatcgtcaccaagcaggaaaggggaaaatccttactgtttaagacatctgctggtgttaatatgtgcactctgattgccatggacctcggcgaactgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgctccccatgtcggcctgggtttggagaccagaacagaaacttggatgagctccgagggggcctggaaacagatccagagggtggaaacctgggctctccggcaccctggattcacagttattgcactgtttctggcccatgtgatcggcacctctattacgcagaagggcatcattttcatcctcttaatgctggtcactccatcgatggctatgcgctgcgtggggattggatcaagagattttgtagagggtcttagcggcgccacatgggttgacgtggtcttggagcacgggagttgtgtgaccactatggcgaaggataaacccacactggacatcgaactactcaagaccgaggtgacgaaccctgcagtcctgaggaaactttgcattgaagccaagatctccaataccacaactgattctcggtgtccaacccaaggagaggctacactgatggaagaacaagacgccaacttcgtttgccgccgaacttttgtggatagaggctggggtaatgggtgtggattgttcggcaaaggcagcctcataacctgcgcaaagtttaagtgcgtaacaaaactggaggggaagattgtgcagtacgaaaacttaaaatattccgtcatcgtgaccgttcacactggagaccagcatcaagtgggtaatgagtcaacggaacacggcacaaccgctactattacaccccaggcccctacaagtgagatccagctgaccgactacggggcgctcactcttgattgtagcccaaggacaggactggacttcaacgaaatggtcttgctaacgatgaaggagaaatcttggctggtgcataagcagtggtttctcgatctgccgcttccctggacctccggcgcctcaactagccaagagacatggaatcggcaggacctgttggtaaccttcaaaacagcacacgctaagaagcaggaagttgtggtcctcggtagtcaagagggggccatgcacactgctctgaccggcgccacggaaatccagacctctggaacaactaccatttttgcaggccatttaaaatgccgtctgaagatggataaactaacactcaaggggatgtcctatgtgatgtgtactggtagcttcaaactggagaaggaagtcgccgagacccagcacggaacggtgcttgttcagataaagtacgagggcacagacgctccttgcaaaatcccattctcgacccaagatgaaaagggggtgactcagaacggacgcttgattacagcgaatcccatcgtaaccgacaaagagaagcctgtcaacatagaagcagagccaccctttggcgagtcttatattgtgatcggtgccggggaaaaagctctgaagctctcctggttcaagaaaggctcaagtatcggaaagatgtttgaggccactgcaagaggcgccaggcggatggctattctgggggataccgcctgggacttcggaagcatcggtggcgtttttacatccgtggggaaacttgtccatcagattttcggaacggcatacggcgtgctgttttctggtgtaagctggaccatgaagatagggttgggcgtgctcctgacttggttaggactaaattcacgaagtacatccctaagcatgacctgtatcgcggttggcctcgtcacactgtaccttggggtgatggtgcaggctgattctggatgcgtcattaactggaaaggccgcgaattgaagtgtggttcagggatcttcgttactaatgaggtgcacacctggacggaacaatataagtttcaggccgacagtccgaaaagactgagcgcagccatcggaaaggcttgggaggagggcgtgtgcggtattaggtccgccacacggctcgaaaacataatgtggaaacagatctctaacgagctgaatcatattttactggaaaacgacatgaagttcaccgtagtcgtgggcgatgttgtggggatccttgcacagggcaagaagatgattcgccctcaacccatggagcacaaatactcgtggaaaagctggggcaaggctaagatcataggggccgacgtccagaatactacctttatcattgatggaccaaacacacctgaatgtcccgacgatcagagagcgtggaatatctgggaggtggaggactatggcttcggtatttttactaccaacatctggttgaagctcagggattcccacacacaggtttgcgaccatcgtctgatgtcagccgctataaaagatagtaaggcagtgcacgccgacatggggtactggattgaatctgagaaaaatgaaacgtggaagctagctcgggccagcttcatcgaggtaaagacctgtatttggccaaaatcccatactctgtggtcaaacggagtcctcgaaagcgagatgatcatacccaagatctatggcggtcctatttctcaacacaattaccgaccaggctatttcacacagaccgcagggccgtggcacctgggaaaacttgagttggattttgacctgtgcgaaggcactacagtggtggtcgatgagcattgcgggaacagaggaccctccttaaggaccacgactgttaccggcaagatcattcacgaatggtgttgccgcagttgtacactccctccactgcggttcaaaggtgaggacgggtgctggtacggaatggagatcagacccgtgaaggaaaaggaggaaaatcttgtaaaaagcatggtgtctgcgggctccggtgaggtcgactcatttagtctgggcttgctctgtataagcattatgatcgaagaggtgatgaggtcgcgctggtcccgaaagatgctgatgaccgggactctagccgttttcctgctcctgatcatgggacagcttacatggaacgatttgacccggctgtgcattatggtgggcgctaatgcctctgaccgtatggggatgggaacaacttacttagcactcatggctacctttaaaatgagacctatgttcgccgtcggcctgctttttaggcgcctgacgagccgggaggtgctactcctgacaatcggtttgtcactggttgcaagtgtggaattaccaaactccctcgaggaactgggggatggacttgccatgggcattatgatactgaagttgctcaccgacttccaatctcatcagctgtgggctactctactgagccttacctttatcaaaacaactctctccctgcactatgcgtggaagaccatggccatggtcttgtcaattgtaagcctgttccccttatgtctcagtacgacatctcagaagaccacttggctgccggtgcttctgggctccttggggtgcaaacctctcgcaatgtttctgatcgctgagaataagatttggggaagaaaaagctggccactaaacgaaggtatcatggccgttggcgtggtctcgatactgctttcatctctcctgaagaacgatgtgcccttggccgggcctttaatcgctggaggcatgctgattgcatgttacgtaatcagtggttccagcgccgacctctctctggagaaagcggctgaggtgagctgggaagaggaagccgagcattccggggcatcacacaatattcttgtcgaagttcaggatgacggaacaatgaagatcaaagatgaggagagggacgataccctgactatattgctaaaggccacactgctcgctgtgagtggcgtgtatcccctgagcattccagcaacccttttcgtctggtacttttggcaaaagaaaaagcagcgatctggcgtgttatgggacacgccttcacccccagaagttgagcgcgccgtactggatgacgggatctatcggatcatgcagagaggactcttgggtaggagccaggtgggcgtcggggtgttccaagaaaacgttttccacactatgtggcatgtgacccgtggagcggtcctgatgtaccagggcaaacgcctcgagccgagttgggctagcgtgaagaaagacctgatttcctatggtgggggatggcggcttcagggctcttggaatacaggcgaggaagtacaggtcatagccgtggagcctgggaagaaccccaagaatgttcaaaccgcaccaggaacatttaaaactcccgaaggtgaggtgggcgccatcgctctggatttcaagcctgggacctcgggaagcccaattgtcaacagagaaggcaaaatcgtgggtttgtacgggaatggagttgtgacgacatcaggcacttacgtctccgccattgcacaggctaaggccagtcaggagggccccctacctgagatcgaagacgaggtgtttaggaaacgaaacctgaccataatggatctccacccggggtctggaaagacacggcgctatttaccagcgatcgtaagagaagccattaagaggaaactgcggacccttatcctggcacccactcgagtggttgctagcgagatggccgaagctctcaagggtatgcctattagataccaaaccacagcagtcaaatccgagcatacgggcaaggagatcgtggacttgatgtgccacgccactttcaccatgcgcctgctctcaccagtgagggtccccaattataacatgataattatggatgaagcccattttacagacccttctagcatcgctgcgcgtgggtacatcagtacccgggtaggaatgggcgaggcagccgctattttcatgactgccacaccgcccggttccgtggaagcatttccacagagcaatgccgttatccaggatgaggaaagagacatacctgagaggtcttggaactcagggtatgagtggattaccgatttccccggaaaaacggtgtggtttgtcccatccatcaagagtggcaatgacattgctaactgtctgcgcaagaatggcaaacgagtgatccagcttagcagaaagactttcgatacagaataccagaaaaccaagaacaacgactgggactatgttgtgaccactgatatatcggagatgggggcgaattttcgggccgacagggtcattgatcctcgccgttgcctaaaacccgtgatcctgaaggacggaccagaaagagtaatcttggcaggtccgatgcctgtgacagttgcttctgccgcacagcggaggggccgcattgggcgaaaccacaataaggagggagatcagtacatctacatgggccagcccttaaacaatgacgaggatcacgcccattggaccgaagctaaaatgctgctcgacaacattaatacaccagagggtataatccccgccctgttcgaacctgagagagaaaagtccgcggcaattgatggggagtatcggcttaggggcgaggcccgcaaaactttcgtcgaactgatgagaaggggagacctcccagtgtggttgagctacaaggtggcttcagagggctttcaatatagtgatcggcgttggtgcttcgacggggaacgcaacaatcaggtcctggaggaaaacatggatgttgagatctggacgaaagagggagaacgaaagaaactaagacccaggtggctggacgcccggacctactctgaccctctcgcacttcgcgagtttaaggagttcgcagccggtagaaggtccgtgagcggcgatctgatcttagagattgggaagttgccgcagcacctgacacagcgggctcaaaatgccctcgacaacctggtaatgcttcataattcagaacagggaggccgagcatatagacacgcgatggaggagctgccagatactatagaaaccctcatgttgctggccttaatcgctgtgctaacaggtggggtcaccctgtttttcctcagtggccgcggacttggcaaaactagcattgggctgttgtgtgtgatggcctcctctgttctgctctggatggcaagcgtggagccccactggatcgctgcctccattatcctggaatttttccttatggtcctcctgatacctgagcccgacaggcagcggacgccacaggataaccaattggcatacgtagtgatcggactgttatttatgattctaaccgttgccgctaatgagatgggtctgctcgaaacaactaagaaagaccttggcatcgggcatgtggcggtcgagaaccaccatcacgccaccatgctggatgtggacttgcatcctgcatcagcttggacactgtatgccgtcgccaccactattatcacacccatgatgcgtcacacgatagaaaacaccactgcaaatatttctctcacagctatcgccaaccaggcggctattctgatgggacttgataagggctggccaatcagtaaaatggacataggtgtgcctttactggccctcgggtgctactcgcaggttaatccgttgaccctgaccgcagccgtgctaatgctggtagctcactacgcaatcattggccccggactccaagccaaggcgacaagagaggctcagaagaggactgccgcaggcatcatgaaaaacccaacggtggatgggattgtcgccatcgaccttgatcctgttgtgtatgacgctaagttcgaaaaacagctgggacagataatgttgctgattctctgtaccagccaaatcctgttaatgcgcacaacttgggccctttgcgagtccatcaccctggcaacaggccccctcaccactctatgggagggttctccagggaagttttggaatacgacaattgctgtctcaatggccaacatcttccggggaagctacctggcgggcgccggtttggcattttccctgatgaaaagtctcggcgggggacgaagaggcaccggggctcagggagaaactcttggcgagaagtggaagaggcagctgaatcagttgtctaaaagcgagttcaacatatataagcgctcaggtattatggaggtggaccggtccgaagccaaagaggggctgaagagaggagagaccacacgtcatgcagtaagtaggggcactgctaaactccggtggttcgtggaacgcaatttagttaagcctgagggtaaggtgatcgatctgggctgtgggcgaggaggctggagctactattgcgccgggcttaaaaaggtcaccgaagtgaaaggatacacaaagggcggtcccgggcacgaggaaccgattccaatggccacgtatggatggaacctggtcaaactacattctggcaaggacgtgtttttcacccctcccgagaaatgtgatactctcctgtgcgacatcggcgagtcctcaccaaatcccacaatagaagaggggagaaccttgagggttctgaagatggtagaaccttggctccggggaaaccaattttgtatcaagattcttaatccgtacatgcccagcgtggtcgagactctggagcagatgcagcgcaaacacggtggcatgttagtgagaaacccactgtcgagaaattctacacacgaaatgtactgggttagttgcgggaccggaaacatcgtgtccgcggtcaatatgacgagccgaatgttgctcaaccggttcaccatggctcatcgtaagcctacatatgagagagatgtggacctgggcgcaggtactcgccacgtagccgtggaacccgaggttgctaacctagatattatcgggcagaggattgaaaatatcaaacatgagcacaagtcaacctggcattacgacgaggataacccttataaaacatgggcctaccacggatcctatgaagtcaagccatctggcagcgcaagttccatggtgaatggcgtggtcaaacttctgactaaaccctgggacgttatacctatggtgacccaaattgccatgacagataccactccatttgggcagcagcgggtattcaaggagaaagtggacacgagaacacccaaggctaaacgcggaaccgcgcaaatcatggaagtcactgccaggtggctctggggttttctgagccgaaacaagaagccgcggatctgtaccagagaggagttcacaaggaaagtgcgctctaatgcagctattggcgccgtttttgtggacgagaaccagtggaactcagcaaaggaggccgtcgaagatgagcgtttctgggacttggtgcagaaagaacgggagctgcacaagcaggggaaatgcgctacgtgcgtatacaacatgatgggaaagagagaaaagaaactcggcgagtttggtaaggccaaagggagtagggcgatatggtatatgtggcttggagcacgcttcctggagtttgaagccttaggcttcatgaatgaggatcattggttctcccgagaaaacagcctgtctggcgttgagggggagggattgcacaagctcggttacatcctgcgggacatttcgaaaatccctggcgggaatatgtacgctgatgacaccgccggatgggatactagaattacagaagacgatctacaaaacgaggcaaggatcaccgacataatggaaccagagcatgcacttctggccacttcaatctttaagctcacatatcagaataaagtggtccgcgtgcagagacccgctaagaacggcaccgtgatggatgtcattagccggagggaccagcgtggttccgggcaagttggaacatacggcctgaatactttcaccaacatggaagcccagttgatccgacagatggagagtgagggcatatttttaccttctgaactggagacgcagaacctcgcagaacgcgtgcttgattggctggagaagtatggggtagaaagactaaaacggatggcgatcagcggagacgactgtgtggtcaagccaatagatgacaggttcgccaccgctctgacagccctcaatgatatgggtaaagtgcgcaaggacattccccaatgggagccgtccaaaggctggaacgattggcagcaggttcctttttgctcacaccacttccatcagttgatcatgaaggacgggagagagatcgtggtcccctgtcggaatcaagatgaactggtgggaagggcacgagtaagtcagggcgctggttggtctcttcgtgagactgcctgcctggggaagtcctacgcacagatgtggcaactcatgtattttcacagacgcgacttacggctggccgcgaacgctatttgttccgccgttccagtggattgggtccctacctcaaggacaacttggagcatacatgcacaccatcagtggatgaccacggaagacatgttgtctgtgtggaatagagtttggatcgaggaaaacccctggatggaggataaaacacacgtgtccagttggggagacgtcccatacctgggcaagcgcgaggaccagtggtgcggcagcctcattgggcttaccgcccgggctacttgggcctcgaatatccaggtggcaattaaccaagtaaggcgactgatcggaaatgaaaactatctagattacatgacatccatgaaaagattcaagaatgagggtgaccccgaaggcgctctgtggtga

SEQ ID NO: 13784 - RNA, 9879 nt, synthetic construct
  misc_feature 1..9879: note = derived and/or modified CDS sequence (opt3) from DENV-1__GQ199806__SS-prME
  source 1..9879: mol_type = other RNA
agcgtgacaatgctgctaatgcttatgcccacagcactggctttccacttgactacgcgaggcggggagcctcatatgatcgtctccaagcaggaaagggggaaatctttactgtttaagacatcagccggtgttaacatgtgcacactaattgcaatggacctcggcgagttctgtgaagatactatgacctacaaatgcccacggataacagaggcggaaccggacgatgtggactgttggtgcaatgctaccgatacttgggtaacatatgggacctgtagtcagacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccattctcaggaaactgtgcatcgaagctaagatatctaatacgaccacagatagccggtgtccaactcaaggagaggccacccttgtggaggaacaagacgcaaactttgtctgccgccgaacattcgttgatagaggctggggtaatgggtgtggactgtttggcaaaggctccttgattacttgcgctaagttcaagtgcgtgaccaaactcgaggggaagatcgtacagtacgaaaacctgaaatattcagtgattgtcacagtgcacaccggagaccagcatcaagttggtaatgagagtactgaacacggcacgacagccaccatcactccccaggcgcctagcaccgagatccagttaacagactacggggccctgaccctcgattgttctccaaggactggacttgactttaacgaaatggtgctgttgacaatgaaggagaaatcctggctagtccataagcagtggttcctggatctcccgctgccctggacgtcaggcgcaagcaccagtcaagagacttggaatcggaaagaccttctggtgacatttaagaccgctcacgccaagaaacaggaagctgtagttttgggttctcaggagggggccatgcacacagcactcactggcgccaccgaaattcaaacgtccggaaccacaactatattcgctggccatctgaagtgccgtttaaaaatggataagctgaccctaaaagggatgagctatgtgatgtgtacaggatcgttcaagctcgagaaggaagtcgcggagactcagcacggtaccgtgctggtccagatcaaatacgagggcacggacgcaccttgcaagattccattttctacacaggatgaaaaaggggtgacccaaaacggacgccttatcactgccaatcccatagttacagacaaggagaaacctgtgaacattgaagctgagccacccttcggcgagtcctatatcgtaatcggtgccggggaaaaggcattgaagctgtcatggtttaaaaagggcagtagcattggaaaaatgttcgaggccaccgctagaggcgccaggcggatggcaatcctcggggatactgcgtgggactttggatccattggtggcgtcttcacctctgtggggaagctggttcatcagatatttggaacagcttacggcgtgcttttcagcggtgtctcatggacgatgaaaatcgggattggcgtgctgttgacctggctcggactgaatagtcgatccactagcttatctatgacatgtatcgtagtgggcctggttaccctatacctcggggtcatggtgcaggccgattcaggatgcgtgatcaactggaagggccgcgaactgaagtgtggtagtgggatttttgtcacaaatgaggttcacacttggaccgaacagtataaattccaagcagacagcccgaagagactttccgccgctataggaaaagcctgggaggagggcgtgtgcggtatcaggtctgcaacgcggttggaaaacattatgtggaagcagatctcgaacgagctgaatcatattctcctggaaaacgacatgaaatttacagtggtagtcggcgatgtggctgggatcttagcccagggaaagaaaatgatacgccctcagcccatggagtacaagtatagctggaagtcctggggcaaagcgaagatcattggggccgacgttcaaaataccactttcatcattgatggaccaaacacccctgaatgtcccgacgatcagagagcttggaatatctgggaggtggaggactacggctttggtatattcacaactaacatttggctgaaacttagggattcatatacccaggtctgcgaccaccgtttgatgagtgcagccatcaaggattctaaagctgtgcacgccgacatggggtactggattgaaagcgagaagaatgaaacatggaagctcgcacgggcgtccttcatcgaggttaaaacgtgtatatggccaaagtcacataccctgtggagcaacggagtgctagaatctgagatgatcattcccaaaatctatggcggtcctatttcccagcacaattaccgaccaggctactttactcaaacagccgggccgtggcatctgggaaagctcgagctggatttcgacctttgcgaaggcaccactgtagtcgtggatgagcactgcgggaacagaggacccagtttgaggacaaccacggtgactggcaaaatcatacacgaatggtgttgccgcagctgtaccctgcctccattacggtttaagggtgaggacgggtgctggtatggaatggagattagacccgtcaaggaaaaagaggaaaatctcgttaagtctatggtgtccgctggctcaggtgaggtagacagtttcagcctgggccttctgtgtatctcgatcatgattgaagaggtgatgaggtcccgctggtctcgaaaaatgttgatgacagggaccctcgccgtctttttcctgctaatcatgggacagctgacttggaacgatctcattcggctgtgcataatggtgggcgcaaatgctagcgaccgtatggggatgggaacaacctaccttgccttgatggcaacatttaagatgagacctatgttcgccgttggcctgttatttaggcgcctcacttcacgggaggtgctgcttctgaccatcggtctaagtctcgtcgcttccgtggaactgccaaactctttggaggaactgggggatggattagcgatgggcattatgatcctcaaactgcttacggacttccagagccatcaactgtgggccacattgctctccctgacctttattaagactaccttctcactacactatgcatggaagacaatggctatggttctgagcatcgtgagtctttttcccctctgtctgtctactacctcccagaaaacgacatggttgccggtcctgttaggcagcctcgggtgcaagcctctgaccatgttccttatagccgagaataaaatctggggaagaaagtcgtggccactgaacgaaggtattatggccgtaggcatcgtgtcaattttgctctctagtctgctcaagaacgatgttcccctggctgggcctcttatcgcaggaggcatgctcatagcctgttacgtgatttccggtagctctgcggacctgagcttggagaaggctgccgaggtctcctgggaagaggaagcagagcattcaggggccagtcacaatatcttagtggaagtacaggatgacggaactatgaaaatcaaggatgaggagagggacgatacactgaccattctcctgaaggctactcttctggcagtgagcggcgtctatcccttgtctataccagccacactattcgtttggtacttttggcagaaaaagaaacaacgatccggcgtgctgtgggacaccccttcacccccagaagtggagcgcgcggtcctcgatgacgggatctatcggattatgcagagaggactgcttggtaggagtcaggtgggcgttggggtattccaggaaaacgtgtttcatacgatgtggcacgtcactcgtggagctgtgttaatgtaccaaggcaagcgcctggagccgagctgggcctccgttaaaaaggacctcatctcttacggtgggggatggcggttgcagggctcgtggaataccggcgaggaagtgcaggtcattgcagtggagcctgggaagaaccccaaaaatgtacagacagccccaggaaccttcaagacaagcgaaggtgaggtcggcgctatcgccctggattttaaacccgggacttcaggatcccctatagtgaacagagaaggcaagatcgttggtctctatgggaatggagtggtcaccacgagtggcacatacgtgtctgcaattgctcaagccaaagcgagccaggacggcccactgcccgagatcgaggatgaagttttcaggaagcgaaaccttactattatggacctgcaccctgggtccggaaagacccggcgctatttgccggccatcgtgagagaggcaataaaaaggaagctacggacactgattctcgctccaacccgagtcgtggcctcagaaatggctgaggcattaaaaggtatgcccatcagataccagactaccgccgtaaagtctgaacatacaggcaaagagatcgtggatctgatgtgccacgccacgtttactatgcgccttctgagccctgttagggtcccaaattataacatgattatcatggacgaggctcatttcaccgatcccagttccatagcggcacgtgggtacattagcacacgggtgggaatgggcgaagccgctgccatctttatgaccgcaactcctccgggttctgtggaggccttcccccaatcaaatgctgtcattcaggacgaagagagagatatcccagaaaggtcctggaacagtgggtatgagtggataacagactttcctggaaagaccgtatggttcgtgcccagcattaagtcgggcaatgatatcgcgaactgtctccgcaaaaatggcaagcgagttatccagttgtctagaaaaacgttcgacactgagtaccagaagaccaagaacaacgactgggattacgtggtcaccaccgacatttccgaaatgggggccaattttcgggcagatagggtgatcgacccacgccgttgcctgaagcctgttattctcaaggatggacccgagagagtgatactggctggtccaatgccggtcactgtggccagcgcagcccaacggaggggccgcatcgggcgaaaccacaataaagaaggagaccagtatatttacatgggccagcctcttaacaatgatgaggaccatgctcactggacagaggccaagatgctactggataacatcaatacccccgaaggtatcattccagcgttgttcgagcccgaaagagagaaatcagcagccatagacggggaatatcggttaaggggcgaggctcgcaagacatttgtagagctgatgagaaggggagatctccctgtgtggctgagttacaaagttgcctctgaaggcttccagtattccgaccggcgttggtgctttgatggggagcgcaacaatcaagtccttgaagagaacatggacgtggaaatctggactaaggagggagagaggaaaaagctgagaccaagatggctcgacgctcggacgtacagcgatcccttggcactgcgcgagttcaaggagtttgccgctggtagaaggtcagtgagtggcgacctaattctggaaatcgggaaactccctcagcaccttacccagcgggcccagaatgcactggataacttagtcatgttgcataatagcgagcaaggaggccgagcgtatagacacgccatggaagaactgccggacacaattgagactctcatgctgcttgctctgatcgccgttctcaccggtggggtgacattgttctttctgtccggccgcggattaggcaagacctctatagggctactgtgtgtaatggcaagctccgtgctcctttggatggcttcagtcgaaccacattggatcgccgcatctattatcctggagttctttttgatggtgctgctcattcccgaacctgataggcagcggactccccaggacaaccagctggcctacgttgtgatcggacttctcttcatgatactgacggtcgctgcgaatgagatgggtttgctggagaccaccaaaaaggatttaggcattgggcacgtagccgtggaaaaccaccatcacgcagctatgctagacgttgatctgcatccagccagtgcctggactctctacgcagtggctaccacaatcattacccctatgatgcgtcacactatcgagaacacaacggccaatatatcgcttaccgcgatcgctaaccaagccgcaattctgatgggattggacaaaggctggcccatcagcaagatggatattggtgtcccactgctcgccctggggtgctattcccaggtgaatcctcttactttaacagctgcagtcctgatgctcgtggcccattacgcgatcataggcccgggattgcaggctaaggccaccagagaagcacagaaaaggaccgccgctggcattatgaagaaccccacagttgacgggatcgtggccatcgatctggacccagtagtgtatgacgcaaaatttgagaagcagctaggacagattatgctgctcatcctttgtacttctcagatactgttgatgcgcacgacctgggctctgtgcgaatcaattacactcgccactggccctctgaccacattatgggagggtagccccgggaaattctggaataccactatcgcggtctccatggccaacattttccggggaagttaccttgcaggcgctggtctggccttttctctcatgaaaagcctaggcgggggacgaagaggcacgggggcacaaggagagacactgggcgaaaagtggaaaaggcagttgaatcagctgtcaaagtccgagttcaacacctataaacgcagtggtatcatggaagttgatcggagcgaggctaaggaagggctcaaaagaggagagactaccaagcacgccgtgtctcgtggcacagccaaacttaggtggtttgtcgagcggaatctggtgaaaccagaaggtaaggtaatagacttgggctgtgggcgcggaggctggtcctactattgcgcggggctgaaaaaggtgactgaggttaaaggatacaccaagggcggtcctgggcacgaggaacccatcccgatggctacatacggatggaacctcgtgaaattaaattcaggcaaggatgtcttctttattccacctgaaaagtgtgacacgctgctttgcgatatcggcgagagctcgcccaacccaaccattgaggaagggcgaactctgagagtgctaaaaatggtcgagccctggctcaggggaaatcagttctgtatcaagattctgaacccttatatgccgtctgtggttgaaacattggagcaaatgcagcggaaacatggtggcatgctggtacgcaatcccctcagtagaaactccacccacgagatgtactgggtgagctgcgggactggaaatatcgtctcagcagtgaacatgacatccaggatgcttctgaaccgatttaccatggcccatcggaagccaacgtatgaacgtgacgttgatttaggcgctggtaccagacacgtggccgtcgagcctgaagtggcaaatctggacataattgggcagcgcatcgagaacatcaaatacgaacacaagtctacatggcattatgatgaggacaatccctacaagacttgggcctatcacggaagctacgaggtaaaacctagtggctccgctagctctatggtgaacggcgttgtcaagttgctcaccaaaccatgggatgtgattcccatggtgacacagatagcgatgactgacaccacacctttcgggcaacagagggtctttaaggaaaaagttgacacccggactccaaaggccaagagaggaacggcacagatcatggaggtgacagctaaatggctgtggggtttcctatcacgcaataagaaacccaggatttgtacccgagaagagtttactcggaaggtaagaagtaacgccgcaatcggcgccgtgttcgtcgatgaaaatcaatggaactccgctaaagaggccgtggaggacgaaaggttttgggatcttgttcatcgcgagcgtgaactgcacaagcaggggaagtgcgcgacctgcgtgtacaatatgatgggaaaacgggagaagaaactcggcgagttcggtaaggcaaaagggagcagagccatttggtatatgtggctgggagctaggttcttggagtttgaggccctgggcttcatgaacgaagaccattggttttctcgcgaaaattcgctctcaggcgtcgaaggggagggacttcacaagctgggttacatcttacgagatataagcaaaatcccgggcgggaacatgtatgcagacgatacagctggatgggacacgcggattaccgaggatgacctgcagaatgaagccaagatcactgatattatggagcctgaacacgctttgctcgccaagtccatcttcaaactgacataccagaacaaggtggtaagagttcaaaggccagccaaaaatggcaccgtgatggacgtcataagtcgcagagatcagcggggttctggacaggtgggaacttatggcctaaacacatttaccaacatggaggcgcagcttattaggcaaatggaaagcgagggcatcttctccccctcagagctggaaacacctaatctcgccgggcgtgtgctggactggttggagaagcatggagtcgaacgattaaaacgcatggctatcagtggtgacgattgtgttgtgaagccaattgacgatagatttgccactgcactgaccgctctcaacgacatgggcaaggtacggaaagatataccccagtgggagccgtctaaggggtggaatgactggcaacaggtgcctttctgcagccaccattttcaccaacttatcatgaaagatggaagggaaattgtcgtgccctgtcgcaaccaggacgagctggttggcagagcccgggtgtcccagggtgcagggtggtcactaagggagacggcctgcctgggaaagagctacgcgcagatgtggcaactcatgtatttccaccgacgtgatttgagactggctgccaatgcaatctgttctgccgtcccagtggactgggtacctacctcccgcacaacttggagtattcatgctcaccatcagtggatgaccacagaagatatgcttagcgtttggaaccgggtgtggatcgaggaaaatccctggatggaggacaaaactcacatatcgtcctgggaagacgtcccatacctgggcaagagggaggatcagtggtgcggctctctcatcgggttaaccgccagagcaacgtgggctacaaacattcaagtggccatcaatcaggttcgccggctgattggaaacgagaattacttggactatatgacctcaatgaagaggtttaaaaacgaaagcgatcccgagggtgcgctgtggtga

SEQ ID NO: 13785 - RNA, 9879 nt, synthetic construct
  misc_feature 1..9879: note = derived and/or modified CDS sequence (opt3) from DENV-1__GQ199809__SS-prME
  source 1..9879: mol_type = other RNA
tccgtgaccatgctgctcatgcttatgcccacagcactggctttccacttgactacgaggggaggggaacctcatatgatcgtcaccaagcaggaaaggggaaaatccttactgtttaagacatctgccggtgttaatatgtgcactctaattgccatggacctcggcgaactgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggttgacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggatcgttcaaactggagaaggaagtggctgagacccagcacggtacggtccttgtgcagataaagtacgagggcacagacgcgccttgcaaaatcccattctcgacccaagatgaaaagggggttattcagaacggacgcttgatcactgcaaatcccatagtgacagacaaagagaagcctgtaaacattgaagccgagccaccctttggcgagtcttatatcgtcatcggtgtgggggaaaaagctctgaagctctcctggttcaagaaaggctcaagtattggaaagatgtttgaggccaccgcaagaggcgccaggcggatggctatcctgggggatactgcctgggacttcggaagcattggtggcgtttttacctccgtggggaaacttgtccatcagatattcggaacagcatacggcgtgctgttttctggtgtaagctggacgatgaagatcgggattggcgtgttgctcacctggctgggattaaattcacgaagtacttccctgagcatgacatgtatcgcggttggcctagtcaccctctacctgggggtgatggtgcaggctgattctggatgcgtcatcaactggaaaggccgcgaacttaagtgtggttcagggattttcgttacaaatgaggtgcacacttggaccgaacaatataagtttcaggccgacagtccgaaaagattgagcgcagccataggaaaggcttgggaggagggcgtgtgcggtatcaggtccgtaacgcggctggaaaacattatgtggaaacagatctctaacgagctcaatcatattctgttagaaaacgacatgaagttcacagtcgtggttggcgatgtggtcgggatcctggcccagggcaaaaagatgatacgccctcaacccatggagcacaaatactcgtggaaaagctggggcaaggcaaagatcattggggctgacgtgcagaataccacttttatcattgatggaccaaacacccctgaatgtcccgacgatcagagagcctggaatatctgggaggttgaggactatggcttcggtatatttacaactaacatttggcttaagttgagggattcctacacccaggcgtgcgaccaccgtctcatgtcagccgctatcaaagatagtaaggcagtgcatgccgacatggggtattggattgaatctgagaaaaatgaaacatggaagctggctcgggccagcttcatcgaggtaaagacgtgtatatggccaaaatcccacaccctatggtcaaacggagtcctggaaagcgagatggtgatccccaagatttacggcggtcctatctctcaacataattatcgaccaggctacttcactcagacagcagggccgtggcacctcggaaaactggagcttgattttgacttgtgcgaaggcaccactgtggtcgttgatgagcactgcgggaacagaggaccctccctgaggacaaccacggtgactggcaagattatccatgaatggtgttgccgcagttgtaccttacctccactccggttcaaaggtgaggacgggtgctggtacggaatggagataagacccgtaaaggaaaaggaggaaaatctggtgaaaagcatggtctctgcgggctccggtgaggtggactcatttagtcttggcctgttgtgtattagcatcatgatcgaagaggttatgaggtcgcgctggtcccgaaagatgctcatgacagggaccctggccgtgttcctactgctcattatgggacagctgacttggaacgatcttatccggttgtgcattatggtcggcgctaatgcctctgaccgtatggggatgggaacaacctatctggcattaatggctacatttaaaatgagacctatgttcgccgtgggcctcctgtttaggcgccttactagccgggaggttctgctactcaccataggtctgtcattggtggcaagtgtcgaactgccaaactccttagaggaactcggggatggactggccatgggcatcatgattcttaagctgttgacggacttccaatctcaccagctctgggctacactgctaagcctgacctttatcaaaactaccctttccctccattacgcgtggaagacaatggccatggtactgtcaattgtgagcttgttccccctgtgtttaagtactacctctcagaagacgacatggctcccggttctgcttggctccctggggtgcaaacctttgaccatgtttctcatcgcagagaataagatatggggaagaaaaagctggccactgaacgaaggtatcatggctgtgggcgtcgtgtcgattctactgtcatctcttctcaagaacgatgtacccctggccgggcctttgatcgccggaggcatgttaattgcttgttatgtgatcagtggttccagcgcagacctgtctctcgagaaagccgcggaggtcagctgggaagaggaagctgagcactccggggcctcacataatatactggttgaagtgcaggatgacggaactatgaagattaaagatgaggagagggacgatacacttaccatcctgttgaaggcaactctactggccgtgagtggcgtctaccccctcagcatcccagctacactgttcgtgtggtatttttggcaaaagaaaaagcagcgatctggcgttctttgggacaccccttcacccccagaagtagagcgcgcagtgttagatgacgggatttaccggataatgcagagaggactgctcggtaggagccaggtcggcgtgggggttttccaagaaaacgtgttccacacgatgtggcacgtcactcgtggagccgtgttgatgtatcagggcaaacgcctggagccgagttgggcgagcgtaaagaaagacctcatctcctacggtgggggatggcggctgcagggctcttggaataccggcgaggaagtccaggtgattgctgttgagcctgggaagaaccccaagaatgtgcaaacagccccaggaacctttaaaacacccgaaggtgaggtcggcgcaatcgcccttgatttcaagcctgggacttcgggaagcccaattgtgaacagagaaggcaaaatcgttggtctgtacgggaatggagtggtcaccacgtcaggcacatatgtgtccgctatagcccaggcaaaggctagtcaggagggccccttgcctgagatcgaagacgaggtatttaggaaacgaaacctaactattatggatctgcatccggggtctggaaagacccggcgctacctcccagccatcgtgagagaagcgattaagaggaaattacggacactgatccttgcccccacccgagttgtcgcaagcgagatggctgaagccctgaagggtatgcctataagatatcaaactaccgctgtgaaatccgagcacacaggcaaggagattgtggacctcatgtgccatgcaacgttcactatgcgcttgctgtcaccagtcagggtacccaattacaacatgatcatcatggatgaagcccactttaccgacccttctagcattgccgctcgtgggtatatcagtacacgggtgggaatgggcgaggcggcagccatattcatgaccgctactccgcccggttccgttgaagcctttccacagagcaatgcagtgattcaggatgaggaaagagacatccctgagaggtcttggaactcagggtacgagtggattacagatttccccggaaaaaccgtctggtttgtgccatccatcaagagtggcaatgacatagccaactgtctccgcaagaatggcaaacgagttattcagctgagcagaaagacgttcgatactgaatatcagaaaaccaagaacaacgactgggactacgtggtcaccaccgatatctcggagatgggggctaattttcgggcggacagggtgatcgatcctcgccgttgccttaaacccgtaattctaaaggacggaccagaaagagtgatcctggccggtccgatgcctgttactgtcgcatctgctgcccagcggaggggccgcattgggcgaaaccataataaggagggagatcagtacatatatatgggccagcccttgaacaatgacgaggatcacgcacactggacagaagccaaaatgttactggacaacatcaataccccagagggtattatccccgctctcttcgaacctgagagagaaaagtccgccgcgatcgatggggagtaccggctgaggggcgaggcacgcaaaacattcgtggaacttatgagaaggggagacctgccagtgtggctcagctataaggtcgcctcagagggctttcaatacagtgatcggcgttggtgcttcgacggggaacgcaacaatcaggttttggaggaaaacatggatgtggagatttggactaaagagggagaacgaaagaaactgagacccaggtggctagacgctcggacgtattctgaccctctggccctccgcgagtttaaggagttcgctgcaggtagaaggtccgtaagcggcgatcttatactggagatcgggaagttaccgcagcatttgacccagcgggcccaaaatgctctggacaacctcgtgatgctgcacaattcagaacagggaggccgagcctacagacatgcaatggaggagcttccagatacaattgaaactctgatgctcttggcgctgatcgccgtcttaaccggtggggtgacactatttttcctgagtggccgcggactcggcaaaaccagcattgggcttctgtgtgttatggcttcctctgtgttgctgtggatggccagcgtcgagccccactggatcgcagcttccataatcctcgaatttttcctgatggtacttctcattcctgagcccgacaggcagcggactccacaggataaccaactggcctatgtggttatcggattgctgtttatgattttaacggtggcagccaatgagatgggtctactggaaaccacaaagaaagacctcggcatcgggcacgtcgctgtggagaaccatcaccatgcgactatgcttgatgtcgacctgcaccctgcctcagcatggaccttgtacgctgtggccacaaccataattactcccatgatgcgtcatacaatcgaaaacacgaccgccaatatttctctgactgcaatcgctaaccaggccgcgatactcatgggactggataagggctggccaatcagtaaaatggacattggtgttcctcttttagctctggggtgctacagccaggtgaatccgctcacattgaccgccgcagtactgatgctagtggcccactatgctatcattggccccggactgcaagcaaaggccaccagagaggcgcagaagaggacagctgccggcatcatgaaaaacccaactgtcgatgggatagttgcaattgacctcgatcctgtggtctacgacgccaagttcgaaaaacagcttggacagatcatgctgttgatcctgtgtacgagccaaattctcctgatgcgcaccacatgggctttatgcgagtccatcactcttgccaccggccccctgacaaccctctgggagggttctccagggaagttttggaatactacgatagcagtgtcaatggctaacattttccggggaagctatctagccggcgcgggtctggccttttccttgatgaaaagtctgggcgggggacgaagaggcacaggggcacagggagaaaccctcggcgagaagtggaagaggcagcttaatcagctgtctaaaagcgagttcaacatctacaagcgctcaggtattatggaggtagaccggtccgaagctaaagaggggttgaagagaggagagactacccgtcacgccgtgagtaggggcacagcaaaactgcggtggttcgttgaacgcaatctcgtgaagcctgagggtaaggtcatcgatttaggctgtgggcgaggaggctggagctattactgcgctgggctgaaaaaggtgactgaagtcaaaggatataccaagggcggtcccgggcatgaggaaccgataccaatggccacatacggatggaaccttgtgaaactgcactctggcaaggacgtatttttcacgcctcccgagaaatgtgataccctactctgcgacatcggcgagtcctcaccaaatcccactattgaagaggggagaacactgagggtattgaagatggtggaaccttggctgcggggaaaccaattttgtatcaagattctcaatccgtacatgcccagcgtcgtggagacccttgagcagatgcagcgcaaacatggtggcatgctggttagaaacccattatcgagaaattctactcacgaaatgtattgggtgagttgcgggacaggaaacatcgtctccgccgtgaatatgaccagccgaatgctgttgaaccggttcacgatggcgcaccgtaagcctacctacgagagagatgtagacctcggcgctggtacacgccatgtggcagttgaacccgaggtcgccaacctggatattatcgggcagaggatagaaaatattaaacacgagcataagtcaacttggcactatgacgaggataacccttacaaaacctgggcttatcatggatcctacgaagtgaagccatctggcagcgccagttccatggtgaatggcgtcgttaagctacttacaaaaccctgggacgtgatccctatggtaactcaaatcgcaatgaccgatacaaccccatttgggcagcagcgggtgttcaaggagaaagtcgacactagaacgcccaaggccaaacgcggaacagctcaaattatggaagtgaccgcgaggtggctgtggggttttctcagccgaaacaagaagccgcggatatgtactagagaggagttcaccaggaaagttcgctctaatgccgcaatcggcgctgtgtttgtcgacgagaaccagtggaactcagccaaggaggcagtggaagatgagcgtttctgggacctggtacagaaagaacgggagttgcacaagcaggggaaatgcgccacatgcgtttataacatgatgggaaagagagaaaagaaactgggcgagtttggtaaggctaaagggagtagggccatttggtacatgtggctcggagcgcgcttccttgagtttgaagcactgggcttcatgaatgaggatcactggttctcccgagaaaacagcttatctggcgtggagggggagggactgcataagttgggttacatcctccgggacatttcgaaaatccctggcgggaatatgtatgccgatgacacggctggatgggataccagaataactgaagacgatctgcaaaacgaggccaagatcacagacattatggaaccagagcacgcactacttgctacctcaatctttaaactgacttaccagaataaggtcgtgagggtgcagcgccccgccaagaacggcacagtcatggatgttattagcagacgggaccagaggggttccgggcaagtgggaacctatggcctcaatacattcactaacatggaagctcagctgatccgtcagatggagagtgagggcatatttttgccttctgaattagagaccccaaacctggccgaacgagtactcgattggcttgagaaacatggggtggaacgcctgaagagaatggcaattagcggagacgactgtgtcgtgaaacccatcgatgaccggttcgcgacggccctaaccgctctgaatgatatgggtaaggttaggaaagacatcccgcagtgggagccttccaagggctggaacgattggcaacaggtgcccttttgctcacaccacttccatcagctcattatgaaggacgggcgcgagatagtcgtgccatgtagaaatcaggatgaattggtaggacgggccagggttagtcaaggcgcaggttggtctctgcgagagacagcttgccttgggaaaagctacgcccagatgtggcagctgatgtattttcaccgtagagacctccgcttagcagccaacgcgaattgttccgctgtgcctgtcgattgggtgcccacttcacggaccacatggagcatccatgcccaccatcaatggatgactaccgaagacatgctgtctgtttggaacagggtgtggattgaggaaaatccatggatggaggataagacgcacgtctccagttggggagacgtgccctacttgggcaaaagagaggaccagtggtgcggcagcctgatcgggctcacagcacgcgccacctgggcttcgaacattcaggtagccatcaatcaggtgcggaggcttataggaaacgaaaattatctggattacatgacttccatgaagcgattcaaaaacgagggtgaccctgaaggcgcactatggtga

SEQ ID NO: 13786 - RNA, 9879 nt, synthetic construct
  misc_feature 1..9879: note = derived and/or modified CDS sequence (opt3) from DENV-1__GQ199810__SS-prME
  source 1..9879: mol_type = other RNA
agcgtgaccatgctgctcatgcttatgcccacggccctggctttccacttgactacgagaggaggggaacctcatatgatcgtctccaagcaggaaagagggaaatctttactgtttaagacctcagccggtgttaatatgtgcacactaattgccatggacctcggagagctgtgtgaagatactatgacctacaaatgcccacggataacagagaccgaaccggacgatgtggactgttggtgcaatgcgactgatacatgggtaacctatgggacgtgtagtcaaactggggagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaagacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaagcccctaccaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccggcagcttcaaactggagaaggaagtcgccgagacgcagcacggtacagtgcttgttcagataaagtacgagggcaccgacgctccttgcaaaatcccattcttgactcaagatgaaaagggggtgacacagaacggacgcctgattaccgcgaatcccatcgtaactgacaaagagaagcctgtcaacatagaagcagagccaccctttggcgagtcgtatattatcatcggtgccggggaaaaagctctcaagctgtcttggttcaagaaaggctcctcaattggaaagatgtttgaggccaccgcaagaggcgccaggcggatggctatccttggggatacagcctgggacttcggaagtattggtggcgtgtttacgagcgttgggaaactggtgcatcagatattcggaaccgcatacggcgtcttgttttccggtgtgtcttggactatgaagatcgggattggcgtactcctgacatggttaggactgaatagccgatcaaccagtctatccatgacatgtatcgcggtgggcctcgttactctgtaccttggggtcatggtgcaggctgatagcggatgcgtgatcaactggaaaggccgcgaattgaagtgtggttctgggattttcgtcaccaatgaggttcacacgtggacagaacaatataagtttcaggccgactcaccgaaaagactgagtgcagccataggaaaggcttgggaggagggcgtgtgcggtatcaggagcgccacccggctcgaaaacattatgtggaaacagatctccaacgagctgaatcatattttactggaaaacgacatgaagttcactgtggtagtcggcgatgtggcagggatccttgctcagggcaagaagatgatacgccctcaacccatggagtacaaatattcttggaagtcgtggggcaaggccaaaatcattggggcggacgttcagaataccacatttatcattgatggaccaaacactcctgaatgtcccgacgatcagagagcctggaatatctgggaggtggaggactacggcttcggtatatttaccacaaacatttggttgaagctcagggatagccacacgcaggtctgcgaccaccgtctgatgtccgctgcaatcaaagattcaaaggccgtgcatgctgacatggggtattggattgaaagtgagaaaaatgaaacctggaagctagcccgggcatctttcatcgaggttaagacttgtatatggccaaaaagccacacactgtggtccaacggagtgctcgaatcagagatgatcattcccaagatctacggcggtcctattagccaacataattatcgaccaggctacttcacccagactgcggggccgtggcacctgggaaaacttgagttggattttgacctgtgcgaaggcacaaccgtagtcgtggatgagcactgcgggaacagaggaccctctttaaggacgactaccgtgacaggcaagatcatacatgaatggtgttgccgctcctgtaccctccctccactgcggttcagaggtgaggacgggtgctggtacggaatggagattaggcccgtcaaagaaaaggaggaaaatcttgttaagagtatggtgagcgccggctctggtgaggtagactccttttcactgggcttgctctgtatcagtatcatgattgaagaggtgatgcgcagccgatggtcgcggaaaatgctgatgactgggacactagctgtcttctttctgctcatcatgggacagctgacctggaacgatcttattcgtttgtgcataatggtgggcgccaatgcatccgacagaatggggatgggaacaacttatctggctttaatggccaccttcaagatgaggcctatgtttgcagttggcctcctgttccgccggcttacgtctagagaggtgctgctactcacaatcggtctgagcttggtcgcctcagtggaactgccaaacagtttagaggaactcggggatggactggctatgggcattatgatccttaaactgttgaccgactttcaatcccaccagctctgggcgactctgctatctctgaccttcattaagacaacttttagccttcattacgcctggaaaaccatggcaatggttctctccatcgtgtcactgttccccttgtgtctgagcacgacaagtcagaagaccacttggttaccggtcctcctgggctctcttgggtgcaagcctctgacaatgtttttgatagctgagaataaaatctggggaaggcgatcctggccactcaacgaaggtattatggccgtaggcatcgtgagcattctgctatcgtcactgcttaagaacgatgttcccctcgccgggcctctgatcgctggaggcatgttgatagcatgttatgtgatttctggtagttccgccgacttaagcctggagaaagcggctgaggtctcttgggaagaggaagtggagcacagcggggcctcccataatatcctcgtagaagtgcaggatgacggaaccatgaagatcaaagatgaggagcgcgacgatactctgacaattcttctgaaggcaaccttgctagccgtctcaggcgtttaccccctgagtataccagctacactcttcgtgtggtatttctggcagaagaagaagcagcggagcggcgtgctgtgggacactccttctcccccagaagtcgagagagcagtgcttgatgacgggatctacaggattatgcagcgtggattactgggtcgctcccaggttggcgtaggggtgtttcaagaaaacgtcttccacaccatgtggcacgtgacacggggagccgttctcatgtatcagggcaaaagattggagccgtcatgggcgagtgtgaagaaagacctgatcagctacggtgggggatggaggctccagggctcctggaataccggcgaggaagtccaggtgattgctgtagagcctgggaagaaccccaaaaatgtccaaacagccccaggaacttttaagacccccgaaggtgaggtgggcgcaatcgccctggatttcaagcctgggacgtctggatcgccaatagttaaccgagaaggcaaaatcgtgggtctttacgggaatggagtcgtgacaactagcggcacctatgtttcagctattgcccaggcaaaggcttcccaggagggccccctgcctgagatcgaagacgaggtgtttcggaaacgcaacttgacaattatggatctacatccggggagtggaaagaccagaaggtacctgccagccatcgtccgggaagcgataaaacgaaagctcagaactttaattctggcccccacccgcgtggtagcatctgagatggctgaagcccttaagggtatgcctatcaggtatcaaacaacggctgtgaaaagcgagcacactggcaaggagatcgttgacctgatgtgccatgcaaccttcacaatgcgtctcttgtccccagtccgggtgcccaattacaacatgattatcatggatgaagcccactttaccgacccttcatctatagccgctagagggtatattagcactagggtgggaatgggcgaggcggcagccatcttcatgacagctaccccgcccggtagtgtcgaagcctttccacagtccaatgcagtaattcaggatgaggaacgcgacatccctgagcgaagctggaactctgggtacgagtggataacggatttccccggaaaaactgtgtggtttgttccatcaattaagtccggcaatgacatcgccaactgtctgaggaaaaatggcaagcgggtgatccagctcagtaggaagacattcgataccgaatatcagaaaaccaagaacaacgactgggactacgtcgtgactacagatattagcgagatgggggctaatttccgcgcggaccgtgttatcgatcctagacggtgcctgaaacccgtgattcttaaggacggaccagaaagggtcatactagccggtccgatgcctgtgaccgtagcatcggctgcccagcgccgaggcagaatcgggcggaaccataataaagagggagatcagtacatttatatgggccagcccctgaacaatgacgaggatcacgcacactggacagaagccaagatgttgttagacaacatcaatactccagagggtatcattcccgctctgtttgaacctgagagggaaaagtctgccgcgatagatggggagtaccgcctcagaggcgaggcaaggaaaacgttcgtggaactgatgcggcgtggagaccttccagtttggctgtcctataaggtcgccagcgagggctttcaatactcagatcgccgatggtgcttcgacggggaaagaaacaatcaggtgctcgaggaaaacatggatgtggagatctggaccaaagagggagaaaggaagaaattgcggccccgctggctggacgctagaacatatagtgaccctctagccctgagggagtttaaggagttcgctgcaggtcggcgatctgtctccggcgatctcattcttgagatcgggaaactgccgcagcatttaactcagagagcccaaaatgctttggacaacctggttatgctccacaatagcgaacagggaggccgcgcctacaggcatgcaatggaggagctgccagataccattgaaacacttatgctgctcgcgttgatcgccgtgctgaccggtggggtaactttatttttcctatcaggccggggactgggcaagacgagtatagggctcctttgtgtgatggctagctccgtcctgttgtggatggcctctgtggagccccactggatcgcagctagcattatcctggaatttttcctcatggttctgcttattcctgagcccgaccgtcagagaaccccacaggataaccaactcgcctatgtggtcatcggactgttgtttatgatactgacagtagcagccaatgagatgggtttactagaaactaccaagaaagacctgggcattgggcacgtggctgttgagaaccatcaccatgcggccatgctcgatgtggaccttcaccctgcatccgcttggacactgtacgccgtcgccaccactatcattacacccatgatgaggcatacgatcgaaaacaccactgcaaatatatcattgacagctatcgccaaccaggcggctattctgatgggactcgataagggctggccaatctctaaaatggacattggtgtgcctctgcttgccttagggtgctacagtcaggtcaatccgctgaccctcaccgcagccgtgttgatgctggttgctcactatgcaatcataggccccggactacaagccaaggcgacacgcgaggctcagaaacggactgccgcaggcattatgaagaacccaacggtggatgggatcgtagccatcgacctggatcctgtggtctacgacgctaagttcgaaaaacagctcggacagattatgcttctgatcttgtgtacctcgcaaatactgctcatgcgaacaacttgggccctgtgcgagagcattaccttagcaacaggcccccttaccactctgtgggagggttccccagggaagttttggaatacgacaatcgctgtttctatggccaacattttcagaggatcatatctcgcgggcgccggtctagcattcagcctgatgaaatccttgggcgggggaaggcgcggcaccggggctcagggagaaactctgggcgagaagtggaaacggcagctcaatcagcttagtaagtctgaatttaacacctacaagagaagcggtatcatggaggtggaccgttcagaagccaaagaggggctgaagaggggagagacaactaaacacgcagtctcccggggcaccgctaagttgcgctggttcgtggaacgaaatctggtaaaacctgagggtaaggtgatagatctcggctgtgggagaggaggctggagttattactgcgccgggttaaagaaagttacagaagtgaagggatatacgaaaggcggtcccgggcatgaggaaccgatcccaatggccacctacggatggaacctggtcaaacttcacagcggcaaagacgtgtttttcattcctcccgagaagtgtgatactctgctatgcgacatcggcgagtcttccccaaatcccacaattgaagaggggaggaccctccgggtcctgaaaatggtggaaccttggttgcgcggaaaccaattttgtatcaagattctgaatccgtacatgccctcagttgtagagactctcgagcagatgcagagaaagcatggtggcatgcttgtgaggaacccactgagccgaaattcgacacacgaaatgtattgggtctcttgcgggaccggaaacatcgtgagtgcggttaatatgacgtcccggatgttactgaaccgtttcaccatggctcacagaaaacctacatacgagcgcgatgtggacttgggcgcaggtactaggcatgtcgccgtggaacccgagatagctaacctcgatattatcgggcagcggatcgaaaatattaagcacgagcataaaagcacctggcactatgacgaggataacccttacaagacatgggcctatcatggatcatacgaagtaaaaccatccggctctgcaagcagtatggtgaatggcgttgtcaagctgctaactaagccctgggacgtgatacctatggtgacccaaatcgccatgacagataccactccatttgggcagcagagagtcttcaaagagaaggttgacacgcgcacacccaaagctaagaggggaaccgcgcaaattatggaagtgactgccaaatggctttggggttttctgtcccgaaacaagaagccgcggatctgtaccagagaggagttcacaaggaaagtacgcagcaatgcagctattggcgccgtgtttgtcgacgagaaccagtggaactctgcaaaggaggccgtggaagatgagcgtttctgggacctcgttcaccgggaaagagagctgcacaaacaggggaagtgcgctacgtgcgtgtataacatgatgggaaaaagggaaaagaagttgggcgagtttggtaaagccaaggggtcacgcgcgatctggtacatgtggctgggagcacgattcctcgagttcgaagcccttggctttatgaatgaggatcattggttcagtcgggaaaactccctgagcggcgtcgagggggagggattacacaaactgggttacatattgagagacatctctaagattcctggcgggaatatgtatgctgatgacaccgccggatgggatactaggatcacagaagacgatctccagaacgaggcacgcattaccgacatcatggaaccagagcatgctctgctagccaaatcgatatttaaacttacttaccaaaataaagtggtaagagttcagcggcccgctaagaacggcacagtgatggatgtcatttcaaggcgtgaccagcgaggtagcggacaggtgggaacctatggcctgaatacattcactaacatggaagcccaactcatccgccagatggagtccgagggcatctttagtccttctgaactggagaccccaaacttggcagaaagagtgttagattggctggagaagtacggggtcgaacggctcaaaaggatggcgattagcggagacgactgtgttgtgaagcccatagatgaccgcttcgccacggctcttaccgccctgaatgatatgggtaaagtaagaaaggacatcccgcagtgggagccttccaaaggctggaacgattggcagcaagtgcccttttgctcacaccacttccatcagctaattatgaaggacgggcgggagatcgtcgtgccatgtaggaatcaggatgaactggttggacgagcacgtgtgagtcagggcgctggttggtctctcagagagacagcctgcttgggaaagagctatgcacaaatgtggcagctgatgtactttcaccgccgggaccttaggctggccgcgaacgctatttgttccgccgtccctgtggattggatccccacttcaagaaccacatggagcatacatgcacaccatcagtggatgactaccgaagacatgctctctgtatggaatcgcgtttggatcgaggaaaacccatggatggaggataaaacgcacatttccagttggggagacgtgccctatttaggcaagcgggaggaccaatggtgcggcagcctgatcgggttgacagccagggctacctgggccactaatattcaggtcgcaatcaaccaggtgcgaagactgattggaaatgaaaactacctcgattacatgacatcgatgaaacggttcaagaatgagggtgaccctgaaggcgctctttggtga

SEQ ID NO: 13787 - RNA, 9879 nt, synthetic construct
  misc_feature 1..9879: note = derived and/or modified CDS sequence (opt3) from DENV-1__GQ199811__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagttctgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagagcaggacgcaaactttgtttgccgccgaacattcgtggatagaggctggggtaatgggtgtggactgtttggcaaaggctccttgataacttgcgctaagttcaagtgcgtaaccaaactcgaggggaagattgtgcagtacgaaaacctgaaatattcagtcatcgtgacagttcacaccggagaccagcatcaagtgggtaatgagagtactgaacacggcacgacagccaccattactccccaggcgcctagcaccgagatccagttaacagactacggggccctgaccctcgattgttctccaaggactggacttgactttaacgaaatggtcctgttgacaatgaaggagaaatcctggctagtgcataagcagtggttcctggatctcccgctgccctggacgtcaggcgcaagcaccagtcaagagacttggaatcggcaggaccttctggtaacatttaaaaccgctcacgccaagaagcaggaagttgtggtcttgggttctcaagagggggctatgcacacagccctcactggcgcaaccgaaatccagacgtccggaaccacaactattttcgccggccatctgaaatgccgtttaaagatggataaactgaccctaaaggggatgagctatgtgatgtgtacaggatcgttcaaactcgagaaggaagtcgctgagactcagcacggtaccgtgctggttcagataaagtacgagggcacggacgcgccttgcaaaatcccattttctacacaagatgaaaagggggtgacccagaacggacgccttattactgcaaatcccatcgtaacagacaaagagaagcctgtcaacatagaagccgagccacccttcggcgagtcctatattgtgatcggtgctggggaaaaagccttgaagctgtcatggtttaagaaaggcagtagcatcggaaagatgttcgaggcaaccgccagaggcgctaggcggatggccattctcggggatactgcatgggactttggatccatcggtggcgttttcacctctgtggggaaactggtccatcagatttttggaacagcgtacggcgtgcttttcagcggtgtatcatggacgatgaagatagggatcggcgtgctgttgacctggctcggactgaatagtcgatccactagcttatctatgacatgtattgctgttggcctggtcaccctatacctcggggtgatggtgcaggccgattcaggatgcgtcatcaactggaaaggccgcgaactgaagtgtggtagtgggatctttgttacaaatgaggtgcacacttggaccgaacaatataagttccaggcagacagcccgaaaagactttccgccgctattggaaaggcctgggaggagggcgtgtgcggtataaggtctgcaacgcggttggaaaacatcatgtggaaacagatttcgaacgagctgaattacatcctcctggaaaacgacatgaagttaacagtagtcgtgggcgatgttgctgggattctggcccagggaaaaaagatgatccgccctcaacccatggagtataaatacagctggaagtcctggggcaaggcgaaaataatcggggccgacgtgcagaataccacttttattatcgatggaccaaacacccctgaatgtcccgacgatcagagagcttggaatatttgggaggtcgaggactatggcttcggtatctttacaactaacatatggcttaagttgagggattcatacacccaggtgtgcgaccatcgtctcatgagtgcagccattaaagattctaaggctgttcacgccgacatggggtattggatcgaaagcgagaaaaatgaaacatggaagctggcacgggcgtccttcattgaggtgaagacgtgtatctggccaaaatcacacaccctatggagcaacggagtactggaatctgagatgataatccccaagatttacggcggtcctatctcccaacataattaccgaccaggctatttcactcagacagccgggccgtggcacctcggaaaactggagcttgattttgacttgtgcgaaggcaccactgtcgtggtggatgagcattgcgggaacagaggacccagtctgaggacaaccacggtcactggcaagattatccacgaatggtgttgccgcagctgtaccttacctccactccggttcaaaggtgaggacgggtgctggtacggaatggagataagacccgttaaggaaaaggaggaaaatctggtgaaatctatggtatccgctggctcaggtgaggtggacagttttagccttggcctgttgtgtatttcgatcatgatcgaagaggtcatgaggtcccgctggtctcgaaagatgctcatgacagggaccctggccgtgttctttctactgattatgggacagctcacttggaacgatctgatccggctttgcattatggttggcgcaaatgctagcgaccgtatggggatgggaacaacctatttggccctgatggcaacattcaaaatgagacctatgtttgccgtgggcttactcttcaggcgcctgacttcacgggaggtccttctgctaaccataggtctcagtctggtggcttccgttgaattgccaaactctctggaggaattaggggatggactcgcgatgggcatcatgattctgaagcttctgacggactttcaaagccaccagttgtgggccacactcctgtccctaaccttcgtgagaactaccttttcactgcattacgcatggaaaacaatggctatggtccttagcatcgtaagtctcttccccctgtgtttgtctactacctcccagaagacgacatggctgccggtgttactcggcagcctggggtgcaagcctcttaccatgtttctgattgccgagaataaaatctggggaaggaagtcgtggccattgaacgaaggtataatggccgttggcatcgtgtcaattctcctgtctagtctactgaaaaacgatgtcccccttgctgggcctctcatcgcaggaggcatgctgattgcctgttatgtgatctccggtagctctgcggacttgagcttagagaaggctgccgtagtgtcctgggaggaagaggcagaacactcaggggccagtcataatatactggtcgaggttcaggatgacggaactatgaaaattaaggatgaagagcgagacgatacactcaccatcctgcttaaagctactctgttggcagtgagcggcgtgtaccccctatctatcccagccacactgttcgtctggtatttctggcaaaagaagaaacagcgctccggcgtgctctgggacaccccttcacccccagaggttgaacgggcggtactggatgacgggatttacagaataatgcagaggggacttttaggtcgtagtcaggtgggcgtcggggtgtttcaagagaacgttttccacacgatgtggcatgtgactcgcggagctgtcctgatgtaccagggcaagcggctcgaaccgagctgggcctccgtgaaaaaggacttgatctcttatggtgggggatggagactgcagggctcgtggaataccggcgaggaggtacaggtcattgcagtggaacctgggaaaaaccccaagaatgttcaaacagccccaggaacctttaagacaagcgagggtgaagtgggcgctatcgccctcgatttcaaacccgggacttcaggatcccctattgtcaacagggagggcaagatcgtgggtctgtacgggaatggagttgtgaccacgagtggcacatatgtctctgcaatagctcaggccaaagcgagccaggaaggcccacttcccgagatcgaggacgaagtgtttcgaaagcggaacctgactattatggatttgcaccctgggtccggaaaaacccgcagatacctaccggccatcgtaagggaggcaattaagcggaagctgcgaacactcatcttagctccaaccagagtggttgcctcagaaatggctgaggcactgaaaggtatgcccatacgctatcaaactaccgccgtcaagtctgaacacacaggcaaagagattgtggaccttatgtgccatgccacgttcactatgaggctgctcagccctgtgcgtgtcccaaattacaacatgatcatcatggatgaggctcactttaccgaccccagttccattgcggcacgggggtatatcagcacaagagtaggaatgggcgaagccgctgccatattcatgaccgcaactcctccgggttctgtggaggcctttccccagtcaaatgctgttattcaggatgaagagagggacatcccagaacgctcctggaacagtgggtacgagtggattacagatttccctggaaagaccgtgtggtttgtccccagcatcaaatcgggcaatgacatagcgaactgtttgcgaaagaatggcaagagagtgattcagctgtctcggaaaacgttcgatactgagtaccaaaagacaaaaaacaacgactgggactatgttgtgaccaccgatatctccgaaatgggggccaatttcagggcagaccgcgtcatcgatccacgtagatgcctcaagcctgtgattctgaaagacggacccgagcgggtaatccttgctggtccaatgccggtgactgttgccagcgcagcccagaggcgcggccgaattgggagaaaccataataaggaaggagatcagtacatatatatgggccagcctctaaacaatgacgaggatcacgctcattggacagaggccaagatgctgttggacaacatcaatacccccgaaggtattatcccagcgttatttgagcccgaacgggagaaatcagcagccatcgatggggaatacaggctgcgcggcgaggctagaaagacattcgtcgagctcatgaggcggggagacctgcctgtgtggcttagttataaagtggcctctgaaggctttcaatactccgatcgtcgctggtgcttcgacggggagcgaaacaatcaggtcctggaagagaacatggatgttgaaatttggactaaggagggagagagaaaaaagctcaggccacggtggttggacgctcgcacgtatagcgaccccctggcactaagagaatttaaagagttcgccgctggtaggcggtcagtgagtggcgatctgatactcgaaatcgggaagcttcctcagcacctgacccagcgagcccaaaatgcattagacaacttggtaatgctgcacaatagcgagcagggaggcagagcgtaccgccatgccatggaagagctcccggatacaattgagactctgatgcttctggctctcatcgccgtgttgaccggtggggtcacactgtttttcttatccggcaggggactaggcaagacctctattgggctgctctgtgtgatggcaagctccgttcttctgtggatggcttcagtggaaccacactggatcgccgcatctataatcttggagtttttcctgatggtcctcctgattcccgaacctgaccggcagcgtactccccaggataaccaacttgcctacgtagtgatcggactcctgtttatgattttgacggttgctgcgaatgagatgggtctgttagagaccacaaaaaaggacctaggcatcgggcatgtggccgtcgaaaaccaccaccatgcagctatgctggatgtggacctccacccagccagtgcctggactctttatgcagtcgctaccacaataattacccctatgatgagacatactatcgagaacacaacggccaatatttcgctgaccgcgatcgctaaccaggccgcaatattgatgggactggataaaggctggcccatcagcaagatggacattggtgtgccactcctggcccttgggtgctactcccaggttaatcctttaactctgacagctgcagtgctcatgttggtagcccactatgcgatcattggcccgggactgcaagctaaagccaccagggaagcacagaagcgcaccgccgctggcatcatgaagaaccccacagtggatgggatagtcgccattgacctagatccagttgtgtacgacgcaaaattcgagaagcagctgggacagatcatgctccttatcctgtgtacttctcaaattttgctgatgcggacgacctgggctctctgcgaatcaatcacactggccactggccctttaaccacactttgggagggtagccccgggaaattttggaataccactatagcggtctccatggccaacattttccgaggaagttatctggcaggcgctggtctcgccttctctctaatgaagagcctgggcgggggaagaaggggcacgggggcacagggagagacattgggcgaaaaatggaagcgccagctgaatcagctctcaaagtccgagtttaacacctacaaacggagtggtatcatggaagtggacagaagcgaggctaaggaagggcttaaacgtggagagactaccaagcatgccgtatctaggggcacagccaaactgcggtggttcgtggagcgcaatttggttaagccagaaggtaaggtgattgatctgggctgtgggcgaggaggctggtcctattactgcgcggggctcaaaaaggtcactgaggtgaaaggatacaccaagggcggtcctgggcacgaagagcccatcccgatggctacatatggatggaacttagtcaaactgcactcaggcaaggacgtgtttttcataccacctgaaaaatgtgatacgcttctgtgcgacatcggcgagagctcgcccaatccaaccattgaggaagggagaactctaagggttctcaagatggtagagccctggctgcggggaaaccaattttgtatcaagattttgaatccttacatgccgtctgtggtcgaaacactggagcagatgcagcgcaaacatggtggcatgctcgtgagaaacccccttagtaggaattccacccacgagatgtattgggttagctgcgggactggaaacatcgtgtcagcagtcaatatgacatcccgaatgctgttaaaccggttcaccatggcccatcgtaagccaacgtacgaaagagatgtggacctgggcgctggtacccgccacgtagccgtggagcctgaagttgcaaacttggatattatcgggcagaggatagagaatattaaacacgaacataagtctacatggcactatgacgaggataacccctacaaaacttgggcctatcatggaagctacgaggtcaagcctagtggctccgctagctctatggtgaatggcgtggtcaagctcctgaccaaaccatgggacgttatccccatggtgacacaaatcgcgatgactgataccacaccttttgggcagcagcgggtattcaaggaaaaagtggacaccagaactccaaaggccaaacgcggaacggcacaaattatggaggtcacagctaagtggctatggggttttctttcaaggaacaagaaaccccgaatatgtacccgggaagagttcactagaaaggtgaggagtaatgccgcaatcggcgccgtttttgtggacgaaaaccagtggaattccgctaaagaggccgtcgaggatgaacgcttctgggacctggtgcaccgtgagcgggaactccataagcaggggaaatgcgcgacctgcgtatacaacatgatgggaaagagagagaagaaactgggcgaatttggtaaggcaaaagggagcagggccatttggtatatgtggttgggagctcgcttcctggagttcgaggccctcggctttatgaatgaagatcactggttctctcgagagaactcgctttcaggcgttgaaggggagggactgcacaagttaggttacatcctgcgggacattagcaaaatcccgggcgggaatatgtatgcagatgacacagctggatgggatacgagaataaccgaggacgatttgcagaacgaagccaagatcactgacattatggagcctgaacatgctctcctggccaaatccatctttaagctaacataccaaaataaggtggtcagggtgcagcgcccagcaaaaaacggcaccgtgatggatgtcattagtagacgggaccagaggggttctgggcaggttggaacttatggccttaatacattcaccaacatggaggcgcaactgatccgtcagatggaaagcgagggcatattttccccctcagagctcgaaacacctaacctggccgggcgagtgttggattggttagagaagcacggagtagaacgcctgaaaagaatggctattagtggtgacgactgtgtggtcaagccaatcgatgaccggttcgccactgcactcaccgctcttaatgatatgggcaaagtgaggaaggacatcccccagtgggagccgtctaaggggtggaacgattggcagcaagttcctttttgcagccatcacttccaccagctgattatgaaagacggacgcgaaatagtggtcccctgtagaaatcaggatgagctagtgggccgggccagggtatcccagggtgcagggtggtcactgcgagagacggcctgcctcggaaagagctacgcgcaaatgtggcagttgatgtattttcatcgtagagacctgcgccttgctgccaacgcaatctgttctgccgttccagtggattgggtccctacctcccggacaacttggagtattcacgctcatcaccagtggatgaccacagaagacatgctgagcgtgtggaatagggtttggatcgaggaaaacccctggatggaggataaaactcatatttcgtcctggggcgacgtgccatacctcggcaagagagaagaccaatggtgcgggtctttaatcggactgaccgcccgcgcaacgtgggctacaaatatacaggtcgccatcaaccaggtgcggaggttgctgggtaatgagaactacctcgattatatgacctcaatgaaacgattcaagaatgagagcgaccccgaaggcgcgctttggtga

SEQ ID NO: 13788 - RNA, 9879 nt, synthetic construct
  misc_feature 1..9879: note = derived and/or modified CDS sequence (opt3) from DENV-1__FJ882549__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagctgtgtgaagatactatgacctacaaatgcccacggataacagaggtggaaccggacgatgtagactgttggtgcaataccactgatacatgggtgacctatgggacgtgtagtcaaactggagagcaccgccgagacaagcgtagcgtcgcgcttgctccccatgtgggcctgggtttggagaccagagccgaaacatggatgtcctctgagggggcatggaaacagatccagaaggttgaaacttgggccctcaggcaccctggattcaccgtgattgctctgtttctggcacatgccatcggcacatcgattacccagaagggcatcatattcatcctcttaatgctggtcacgccatcaatggctatgcggtgcgtggggattggaagccgcgattttgtagagggtcttagtggcgccacttgggttgacgtggtcttggagcacgggtcctgtgtgacaaccatggcgaaagataagcccactctggacatcgaactactcaaaacagaggtgaccaaccctgcagtcctgagaaagctttgcattgaagccaaaatctctaatacgaccacagatagcaggtgtccaactcaaggagaggctaccctggttgaagagcaggacgccaacttcgtgtgccggcgcacatttgtagatcgaggctggggtaatgggtgtggattgttcggcaagggctccctcataacttgcgcaaagtttaaatgcgtgaccaagctggaggggaaaattgtccagtacgaaaacttaaagtattcagtgatcgttacagtgcacaccggagaccagcatcaagtcggtaatgagagtactgaacacggcacgacagctaccattactccccaggcccctaccagcgagatccagctgacagactacggggcgctcacccttgattgttctccaagaactggactggacttcaacgaaatggtgttgctaacaatgaaagagaagtcctggctggtacataaacagtggtttctcgatctgccgcttccctggacgtcaggcgccagcaccagtcaagagacttggaataggcaggacctgttggttacattcaagaccgcacacgctaagaaacaggaagtggtcgtgctcggttctcaagagggggccatgcacacagctctgactggcgccaccgaaatccagacgtccggaaccacaactatttttgcaggccatttaaagtgccggctgaaaatggataagctaaccctcaaagggatgagctatgtcatgtgtacaggatcgttcaagctggagaaggaagtggccgagactcagcacggtaccgttcttgtgcagataaaatacgagggcacggacgctccttgcaagatcccattctctacacaagatgaaaaaggggtaacccagaacggacgtttgattactgcgaatcccatcgtcacagacaaggagaaacctgtgaacatagaagcagagccaccctttggcgagtcctatattgttatcggtgccggggaaaaggctctgaagctctcatggttcaaaaagggcagtagcatcggaaaaatgtttgaggccaccgcacgcggcgccagaaggatggctattctgggggatactgcctgggacttcggatccatcggtggcgtgtttacctctgtcgggaagcttgtgcatcagattttcggaacagcatacggcgtactgtttagcggtgtgtcatggacgatgaaaatagggatcggcgttttgctcacctggctgggattaaatagtcggtccactagcctgtctatgacatgtattgcggtcggcctagtgaccctctacctgggggtgatggtccaggctgattcaggatgcgttatcaactggaagggccgagaacttaagtgtggtagtgggatcttcgtgacaaatgaggtgcacacttggaccgaacaatataaatttcaggccgacagcccgaagcgcttgtccgcagccattggaaaagcttgggaggagggcgtatgcggtataagatctgccacgaggctggaaaacatcatgtggcggcagatttcgaacgagctcaatcatatcctgttagaaaacgacatgaagttcacagtcgtggttggcgatgtggtcgggattctggcacagggaaaaaagatgatccgccctcaacccatggagcacaaatacagctggaagtcctggggcaaggctaaaataatcggggccgacgtgcagaataccacttttattatcgatggaccaaacacccctgaatgtcccgacgatcagagagcgtggaatatttgggaggttgaggactatggcttcggtatctttacaactaacatatggcttaagttgagggattcatacacccaggtgtgcgaccaccgtctcatgagtgccgctattaaagattctaaggcagtacatgccgacatggggtattggatcgaaagcgagaaaaatgaaacatggaagctggctcgggcctccttcattgaggtcaagacgtgtatctggccaaaatcacacaccctatggagcaacggagtgctggaatctgagatgataatccccaagatttacggcggtcctatctcccaacataattatcgaccaggctacttcactcagacagcagggccgtggcacctcggaaaactggagcttgattttgacttgtgcgaaggcaccactgtggtcgttgatgagcactgcgggaacagaggacccagtctgaggacaaccacggtgactggcaagattatccatgaatggtgttgccgcagctgtaccttacctccactccggttcaaaggtgaggacgggtgctggtacggaatggagataagacccgtaaaggaaaaggaggaaaatctggtgaaatctatggtctccgcgggctcaggtgaggtggacagttttagccttggcctgttgtgtatttcgatcatgatcgaagaggttatgaggtcccgctggtctcgaaagatgctcatgacagggaccctggccgtgttctttctactgattatgggacagctcacttggaacgatctgatccggagctgcattatggtcggcgctaatgcctcagaccgtatggggatgggaacaacctatcttgcattgatggctacattcaaaatgagacctatgtttgccgtgggcctgttattcaggcgcctcactagtcgggaggttctgcttctgaccataggtctatccctcgtggcatctgtcgaactgccaaacagcttggaggaactgggggatggattagccatgggcatcatgattctcaagctgcttacggactttcaatcctaccagctgtgggctacattgctctcactgaccttcatcaaaactacctttagcctacactatgcgtggaagacaatggccatggtactgagtattgtgtctcttctccccctgtgtttgtccactaccagccagaagacgacatggctgccggttttactcggctcgctggggtgcaaacctcttaccatgttcctgatcgcagagaataagatatggggaagaaaatcatggccattgaacgaaggtatcatggctgtgggcattgtctctatcctcctgagttccctactgaagaacgatgtgccccttgccgggcctctcattgccggaggcatgctgatcgcttgttacgtaataagcggttctagcgcagacttgtccttagagaaagccgcggaggtgtcatgggaagaggaagctgagcatagtggggccagccacaatattctggtcgaagttcaggatgacggaactatgaagatcaaagatgaggagagggacgatacactcaccatcctgcttaaggcaactctgttggccgtgtctggcgtgtatcccctatccattccagctacactgtttgtctggtacttctggcaaaagaaaaagcagcgatcaggcgtgctctgggacacccctagtcccccagaagttgagcgcgcagtactggatgacgggatatatcggatcatgcagagaggacttttaggtaggagccaggtgggcgtcggggtgttccaagaaaacgtttttcatacgatgtggcacgtgactcgtggagccgtcctgatgtaccagggcaaacgcctcgagccgtcctgggcgtctgtgaagaaagacttgatttcgtacggtgggggatggcggctgcagggcagctggaataccggcgaggaagtacaggtcatcgctgtggagcctgggaagaaccccaagaatgttcaaacagccccaggaaccttcaaaacacccgaaggtgaggtgggcgcaattgccctcgattttaagcctgggacttcaggatccccaatcgtcaacagagaaggcaaaatagtgggtctgtatgggaatggagttgtgaccacgagtggcacatacgtctctgctatcgcccaggcaaaggctagccaggagggcccccttcctgagattgaagacgaggtgttcaggaaacgaaacctgactatcatggatttgcacccggggtccggaaagacccggcgctatctaccagccattgtaagagaagcgatcaagaggaaactgcggacactcatattagcccccacccgagtggttgcatcagagatggctgaagccctgaagggtatgcctattagataccaaactaccgctgtcaaatctgagcatacaggccgcgagatcgtggaccttatgtgccacgcaacgtttactatgaggctgctcagcccagtgcgtgtccccaattataacatgatcattatggatgaagcccatttcaccgaccctagttccatcgccgctcgggggtacataagcacaagagtaggaatgggcgaggcggcagccatttttatgaccgctactccgcccggttctgtggaagccttcccacagtcaaatgcagttatccaggatgaggaaagggacattcctgagcgctcctggaacagtgggtatgagtggatcacagattttcccggaaagaccgtgtggttcgtcccaagcataaaatcgggcaatgacattgccaactgtttgcgaaagaatggcaagagagtgatccagctgtctcggaaaacgtttgatactgaataccaaaagacaaaaaacaacgactgggactacgttgtgaccaccgatatctccgagatgggggctaatttcagggcggaccgcgtcattgatcctcgtagatgcctcaagcccgtgatcctgaaagacggaccagaacgggtaattcttgccggtccgatgcctgtgactgttgcaagcgctgcccagaggcgcggccgaatagggagaaaccacaataaggagggagatcagtatatctacatgggccagcccctaaacaatgacgaggatcatgcacactggacagaagccaagatgctgttggacaacattaataccccagagggtatcatccccgctttattcgaacctgagcgggaaaaatcagccgcgattgatggggagtataggctgcgcggcgaggcaagaaagacatttgtcgaactcatgaggcggggagacctgccagtgtggcttagttacaaagtggcctctgagggcttccaatattccgatcgtcgctggtgctttgacggggaacgaaacaatcaggtcctggaggaaaacatggatgttgagatatggactaaggagggagaaagaaaaaagctcaggccccggtggttggacgctcgcacgtacagcgaccctctggccctaagagagttcaaagaatttgctgcaggtaggcggtcagtgagtggcgatctgatcctcgagattgggaagcttccgcagcacctgacccagcgagcccaaaatgctttagacaacttggtaatgctgcataatagcgaacagggaggcagagcctatcgccacgcaatggaggagctcccagatacaatcgaaactctgatgcttctggcgctcattgccgtgttgaccggtggggtcacactgttctttttatccggcaagggactaggcaaaacctctatcgggctgctctgtgtgatggctagctccgcccttctgtggatggcatcagttgagccccattggatagctgcctctatcattttggaattctttctgatggtgctcctgatccctgagcccgacaggcagcggactccacaggataaccaacttgcatacgtcgtaattggactcctgttcatgatcttgacggtggccgctaatgagatgggtctgttagaaaccacaaagaaagacctaggcatagggcacgttgcggtggagaaccaccatcacgccactatgctggatgtcgacctccatcctgcaagtgcttggaccctttacgccgtggccacaaccattatcactcccatgatgcgtcacacaattgaaaacacgaccgcaaatatctcgctgactgctatagccaaccaggcggctatcttgatgggactggataagggctggccaattagcaaaatggacatcggtgtccctctcctggcccttgggtgctattcccaggtgaatccgttaacactgaccgcagccgttctcatgttggtggctcattacgcaattatcggccccggactgcaagccaaggcgaccagagaggctcagaagaggacagccgcaggcataatgaaaaacccaactgtagatgggattgtggccatcgacctagatcctgtcgtttatgacgctaagtttgaaaaacagctgggacagatcatgctccttattctgtgtacgtctcaaatcttgctgatgcgcaccacatgggccctctgcgagtcaataactctggcaaccggccccttaacaaccctttgggagggtagcccagggaagttctggaatactacgattgctgtgtccatggccaacatctttcggggaagttacctggcgggcgccggtctcgcattctctctaatgaaaagcctgggcgggggacgaagaggcacaggggctcagggagaaaccttgggcgagaagtggaagaggcagctgaatcagctctcaaaatccgaattcaacacttataagcgcagtggtattatggaggtcgaccggagcgaagccaaagaggggcttagacgtggagagaccacaaagcacgcagtgtctaggggcactgctaaactgcggtggtttgtagaacgcaatttggtgaagcctgagggtaaggttatcgatctgggctgtgggcgaggaggctggtcctactattgcgccgggctcaaaaaggtgaccgaagtcaaaggatacacaaagggcggtcccgggcacgaggaaccgataccaatggccacgtacggatggaacttagtgaaactgcattcaggcaaggacgtcttctttatccctcccgagaaatgtgatacccttctgtgcgacattggcgagagctcgccaaatcccactatcgaagaggggagaacactaagggtgctcaagatggttgaaccttggctgcggggaaaccaattctgtattaagatcttgaatccgtatatgccctctgtagtggagaccctggagcagatgcagcgcaaacacggtggcatgctcgtcagaaacccacttagtaggaattccactcatgaaatgtactgggtgagctgcgggacaggaaacattgtttcagcggtgaatatgacctcccgaatgctgttaaaccggtttacgatggctcaccgtaagcctacctatgagagagatgtcgacctgggcgcaggtacacgccacgtggccgtagaacccgaggtggctaacttggatatcatagggcagaggattgaaaatatcaaacatgagcacaagtctacttggcattacgacgaggataacccttataaaacctgggcctaccacggaagctatgaagttaagccaagtggctccgcaagctctatggtcaatggcgtggtgaagctcctgacaaaaccctgggacgtcatccctatggttactcaaattgccatgaccgatacaaccccattcgggcagcagcgggtgctaaaggagaaagtagacactagaacgcccaaggctaaacgcggaacagcgcaaataatggaagtgaccgccaagtggctttggggttttctgtcaaggaacaagaaaccgcgaatctgtactcgggaggaattcaccagaaaggtcaggagtaatgcagctattggcgccgtgtttgttgacgagaaccagtggaattccgcaaaagaggccgtggaagatgagcgcttctgggacctcgtccatcgtgaacgggagctgcacaagcaggggaaatgcgctacatgcgtgtacaacatgatgggaaagagagaaaagaaattgggcgagtttggtaaggccaaagggagcagggcgatctggtacatgtggctgggagcacgcttcctcgagtttgaagcccttggcttcatgaatgaggatcactggttctctcgagaaaactcgctgtcaggcgtagagggggagggattacataagctgggttatattttgcgggacatcagcaaaatacctggcgggaatatgtacgctgatgacacggccggatgggataccagaatcactgaagacgatctccagaacgaggcaaagattacagacatcatggaaccagagcacgctctgctagccacctccatttttaaacttacttatcaaaataaggttgtgagggtccagcgccccgctagaaacggcacagtgatggatgtgatcagtcggagggaccagcgtggttctgggcaggtcggaacctacggcctgaatacattcactaacatggaagcccaactcatacgacagatggagagcgagggcattttttccccttcagaactggagaccccaaacttggcagaacgcgttttagattggctggagaagcatggggtggaaagactcaaacggatggcgatcagtggagacgactgtgtagtgaagcccatcgatgacaggttcgccacggctctttctgccctgaatgatatgggtaaagtccgcaaggacattccgcagtgggagcctagcaaaggctggaacgattggcagcaagtgcccttttgctcccaccacttccatcagctaataatgaaggacgggagagagatcgttgtgccatgtcggaatcaggatgaactggtcggaagggcacgagtgtcacagggcgctggttggagcctccgtgagaccgcctgcttggggaagtcttatgcacaaatgtggcagctgatgtactttcacagacgcgaccttcggctggccgcgaacgctatttgttccgccgtacctgttgattgggtgcccacaagtaggactacctggagcatccatgcacaccatcagtggatgacaactgaagacatgctctcggtctggaatagagtgtggattgaggaaaacccatggatggaggataaaacccacatctcctcttggggagacgttccctatttaggcaagcgcgaggaccaatggtgcggctcactgatagggttgacggcccgggctacatgggccaccaatatccaggtggcaattaaccaggtcaggcgactgatcggaaatgaaaactacctcgattacatgactagcatgaaaagattcaagaatgagagtgaccctgaaggtgctctttggtga

SEQ ID NO: 13789 - RNA, 9879 nt, synthetic construct
  misc_feature 1..9879: note = derived and/or modified CDS sequence (opt3) from DENV-1__GQ199814__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagttctgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagagcaggacgcaaactttgtttgccgccgaacattcgtggatagaggctggggtaatgggtgtggactgtttggcaaaggctccttgataacttgcgctaagttcaagtgcgtaaccaaactcgaggggaagattgtgcagtacgaaaacctgaaatattcagtcatcgtgacagttcacaccggagaccagcatcaagtgggtaatgagagtactgaacacggcacgacagccaccattactccccaggcgcctagcaccgagatccagttaacagactacggggccctgaccctcgattgttctccaaggactggacttgactttaacgaaatggtcctgttgacaatgaaggagaaatcctggctagtgcataagcagtggttcctggatctcccgctgccctggacgtcaggcgcaagcaccagtcaagagacttggaatcggcaggaccttctggtaacatttaaaaccgctcacgccaagaagcaggaagttgtggtcttgggttctcaagagggggctatgcacacagccctcactggcgcaaccgaaatccagacgtccggaaccacaactattttcgccggccatctgaaatgccgtttaaagatggataaactgaccctaaaggggatgagctatgtgatgtgtacaggatcgttcaaactcgagaaggaagtcgctgagactcagcacggtaccgtgctggttcagataaagtacgagggcacggacgcgccttgcaaaatcccattttctacacaagatgaaaagggggtgacccagaacggacgccttattactgcaaatcccatcgtaacagacaaagataagcctgtcaacatagaggccgaaccacccttcggcgagtcctatattgtgatcggtgctggggagaaagccttgaagctgtcatggtttaagaaaggcagtagcatcggaaagatgttcgaagcaaccgccagaggcgctaggcggatggccattctcggggacactgcatgggattttggatccatcggtggcgttttcacctctgtggggaaactggtccatcagatttttggaacagcgtacggcgtgcttttcagcggtgtatcatggacgatgaagatagggatcggcgtgctgttgacctggctcggactgaatagtcgatccactagcttatctatgacatgtattgctgttggcctggtcaccctatacctcggggtgatggtgcaggccgactcaggatgcgtcatcaactggaaaggccgcgagctgaagtgtggtagtgggatctttgttacaaatgaagtgcacacttggaccgagcaatataagttccaggcagacagcccgaaaagactttccgccgctattggaaaggcctgggaagagggcgtgtgcggtataaggtctgcaacgcggttggagaacatcatgtggaaacagatttcgaacgaactgaatcatatcctcctggagaacgatatgaagtttacagtagtcgtgggcgacgttgctgggattttagcccagggaaaaaagatgatccgccctcaacccatggaatacaaatatagctggaagtcctggggcaaggcgaaaataatcggggccgatgtgcagaataccactttcattatcgacggaccaaacacccctgagtgtcccgatgaccagagagcttggaatatttgggaagtcgaggattacggctttggtatcttcacaactaacatatggctgaagcttagggactcatatacccaggtgtgcgatcaccgtttgatgagtgcagccattaaagactctaaggctgttcacgccgatatggggtactggatcgagagcgaaaaaaatgagacatggaagctcgcacgggcgtccttcattgaagtgaagacgtgtatctggccaaaatcacataccctgtggagcaacggagtactagagtctgaaatgataatccccaagatttatggcggtcctatctcccaacacaattaccgaccaggctactttactcagacagccgggccgtggcatctgggaaaactcgagctggacttcgatctttgcgagggcaccactgtcgtggtggacgaacactgcgggaacagaggacccagtttgaggacaaccacggtcactggcaagattatccacgagtggtgttgccgcagctgtaccctgcctccattacggtttaaaggtgaagacgggtgctggtatggaatggagataagacccgttaaggagaaggaagagaatctcgtgaaatctatggtatccgctggctcaggtgaagtggatagtttcagcctgggccttctgtgtatttcgatcatgacagaggaagtcatgaggtcccgctggtctcgaaagatgttgatgaccgggactctcgccgtgtttttcctgctaatcatgggacagctgacatggaacgacctcattcggctgtgcatcatggttggcgcaaatgctagcgatcgtatggggatgggaaccacataccttgccttgatggcaacttttaaaatgagacctatgttcgccgtgggcctgttatttaggcgcctcacctcacgggaggtcctgcttctgacgattggtctaagtctcgtggcttccgttgagctgccaaactctttggaagagctgggggacggattagcgatgggcataatgatcctcaagctgcttacagatttccaaagccatcagctgtgggccaccttgctctccctgacttttattaaaaccacattctcactacactatgcatggaagactatggctatggtgctgagcatcgtcagtctttttcccctctgtctgtctaccacgtcccagaagacaacctggttgccggtactgttaggcagcctcgggtgcaaacctctgactatgttccttattgccgaaaataagatctggggaagaaaatcgtggccactgaacgagggtataatggccgtgggcatcgtttcaattttgctctctagtctgctaaagaacgacgtgcccctggctgggcctcttatcgcaggaggcatgctcattgcctgttacgtcatctccggtagctctgcggatctgagcttggaaaaagctgccgaggtgtcctgggaggaagaggcagaacattcaggggccagtcacaatatattagtagaggtgcaggacgatggaacaatgaagattaaagacgaagagagggatgacaccctgactatcctcctgaaggctacacttctggcagtcagcggcgtttatcccttgtctatcccagccaccctattcgtgtggtacttttggcaaaagaaaaagcagcgatccggcgtgctgtgggatacgccttcacccccagaggtcgaacgcgcggtgctcgacgacgggatttatcggataatgcagagaggactgcttggtaggagtcaggttggcgtaggggtgttccaagagaacgtctttcatactatgtggcacgtgacccgtggagctgttttaatgtaccagggcaaacgcctggaaccgagctgggcctccgtgaagaaagatctcatctcttacggtgggggatggcggttgcagggctcgtggaatacaggcgaggaggtccaggtgattgcagtagaacctgggaagaaccccaagaatgtccaaaccgccccaggaacattcaaaactagcgagggtgaagtgggcgctatcgccctggactttaagcccgggacctcaggatcccctattgttaacagagagggcaaaatcgtgggtctctatgggaatggagtcgtgacgacaagtggcacttacgtttctgcaatagctcaggccaaggcgagccaggaaggcccactgcccgagatcgaggatgaagtgttcaggaaacgaaaccttaccattatggacctgcaccctgggtccggaaagacacggcgctatttgccggccatcgtcagagaggcaattaagaggaaactacggaccctgatcctcgctccaactcgagtggtagcctcagaaatggctgaggcattaaagggtatgcccataagataccaaaccacagccgtgaaatctgaacatacgggcaaggagattgttgatctgatgtgccacgccacttttaccatgcgccttctgagccctgtcagggtgccaaattataacatgatcatcatggacgaggctcatttcacagatcccagttccattgcggcacgtgggtacatcagcacccgggtgggaatgggcgaagccgctgccatatttatgactgcaacacctccgggttctgtcgaggccttcccccagtcaaatgctgtaattcaggacgaagagagagatatcccagaaaggtcctggaacagtgggtatgagtggattaccgactttcctggaaaaacggtgtggttcgttcccagcatcaagtcgggcaatgatatagcgaactgtctccgcaagaatggcaaacgagtgattcagttgtctagaaagactttcgacacagagtaccaaaaaaccaagaacaacgactgggattacgtcgtgaccactgacatctccgaaatgggggccaattttcgggcagatagggttatcgacccacgccgttgcctgaaacctgtgattctcaaggatggacccgagagagtcatcctggctggtccaatgccggtgacagtagccagcgcagcccagcggaggggccgcattgggcgaaaccacaataaggaaggagaccagtatgtgtacatgggccagcctcttaacaatgatgaggaccatgctcactggaccgaggccaaaatgctactggataacataaatacacccgaaggtatcattccagcgttgttcgagcccgaaagagagaagtcagcagccatcgacggggaatatcggttaaggggcgaggctcgcaaaacttttgttgagctgatgagaaggggagatctccctgtctggctgagttacaaggtggcctctgaaggcttccaatattccgaccggcgttggtgctttgatggggagcgcaacaatcaggtgcttgaagagaacatggacgtcgaaatctggacgaaagagggagagcgaaagaaactgagaccaaggtggctcgacgctcggacctacagcgatcccttggcactgcgcgaattcaaggagtttgccgctggtagaaggtcagttagtggcgacctaattctggaaatagggaagctccctcagcaccttacacagcgggcccaaaatgcactggataacttagtgatgttgcataatagcgagcagggaggccgagcgtatagacacgccatggaagagctgccggacactatcgagaccctcatgctgcttgctctgattgccgtactcacaggtggggtgaccttgttctttctgtccggccgcggattaggcaaaacttctatcgggctactgtgtgtcatggcaagctccgtgctcctttggatggcttcagttgaaccacattggattgccgcatctatcatactggagttctttttgatggtgctgctcatccccgaacctgataggcagcggacgccccaggacaaccaactggcctacgtcgtaattggacttctcttcatgatcctgaccgtggctgcgaatgagatgggtttgctggagacaactaagaaagatttaggcattgggcacgttgccgtggaaaaccaccatcacgcagctatgctagacgtcgatctgcatccagccagtgcctggaccctctacgcagtggctacaaccatcataactcctatgatgcgtcacacaattgagaacacgaccgccaatatctcgcttactgcgattgctaaccaggccgcaatcctgatgggattggacaagggctggcccataagcaaaatggatatcggtgtcccactgctcgccctggggtgctattcccaggtgaatcctcttacattaaccgctgcagttctgatgctcgtggcccattacgcgattatcggcccgggattgcaagctaaggccaccagagaagcacagaagaggacagccgctggcattatgaaaaaccccactgtagacgggatcgtggccatagatctggacccagtcgtttatgacgcaaagtttgagaaacagctaggacagattatgctgctcatcctttgtacgtctcaaatcctgttgatgcgcaccacatgggctctgtgcgaatcaattactctcgccaccggccctctgacaaccttatgggagggtagccccgggaagttctggaatactacgatcgcggtgtccatggccaacatattccggggaagttaccttgcaggcgctggtctggccttttctctcatgaaaagcctaggcgggggacgaagaggcacaggggcacagggagagaccctgggcgaaaagtggaagaggcagttgaatcagctgtcaaaatccgagttcaacacttataagcgcagtggtattatggaagtcgatcggagcgaggctaaagaagggctcaagagaggagagaccacaaaacacgccgtgtctcgtggcactgccaagcttaggtggtttgtagagcggaatctggtgaagccagaaggtaaagttatcgacttgggctgtgggcgcggaggctggtcctactattgcgcggggctgaagaaagtgaccgaggtcaagggatacacaaaaggcggtcctgggcacgaagagcccattccgatggctacgtacggatggaacctcgtgaagttacattcaggcaaagatgtcttctttatcccacctgaaaagtgtgacaccctgctttgcgatataggcgagagctcgcccaatccaactatcgaggaagggcgaacactgagagtgctaaagatggttgagccctggctcaggggaaaccaattctgtattaaaatcctgaatccttatatgccgtctgtagtggaaaccttggagcagatgcagcggaagcacggtggcatgctggtccgcaaccccctcagtagaaattccactcatgagatgtactgggtgagctgcgggacaggaaacattgtttcagcagtgaatatgacctccaggatgcttctgaaccgatttacgatggcccaccggaaaccaacctatgaacgtgacgtcgatttaggcgctggtacaagacacgtggccgtagagcctgaagtggcaaacctggacatcattgggcagcgcatcgagaatataaagcatgaacacaaatctacttggcattacgatgaggacaacccctataagacctgggcctaccacggaagctatgaggttaagcctagtggctccgctagctctatggtcaatggcgtggtgaaattgctcacaaagccatgggatgtcattcccatggttactcaaatcgcgatgaccgacacaacccctttcgggcagcagagggtgtttaaagaaaaggtagacactcggacgccaaaagccaagagaggaacagcacaaatcatggaggtgaccgctaagtggctgtggggtttcctatcacgcaacaaaaagcccaggatttgtactcgagaagagtttacccggaaagtcagaagtaatgccgcaataggcgccgtgttcgttgatgaaaaccagtggaattccgctaaggaggccgtggaggacgaaaggttttgggatcttgtccatcgcgagcgtgaactgcacaaacaggggaagtgcgcgacatgcgtgtacaacatgatgggaaagcgggagaaaaagctcggcgaattcggtaaagcaaaggggagcagagccatctggtacatgtggctgggagctaggttcttggagtttgaggccctgggcttcatgaatgaagaccactggttttctcgcgagaactcgctctcaggcgtagaaggggagggacttcataaactgggttatattttacgagatatcagcaagattccgggcgggaatatgtacgcagacgatacggctggatgggacacccggatcactgaggatgacctgcagaacgaagccaaaataacagatatcatggagcctgaacacgctttgctcgccaagtccattttcaagctgacctatcaaaataaagttgtgagagtccagaggccagcaaagaacggcactgtgatggacgtgatcagtcgcagagatcagcggggttctgggcaggtcggaacatacggcctaaatacctttacaaacatggaggcgcaacttattaggcagatggaaagcgagggcatcttctccccctcagagctggaaactcctaacctcgccgggcgtgttctggactggttggagaaacatggagtggaacgattaaagcgcatggctataagtggtgacgattgtgtagtgaaaccaattgacgatagatttgccaccgcactgacggctctcaatgacatgggcaaggtccggaaggatatcccccagtgggagccgtctaaagggtggaacgactggcagcaagtgcctttctgcagccaccactttcatcagcttatcatgaaggatggaagggaaattgttgtgccctgtcgcaatcaggacgagctggtcggcagagcccgggtgtcccagggtgcagggtggtcactaagggagaccgcctgcctgggaaaaagctatgcgcaaatgtggcagctcatgtacttccaccgacgtgatttgagactggctgccaacgcaatatgttctgccgtaccagttgactgggtgcctacatcccgcactacctggagtatccatgctcaccatcagtggatgacaactgaagatatgcttagcgtctggaatcgggtgtggattgaggaaaacccctggatggaggacaagacccacatctcgtcctggggcgacgttccatatctgggcaaaagggaagatcaatggtgcgggtctctcattggattaacggccagagcaacatgggctaccaatatccaggtggccataaaccaggtccgccggctgatcggtaatgagaactacttggactacatgacttcaatgaagaggtttaagaatgagagcgatcccgaaggcgcgctgtggtga

SEQ ID NO: 13790 - RNA, 9879 nt, synthetic construct
  misc_feature 1..9879: note = derived and/or modified CDS sequence (opt3) from DENV-1__GQ199816__SS-prME
  source 1..9879: mol_type = other RNA
agcgtgaccatgctgctcatgcttatgcccaccgcactggctttccacttgactacgagaggaggggaacctcatatgatcgtctccaagcaggaaaggggaaaatctttactgtttaagacctcagccggtgttaacatgtgcaccctgattgccatggacctcggcgagttctgtgaagatactatgacctacaaatgcccacggataacagaagcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagaaggtggaaacttgggctttgaggcaccctggatttaccgttattgcactcttcctggcccatgctatcggcacatcgattacccagaagggcatcatatttatcctgctcatgttagtgacgccatcaatggccatgcggtgcgtcgggattggaagccgcgatttcgtggagggtctgagtggcgcgacttgggtagacgttgtgcttgagcacgggtcctgtgtcacaaccatggcaaaagataagcccactttggacatcgaactgctaaaaacagaggtgaccaaccctgccgtgctcagaaagctgtgcattgaagctaaaatctctaatacgaccacagattccaggtgtccaactcaaggagaggccacccttgtcgaagaacaggacgcaaactttgtttgccggcgcacattcgtggatcgaggctggggtaatgggtgtggactgtttggcaagggcagcttgataacttgcgctaagttcaaatgcgtaaccaagctcgaggggaaaacagtgcagtacgaaaacctgaagtattcagtcattgtgaccgttcacactggagaccagcatcaagtgggtaatgagagtacggaacacggcacaaccgccactatcacaccccaggcgcctagcacagagattcagttaaccgactacggggccctgactctcgattgttctccaagaacaggacttgactttaacgaaatggtcctgttgacgatgaaagagaaggcatggctagtgcataaacagtggttcctggatctcccgctgccctggacctccggcgcttcaactagccaagagacatggaataggaaggaccttctggtaacctttaagacagcccacgctaaaaagcaggaagttgtggtcttgggtagtcaggagggggccatgcacactgcactcaccggcgccacggaaatccaaacctctggaacaactaccatcttcgctggccatctgaaatgccggttaaagatggataaactgacactaaaggggatgtcctatgtgatgtgtactgggtccttcaagctcgagaaagaagtcgcggagacccagcacggtacggtgctggttcagattaagtacgagggcacagacgcaccttgcaaaataccattttcgacccaggatgaaaagggggtgactcaaaacggacgtcttatcacagccaatcccattgtaaccgacaaagagaagcctgtcaacatcgaagctgagccacccttcggcgagtcttatatagtgattggtgccggggaaaaggcattgaaactgtcctggtttaagaaaggctcaagtatcggaaagatgttcgaggccactgctcgcggcgccagaaggatggcaatcctcggggataccgcgtgggactttggaagcattggtggcgttttcacatccgtggggaaactggtccatcagatctttggaacggcttacggcgtgcttttctctggtgtaagctggaccatgaagattgggataggcgtgctgttgacttggctcggactaaattcacggagtacatccttaagcatgacctgtatcgccgttggcctggtcacactatacctcggggtgatggtgcaggcagattctggatgcgtcattaactggaagggccgagaactgaaatgtggttcagggatctttgttactaatgaggtgcacacctggacggaacagtataagttccaagccgacagtccgaaacgccttagcgctgccatcggaaaggcatgggaggagggcgtgtgcggtattagatccgctacaaggttggaaaacataatgtggaaacagatctctaacgagctgaatcatattctcctggaaaacgacatgaagtttaccgtagtcgtgggcgatgttgccgggatcttagcgcagggcaagaagatgattcggcctcagcccatggagtacaagtattcgtggaaaagctggggcaaggccaaaatcataggggctgacgtgcaaaatgcaactttcatcattgatggaccaaacacccctgaatgtcccgacgatcagcgcgcctggaatatctgggaggtcgaggactacggctttggtattttcacaactaacatctggctgaaacttagagattcctatacccaggtgtgcgaccacaggttgatgtcagctgccataaaagatagtaaggcagttcacgcggacatggggtactggattgaatctgagaagaatgaaacatggaaactcgcccgtgctagcttcatcgaggtgaagacgtgtatttggccaaaatcccataccctgtggtcaaacggagtactagaaagcgagatgatcatacccaagatctatggcggtcctatttctcagcacaattaccggccaggctactttactcaaacagccgggccgtggcatctgggaaaactcgagctggatttcgacctttgcgaaggcaccactgtcgtggtggatgagcactgcgggaaccgaggaccctccttgagaacaaccacggtcactggcaagatcattcacgaatggtgttgcaggagttgtaccctgcctccattacgctttaagggtgaggacgggtgctggtatggaatggagatccggcccgttaaagaaaaggaggaaaatctcgtgaaaagcatggtatctgcaggctccggtgaggtggactcattcagtctgggccttctgtgtataagcattatgatcgaagaggtcatgagatcgaggtggtcccgcaagatgttgatgacagggatcctcgctgtgtttttcctgctaattatgggacagctgacctggaacgatctcatccgactgtgcattatggttggcgccaatgcatctgaccggatggggatgggaactacataccttgccttgatggctacctttaaaatgcgtcctatgttcgcggtgggcctgttatttagaaggctcacaagccgcgaggtcctgcttctgactataggtctatcactcgtggccagtgttgaactgccaaactccttggaggaactgggggatggattagcaatgggcatcatgattctcaagctgcttaccgacttccagtctcatcaactgtgggctacgttgctcagcctgacatttatcaagaccactttctccctacactatgcctggaaaaccatggccatggtgctgtcaattgtcagcctttttcccctctgtctgagtacaacttctcagaagaccacgtggttgccggtactgttaggctccctcgggtgcaaacctctgacaatgttccttatcgctgagaataagatatggggacggaaaagctggccactgaacgaaggtatcatggcagtgggcattgtttcgatcttgctctcatctctgctaaagaacgatgtgcccctggccgggcctcttattgcgggaggcatgctcatcgcttgttacgtcataagtggttccagcgccgacctgtctttggagaaagcagccgaggtgagctgggaagaggaagctgagcattccggggcatcacacaatattttagtagaagtgcaggatgacggaaccatgaagatcaaggatgaggagagagacgatactctgacaatcctcctgaaagccacccttctggcggtcagtggcgtttatcccttgagcattccagctactctattcgtgtggtacttttggcagaagaaaaagcaaaggtctggcgtgctgtgggacacaccttcacccccagaagtcgagcgagccgtgctcgatgacgggatatatcgcatcatgcagcggggactgcttggtagaagccaggttggcgtaggggtgttccaggaaaacgtctttcataccatgtggcacgtgacgaggggagcagttttaatgtaccaaggcaaacgtctggagccgagttgggccagcgtgaagaaggacctcatttcctacggtgggggatggcgcttgcagggctcttggaatactggcgaggaagtccaggtgatcgctgtagagcctgggaaaaaccccaagaatgtccagaccgccccaggaacattcaaaacctcggaaggtgaggtgggcgcaattgctctggattttaagcccgggacaagcggatcacctatcgttaaccgggaaggcaaaatagtgggtctctatgggaatggagtcgtgactacctccggcacgtacgttagtgccatcgcgcaagccaaggcatctcaggagggcccactgcccgagattgaagacgaggtgttcagaaagaggaaccttacaatcatggatctgcaccctgggagcggaaaaactcgacggtatttgccggctattgtccgcgaagccatcaagagaaaactaaggaccctgatactcgctccaacacgggtggtagcatccgagatggccgaagccttaaagggtatgcccattcgataccagaccactgctgtgaaatcagagcataccggcaaggagatcgttgacctgatgtgccacgcgacatttacgatgagacttctgtctcctgtccgcgtgccaaattataacatgatcattatggatgaagcacatttcactgaccccagcagtatcgccgctagggggtacatatccacccgtgtgggaatgggcgaggccgcagccatttttatgacagctacccctccgggtagcgtcgaagcgttcccccaatctaatgccgtaatccaggatgaggaacgggacattccagagagatcatggaactccgggtatgagtggatcactgattttcctggaaagacagtgtggttcgttcccagtataaaaagcggcaatgacattgcaaactgtctcaggaagaatggcaaacgcgtgatccagttgtcgcgaaagaccttcgatacggaataccagaaaactaagaacaacgactgggactacgtcgtgacaaccgatatctctgagatgggggctaattttagagccgaccgggttattgatccaaggcgctgcctgaagcctgtgatcctcaaagacggacccgaacgtgtcattctggcaggtccaatgccggtgaccgtagcctccgctgcccaaagacggggcaggatagggcgcaaccacaataaggagggagatcagtatatctacatgggccagcctcttaacaatgacgaggatcatgcgcactggactgaagcaaaaatgctactggacaacattaatacacccgagggtatcatcccagccttgttcgaacccgagcgagaaaagagcgctgccattgatggggagtatagattacggggcgaggctaggaaaacctttgtggaactgatgcgcagaggagacctccctgtttggctgtcatacaaggtcgcaagtgagggcttccagtattctgataggcggtggtgctttgacggggaacgtaacaatcaagtgcttgaggaaaacatggatgtggagatatggacaaaagagggagaacgcaagaagctgcgaccaagatggctcgacgccaggacttactccgaccccttggctctgcgggagttcaaagaatttgccgcaggtcgcagaagcgtctcaggcgatctaatcctggagattgggaagctccctcagcaccttacgcagagggcgcagaatgccctggacaacttagttatgttgcataatagtgaacaaggaggccgggcttatcgacacgccatggaggagctgccggataccatcgaaacactcatgctgcttgcactgattgctgtgctcactggtggggtaaccttgttctttctgagcggcagaggattaggcaaaacatccatcgggctactgtgtgtgatggcctctagcgtcctcctttggatggcatccgtggagccacattggatagccgcttcaatcattctggagttctttttgatggttctgctcatccccgagcctgaccgccagaggacaccccaggataaccagctggcgtacgtggtcattggacttctcttcatgatcctgactgtagccgcaaatgagatgggtttgctggaaacgaccaagaaagacttaggcatagggcacgtggctgttgagaaccaccatcacgccgccatgctagatgtggacctgcatccagcatctgcttggacactctacgccgtcgcgactaccattatcacacctatgatgcggcacaccattgaaaacactacagctaatatcagtcttacggccatagcaaaccaagccgctatcctgatgggattggataagggctggcccatttcgaagatggacatcggtgtgccactgctcgcactggggtgctatagccaggtcaatcctcttaccttaactgccgcggtgctgatgctcgttgctcattacgccattatcggcccgggattgcaggcaaaagccacacgtgaggctcaaaagagaaccgccgcaggcataatgaaaaaccccaccgtggatgggattgtagctatcgacctggatccagtggtctatgacacaaagtttgaaaaacagctaggacagatcatgctgctcattctttgtacttcccagatcctgttgatgaggacgacctgggccctgtgcgagtctataacactcgcgactggccctctgaccacattatgggagggttcacccgggaagttctggaataccactattgccgttagcatggcaaacatcttccgcggatcctaccttgctggcgccggtctggcatttagtctcatgaagtctctaggcgggggacggcgaggcacgggggctcaaggagaaacactgggcgagaaatggaagagacagttgaatcagctgagcaaatcagagttcaacacctataagaggtccggtattatggaggtggaccgcagtgaagccaaagaggggctcaagcggggagagactaccaagcacgccgtcagcagaggcacagcgaaacttcgttggtttgtggaaaggaatctggtaaagccagagggtaaagtgatcgatttgggctgtgggcggggaggctggtcttactattgcgctgggctgaagaaagttactgaagtgaagggatacaccaaaggcggtcctgggcacgaggaacccataccgatggcaacatacggatggaacctcgtcaagttacattccggcaaggacgtgttctttatcccacctgagaaatgtgatacgctgctttgcgacattggcgagtcaagccccaatccaaccatcgaagaggggcgcactctgcgagtcctaaagatggtggaaccctggctcagaggaaaccagttctgtattaaaatcctgaatccttatatgccgtcggttgtagagacattggagcaaatgcagaggaagcacggtggcatgctggtgcggaaccccctctctcgcaatagtacccatgaaatgtactgggtctcctgcgggactggaaacattgtgagcgccgttaatatgacatcaagaatgcttctgaacaggtttaccatggctcaccgaaaaccaacgtatgagcgggatgtggacttaggcgccggtacccgtcacgtcgcagtggaacctgaggtagccaacctggatatcatagggcagagaattgaaaatatcaagcatgagcacaagtccacatggcattacgacgaggataacccctataaaacttgggcttaccacggatcttatgaagtgaagcctagcggcagtgcgtccagcatggttaatggcgtcgtgaaattgctcaccaagccatgggacgtgatccccatggtcacacagattgccatgactgataccacacctttcgggcaacagcgcgtttttaaagagaaggtggacaccaggactccaaaggcaaaacggggaacggctcagataatggaagtaacagccaagtggctgtggggtttcctatctagaaacaaaaagccccgcatctgtaccagggaggaatttactcgaaaagtgcggtcaaatgcagccattggcgctgtcttcgtggacgagaaccaatggaatagtgccaaggaggcggttgaagatgagagattttgggaccttgtgcatagggaacgcgagctgcacaagcaggggaaatgcgcaacctgcgtctacaacatgatgggaaagcgtgagaaaaagctcggcgagttcggtaaagccaaggggtcccgggctatctggtacatgtggctgggagccagattcttggagtttgaagcactgggcttcatgaatgaggatcactggtttagcagggaaaactctctctcgggcgtggagggggagggacttcataaactgggttatattttacgcgacatctcaaagataccgggcgggaatatgtacgctgatgacacagccggatgggatacgcgaatcaccgaagacgatctgcagaacgaggctaagattactgacatcatggaacctgagcacgccttgctcgcaaaaagcattttcaagctgacatatcagaataaagtagttcgggtgcaaagaccagcgaagaacggcaccgtcatggatgtgatctccaggcgcgaccagagaggtagtggacaggtgggaacttacggcctaaatacatttaccaacatggaagcccagcttatacggcaaatggagtctgagggcattttcagcccctccgaactggagacacctaacctcgctgggagggtcctggattggttggaaaaacatggagttgagcgtttaaagcgaatggccatctcaggtgacgactgtgtggtaaagccaatcgatgaccgctttgcaactgctctgaccgccctcaatgatatgggcaaagtgagaaaggacattccccagtgggaaccgagtaaagggtggaacgattggcagcaggtccctttctgctctcaccactttcatcaacttataatgaaggacggacgggagatcgtggttccctgtaggaatcaggatgagctggtgggccgcgcaagagtcagccagggtgccgggtggtccctacgggaaacggcgtgcctgggaaaatcatatgctcagatgtggcaactcatgtacttccacaggcgagacttgcgtctggccgcaaacgccatttgtagcgctgtgccagtagattgggttcctacctctagaacaacttggtccatccatgcccaccatcagtggatgaccacagaggacatgcttagtgtgtggaatcgcgtctggattgaagagaacccctggatggaagataagactcacatcagctcgtggggcgacgtgccatatctgggcaagcgggaggaccagtggtgcgggtccctcataggattaaccgcaagggctacgtgggccacaaatatccaagttgcgattaaccaggtgagacgcctgatcggtaatgagaactacttggattacatgacctctatgaaacggtttaagaatgaaattgaccccgagggcgctctgtggtga

SEQ ID NO: 13791 - RNA, 9879 nt, synthetic construct
  misc_feature 1..9879: note = derived and/or modified CDS sequence (opt3) from DENV-1__GQ199817__SS-prME
  source 1..9879: mol_type = other RNA
agcgtgaccatgctgctcatgcttatgcccacagcactggctttccacttgactacgagaggaggggaacctcatatgatcgtctccaagcaggaaagagggaaatctttactgtttaagacctcagccggtgttaatatgtgcacactaattgccatggacctcggcgagttctgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaagacgcaaactttgtttgccgccgaacattcgtggatagaggctggggtaatgggtgtggactgtttggcaaaggctccttgataacttgcgctaagttcaagtgcgtaaccaaactcgaggggaagattgtgcagtacgaaaacctgaaatattcagtcatcgtgacagttcacaccggagaccagcatcaagtgggtaatgagagtactgaacacggcacgacagccaccattactccccaggcgcctagcaccgagatccagttaacagactacggggccctgaccctcgattgttctccaaggactggacttgactttaacgaaatggtcctgttgacaatgaaggagaaatcctggctagtgcataagcagtggttcctggatctcccgctgccctggacgtcaggcgcaagcaccagtcaagagacttggaatcggcaggaccttctggtaacatttaaaaccgctcacgccaagaagcaggaagttgtggtcttgggttctcaagagggggctatgcacacagccctcactggcgcaaccgaaatccagacgtccggaaccacaactattttcgccggccatctgaaatgccgtttaaagatggataaactgaccctaaaggggatgagctatgtgatgtgtacaggatcgttcaaactcgagaaggaagtcgctgagactcagcacggtaccgtgctggttcagataaagtacgagggcacggacgcgccttgcaaaatcccattttctacacaagatgaaaagggggtgacccagaacggacgccttattactgcaaatcccatcgtaacagacaaagagaagcctgtcaacatagaagccgagccacccttcggcgagtcctatattgtgatcggtgctggggaaaaagccttgaagctgtcatggtttaagaaaggcagtagcatcggaaagatgttcgaggcaaccgccagaggcgctaggcggatggccattctcggggatactgcatgggactttggatccatcggtggcgttttcacctctgtggggaaactggtccatcagatttttggaacagcgtacggcgtgcttttcagcggtgtatcatggacgatgaagatagggatcggcgtgctgttgacctggctcggactgaatagtcgatccactagcttatctatgacatgtattgctgttggcctggtcaccctatacctcggggtgatggtgcaggccgattcaggatgcgtcatcaactggaaaggccgcgaactgaagtgtggtagtgggatctttgttacaaatgaggtgcacacttggaccgaacaatataagttccaggcagacagcccgaaaagactttccgccgctattggaaaggcctgggaggagggcgtgtgcggtataaggtctgcaacgcggttggaaaacatcatgtggaaacagatttcgaacgagctgaatcatatcctcctggaaaacgacatgaagttaacagtagtcgtgggcgatgttgctgggattctggcccagggcaagaaaatgatccgccctcaacccatggagtacaaatatagctggaagtcctggggcaaggcgaaaataatcggggccgacgtgcagaataccacttttattatcgatggaccaaacacccctgaatgtcccgacgatcagagagcttggaatatttgggaggtcgaggactacggcttcggtatctttacaactaacatatggcttaagttgagggattcatatacccaggtgtgcgaccaccgtctcatgagtgcagccattaaagattctaaggctgttcacgccgacatggggtactggatcgaaagcgagaaaaatgaaacatggaagctggcacgggcgtccttcattgaggtgaagacgtgtatctggccaaaatcacataccctatggagcaacggagtactggaatctgagatgataatccccaagatttatggcggtcctatctcccaacacaattaccgaccaggctacttcactcagacagccgggccgtggcatctcggaaaactggagcttgattttgacttgtgcgaaggcaccactgtcgtggtggatgagcactgcgggaacagaggacccagtctgaggacaaccacggtcactggcaagattatccacgaatggtgttgccgcagctgtaccttacctccactccggttcaaaggtgaggacgggtgctggtatggaatggagataagacccgttaaggaaaaggaggaaaatctggtgaaatctatggtatccgctggctcaggtgaggtggacagttttagccttggcctgttgtgtatttcgatcatgatcgaagaggtcatgaggtcccgctggtctcgaaagatgctcatgacagggaccctggccgtgttctttctactgattatgggacagctcacttggaacgatctgatccggctttgcattatggttggcgcaaatgctagcgaccgtatggggatgggaacaacctacttggccctgatggcaacattcaaaatgagacctatgtttgccgtgggcttactcttcaggcgcctgacttcacgggaggtccttctgctaaccataggtctcagtctggtggcttccgttgaattgccaaactctctggaggaattaggggatggactcgcgatgggcatcatgattctgaaacttctgacggactttcaaagccatcagttgtgggccacactcctgtccctaaccttcatcagaactaccttttcactgcactatgcatggaaaacaatggctatggtgcttagcattgtcagtctcatccccctgtgtttgtctactacctcccagaagacgacatggctgccggtattactcggcagcctggggtgcaagcctcttaccatgttcctgatagccgagaataaaatctggggaaggaagtcgtggccattgaacgaaggtattatggccgtgggcatcgtttcaattctcctgtctagtctactgaaaaacgatgtgccccttgctgggcctctcatcgcaggaggcatgctgatagcctgttacgtcatttccggtagctctgcggacttgagcttagagaaggctgccgaggtgtcctgggaagaggaagcagagcattcaggggccagtcacaatatcctggtagaagtgcaggatgacggaactatgaaaatcaaggatgaggagcgagacgatacactcaccattctgcttaaagctactctgttggcagtcagcggcgtttatcccctatctataccagccacactgtttgtgtggtgcttctggcaaaagaagaaacagcgctccggcgtgctctgggacaccccttcacccccagaagtcgagcgggcggtgctggatgacgggatctacagaattatgcagaggggacttttaggtcgtagtcaggttggcgtaggggtgttccaagaaaacgtctttcatacgatgtggcacgtgactcgcggagctgttctgatgtatcagggcaagcggctcgagccgagctgggcctccgtgaaaaaggacttgatctcttacggtgggggatggagactgcagggctcgtggaataccggcgaggaagtccaggtgattgcagtagagcctgggaaaaaccccaagaatgtccaaacagccccaggaaccttcaagacaagcgaaggtgaggtgggcgctatcgccctcgattttaaacccgggacttcaggatcccctatagttaacagggaaggcaagatcgtgggtctgtacgggaatggagtcgtgaccacgagtggcacatatgtttctgcaattgctcaggccaaagcgagccaggagggcccacttcccgagatcgaagacgaggtgttccgaaagcggaacctgactattatggatttgcaccctgggtccggaaaaacccgcagatacctaccggccatcgtcagggaagcaataaagcggcgactgagaacactcattttagctccaacccgcgtggtagcctcagagatggctgaagcactgaagggtatgcccatcaggtatcaaactaccgccgtgaaatctgagcatacaggcaaggagatcgttgaccttatgtgtcacgccacgtttactatgcgtctgctcagccctgtccgggtgccaaattacaacatgattatcatggatgaagctcatttcaccgaccccagttccatagcggcaagagggtatattagcacaagggtgggaatgggcgaggccgctgccatctttatgaccgcaactcctccgggttctgtcgaagccttcccccagtcaaatgctgtaattcaggatgaggaacgcgacatcccagagcgatcctggaacagtgggtacgagtggataacagattttcctggaaaaaccgtgtggttcgttcccagcattaagtcgggcaatgacatcgcgaactgcttgaggaagaatggcaagcgggtgatccagctgtctaggaagacgtttgatactgaatatcagaaaacaaagaacaacgactgggactacgtcgtgaccaccgatatttccgagatgggggccaatttccgcgcagaccgtgttatcgatccaagacggtgcctcaaacctgtgattctgaaggacggacccgaaagggtcatacttgctggtccaatgccggtgactgtagccagcgcagcccagcgccgaggcagaatcgggcggaaccacaataaagagggagatcagtacatttatatgggccagcctctaaacaatgacgaggatcatgctcactggacagaagccaagatgctgttggacaacatcaatacccccgagggtatcattccagcgttattcgaacccgagagggaaaagtcagcagccatagatggggagtaccgcctgagaggcgaggctaggaaaacatttgtggaactcatgcggcgtggagacctgcctgtttggcttagttataaggtcgcctctgagggcttccaatactccgatcgccgatggtgttttgacggggaaagaaacaatcaggtgctggaggaaaacatggatgtggagatctggactaaagagggagaaaggaagaaactccggccacgctggttggacgctagaacgtatagcgaccccctggcactaagggagttcaaggaatttgccgctggtcggcgatcagtcagtggcgatctgattctcgagatcgggaaacttcctcagcacctgacccagagagcccaaaatgcattagacaacttggttatgctgcataatagcgaacagggaggccgcgcgtacaggcacgccatggaggagctcccggatacaattgaaactctgatgcttctggctctcatcgccgtgttgaccggtggggtaacactgttcttactatccggccggggactgggcaagacctctatagggctcctttgcgtgatggcaagctccgtcctgttgtggatggcttcagtggagccacattggatcgccgcatctattatcctggaatttttcctcatggttctgcttattcccgagcctgaccgtcagagaactccccaggataaccaactcgcctatgtggtcatcggactgttgtttatgatactgacggtagctgcgaatgagatgggtttactagaaaccacaaagaaagacctgggcattgggcacgtggccgttgagaaccaccatcacgcagctatgctcgatgtggaccttcatccagccagtgcctggactctgtacgcagtcgctaccacaatcattacccctatgatgaggcacactatcgaaaacacaacggccaatatatcgttgaccgcgatcgctaaccaggccgcaattctgatgggactcgataagggctggcccatcagcaaaatggacattggtgtgccactgcttgccttagggtgttactcccaggtcaatcctctgactctcacagctgcagtgttgatgctggttgcccattatgcgatcataggcccgggactacaagctaaggccacccgcgaggcacagaaacggaccgccgctggcattatgaagaaccccacagtggatgggatcgtagccatcgacctggatccagtggtctacgacgcaaagttcgaaaaacagctcggacagattatgcttctgatcttgtgcacttctcaaatactgctcatgcgaacgacctgggctctgtgtgagtcaattacattagccactggccctcttaccacactgtgggagggtagccccgggaagttttggaataccactatcgcggtttccatggccaacattttcagaggaagttatctcgcaggcgctggtctagccttttctctgatgaagtcattgggcgggggaaggcgcggcacgggggcacagggagaaacactgggcgagaagtggaaacggcagctcaatcagcttagcaagtccgagttcaacacctacaagagaagtggtatcatggaggtggaccgtagcgaagctaaagaggggctgaagaggggagagactaccaaacacgccgtctctcggggcacagccaagttgcgctggttcgtggaacgaaatctggtaaaaccagagggtaaggtgatagatctcggctgcgggagaggaggctggtcctattactgtgcggggttaaagaaagttactgaagtgaagggatataccaaaggcggtcctgggcacgaggaacccatcccgatggctacatacggatggaacctggtcaaacttcattcaggcaaagacgtgtttttcattccacctgagaagtgcgatacgctgctatgtgacatcggcgagagctcgcccaatccaaccattgaagaggggaggactctccgggtcctgaaaatggtggaaccctggttgcgcggaaaccaattttgcatcaagattctgaatccttacatgccgtctgttgtagagacactcgagcagatgcagagaaagcacggtggcatgcttgtgaggaaccccctgagtcgaaattccacccatgaaatgtattgggtcagctgtgggactggaaacatcgtgtcagcagttaatatgacatcccggatgttactgaaccgtttcaccatggcccacagaaaaccaacgtacgagcgcgatgtggacttgggcgctggtaccaggcacgtcgccgtggaacctgaggtagcaaacctcgatataattgggcagcggatcgaaaatatcaagcatgagcacaaatctacatggcattatgacgaggataacccctacaagacttgggcctatcacggaagctacgaagtgaaacctagtggctccgctagctctatggttaatggcgtcgtgaagctgctaaccaagccatgggacgtgattcccatggtcacacaaatagcgatgactgataccacaccttttgggcagcagagagttttcaaagagaaggtggacacccgcactccaaaagccaagaggggaacggcacaaatcatggaagtaacagctaaatggctttggggttttctgtcacgaaacaagaagccccggatttgcaccagagaggagttcactaggaaagtgcgcagtaatgccgcaatcggcgccgtctttgtggacgagaaccagtggaactccgctaaggaggccgttgaagatgagcgtttctgggacctcgtgcatcgggaaagagagctgcacaaacaggggaagtgcgcgacctgtgtctataacatgatgggaaaaagggaaaagaagttgggcgagtttggtaaagcaaaggggagccgcgccatttggtacatgtggctgggagctcgattcctcgagtttgaagcccttggcttcatgaatgaggatcactggttctctcgggaaaactcgctgtcaggcgtggagggggagggattacataaactgggttacatcttgagagacataagcaagatcccgggcgggaatatgtatgcagatgacacagctggatgggatacgaggattaccgaagacgatctccagaacgaggccaaaatcactgacattatggaacctgagcacgctctgctagccaagtccatctttaaacttacataccaaaataaggtagttcgcgtgcagagaccagcaaagaacggcaccgtcatggatgtgataagtcggagggaccagcgtggttctggacaggtgggaacttatggcctgaatacattcaccaacatggaagcgcaactcattcgacagatggagagcgagggcatcttttccccctcagaactggagacacctaacttggccgggcgcgtcttagattggctggaaaaacatggagttgagagactcaagcggatggctatcagtggtgacgactgcgtggtaaaaccaattgatgacaggttcgccactgcacttaccgctctgaatgatatgggcaaggtgcgcaaagacataccccagtgggaaccgtctaaggggtggaacgattggcagcaagtccctttttgtagccaccacttccatcagctaatcatgaaggacggaagagagattgtggttccctgccggaatcaggatgagctggtgggcagggcccgagtctcccagggtgcagggtggtcactccgtgaaacggcctgtttgggaaaaagctacgcgcaaatgtggcagctgatgtattttcacagacgcgaccttcggctggctgccaacgcaatctgctctgccgtgccagtagattgggttcctacctccaggacaacttggagtattcatgctcaccatcagtggatgaccacagaggacatgctcagcgtgtggaatagagtctggatcgaagagaacccctggatggaagataagactcacgtgtcgtcctggggcgacgttccatacttaggcaaacgcgaggaccaatggtgtgggtctctgataggattgaccgcccgggcaacgtgggctacaaatatccaggtggccattaaccaggtcaggcgactgctcggtaatgagaactatcttgattacatgacctcaatgaagagattcaaaaatgaaagcgaccccgagggcgcgctgtggtga

SEQ ID NO: 13792 - RNA, 9879 nt, synthetic construct
  misc_feature 1..9879: note = derived and/or modified CDS sequence (opt3) from DENV-1__FJ882550__SS-prME
  source 1..9879: mol_type = other RNA
agcgtgaccatgctgctcatgcttatgcccaccgcactggctttccacttgactacgaggggaggggaacctcatatgatcgtaaccaagcaggaaaggggaaaatccttactgtttaagacatctgccggtgttaatatgtgcactctaattgccatggacctcggcgaactgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaatgacaactatttttgccggccatttaaaatgccgtctgaagatggataaactaaccctcaaggggatgtcctatgtcatgtgtacaggtagcttcaaactggagaaggaagtggctgagactcagcacggaaccgtccttgtgcagataaagtacgagggcacggacgcgccttgcaaaatcccattctcgacacaagatgaaaagggggttacccagaacggacgcttgattactgcaaatcccatcgtgacagacaaagagaagcctgtaaacatagaagccgagccaccctttggcgagtcttatattgtcatcggtgctggggaaaaagccctgaagctctcctggttcaagaaaggctcaagtatcggaaagatgtttgaggcaaccgccagaggcgctaggcggatggccattctgggggatactgcatgggacttcggaagcgtgggtggcgtttttacctccgtggggaaacttgtccatcagatcttcggaacagcgtacggcgtgctgttttctggtgtaagctggacgatgaagattgggataggcgtgttgctcacctggctgggattaaattcacgaagtacttccctgagcatgacatgtatcgctgttggcctagtcaccctctacctgggggtgatggtgcaggccgattctggatgcgtcattaactggaaaggccgcgaacttaagtgtggttcagggatcttcgttacaaatgaggtgcacacttggaccgaacaatataagtttcaggcagacagtccgaaaagattgagcgccgctatcggaaaggcctgggaggagggcgtgtgcggtattaggtccgcaacgcggctggaaaacataatgtggaaacagatctctaacgagctcaatcatattctgttagaaaacgacatgaagttcacagtagtcgtgggcgatgttgtggggatcctggctcagggcaaaaagatgattcgccctcaacccatggagcacaaatactcgtggaaaagctggggcaaggccaagatcataggggcggacgtccagaataccacttttatcattgatggaccaaacacccctgaatgtcccgacgatcagagagcctggaatatctgggaggtggaggactatggcttcggtatttttacaactaacatctggcttaagttgagggattcctacacccaggtttgcgaccaccgtctcatgtcagctgcaataaaagatagtaaggccgtgcatgctgacatggggtattggattgaatctgagaaaaatgaaacatggaagctggcccgggcatccttcatcgaggtaaagacgtgtatttggccaaaatcccacaccctatggtcaaacggagtcctggaaagcgagatgatcatacccaagatctacggcggtcctatttctcaacataattatcgaccaggctacttcactcagacagcggggccgtggcacctcggaaaactggagcttgattttgacttgtgcgaaggcaccactgtggtggtcgatgagcactgcgggaacagaggaccctccctgaggacaaccacggttactggcaagatcattcatgaatggtgttgccgcagttgtaccttacctccactccggttcaaaggtgaggacgggtgctggtacggaatggagatcagacccgtgaaggaaaaggaggaaaatctggtaaaaagcatggtgtctgccggctccggtgaggtcgactcatttagtcttggcctgttgtgtataagcattatgatcgaagaggtgatgaggtcgcgctggtcccgaaagatgctcatgacagggaccctggctgttttcctactgctcatcatgggacagctgacttggaacgatcttattcggttgtgcatcatggtgggcgccaatgcatctgaccgtatggggatgggaacaacctatctggctttaatggccacatttaaaatgagacctatgttcgcagtcggcctcctgtttaggcgccttactagccgggaggtgctgctactcaccattggtctgtcattggttgccagtgtggaactgccaaactccttagaggaactcggggatggactggctatgggcataatgatccttaagctgttgacggacttccaatctcaccagctctgggcgacactgctaagcctgacctttattaaaactaccctttccctccattacgcctggaagacaatggcaatggtcctgtcaatcgtcagcttgttccccctgtgtttaagtactacctctcagaagacgacatggctcccggtgctgcttggctccctggggtgcaaacctttgaccatgtttctcattactgagaataagatctggggaagaaaaagctggccactgaacgaaggtataatggctgttggcgtggtctcgatcctactgtcatctcttctcaagaacgatgtgcccctggccgggcctttgattgccggaggcatgttaatcgcttgttatgtaattagtggttccagcgcagacctgtctctcgagaaagccgcggaggtgagctgggaagaggaagctgagcactccggggcctcacataatatcctggtcgaagttcaggatgacggaacaatgaagataaaagatgaggagagggacgatacccttactattctgttgaaggcaacactactggccgtgagtggcgtgtaccccctcagcatcccagctaccctgttcgtctggtatttttggcaaaagaaaaagcagcgatctggcgtgctttgggacacgccttcacccccagaagttgagcgcgcagtattagatgacgggatctaccggattatgcagagaggactgctcggtaggagccaggtgggcgtcggggtgttccaagaaaacgttttccacactatgtggcacgtgacccgtggagccgtcttgatgtatcagggcaaacgcctggagccgagttgggcgagcgtgaagaaagacctcatatcctacggtgggggatggcggctgcagggctcttggaatacaggcgaggaagtacaggtcatcgctgtggagcctgggaagaaccccaagaatgttcaaaccgccccaggaacatttaaaactcccgaaggtgaggtgggcgcaattgcccttgatttcaagcctgggacctcgggaagcccaatcgtcaacagagaaggcaaaattgtgggtctgtacgggaatggagttgtgacgacatcaggcacttatgtctccgctatcgcccaggcaaaggctagtcaggagggccccttgcctgagatagaagacgaggtgtttaggaaacgaaacctaaccatcatggatctgcatccggggtctggaaagacacggcgctacctcccagccattgtaagagaagcgatcaagaggaaattacggaccctgattcttgcccccactcgagtggttgcaagcgagatggctgaagccctgaagggtatgcctatcagatatcaaaccacagctgtcaaatccgagcacacgggcaaggagatagtggacctcatgtgccatgcaactttcaccatgcgcttgctgtcaccagtgagggtccccaattacaacatgattatcatggatgaagcccactttacagacccttctagcatcgccgctcgtgggtatattagtacccgggtaggaatgggcgaggcggcagccatcttcatgactgctacaccgcccggttccgtggaagcctttccacagagcaatgcagttatacaggatgaggaaagagacattcctgagaggtcttggaactcagggtacgagtggatcaccgatttccccggaaaaacggtgtggtttgtcccatccattaagagtggcaatgacatcgccaactgtctccgcaagaatggcaaacgagtgatacagctgagcagaaagactttcgatacagaatatcagaaaaccaagaacaacgactgggactacgttgtgaccactgatatttcggagatgggggctaattttcgggcggacagggtcatcgatcctcgccgttgccttaaacccgtgatcctaaaggacggaccagaaagagtaattctggccggtccgatgcctgtgacagttgcatctgctgcccagcggaggggccgcatcgggcgaaaccataataaggagggagatcagtacatttatatgggccagcccttgaacaatgacgaggatcacgcacactggaccgaagccaaaatgttactggacaacataaatacaccagagggtatcattcccgctctcttcgaacctgagagagaaaagtccgccgcgatcgatggggagtaccggctgaggggcgaggcacgcaaaactttcgtcgaacttatgagaaggggagacctgccagtgtggctcagctataaggtggcctcagagggctttcaatacagtgatcggcgttggtgcttcgacggggaacgcaacaatcaggtcttggaggaaaacatggatgttgagatctggacgaaagagggagaacgaaagaaactgagacccaggtggctagacgctcggacctattctgaccctctggccctccgcgagtttaaggagttcgctgcaggtagaaggtccgtgagcggcgatcttattctggagatagggaagttaccgcagcatttgacacagcgggcccaaaatgctctggacaacctcgtaatgctgcacaattcagaacagggaggccgagcctacagacatgcaatggaggagcttccagatactatcgaaaccctgatgctcttggcgctgattgccgtgttaacaggtggggtcaccctatttttcctgagtggccgcggactcggcaaaactagcatcgggcttctgtgtgtgatggcttcctctgttttgctgtggatggccagcgtggagccccactggattgcagcttccatcatactcgaatttttcctgatggtccttctcatccctgagcccgacaggcagcggacgccacaggataaccaactggcctatgtagtgattggattgctgtttatgatcttaaccgttgcagccaatgagatgggtctactggaaacaactaagaaagacctcggcattgggcacgtggctgtcgagaaccatcaccatgcgaccatgcttgatgtggacctgcaccctgcctcagcatggacattgtacgctgtcgccaccactatcataacacccatgatgcgtcatacgattgaaaacaccactgccaatatctctctgacagcaattgctaaccaggccgcgatcctcatgggactggataagggctggccaataagtaaaatggacatcggtgtgcctcttttagctctggggtgctactcgcaggttaatccgctcaccttgaccgccgcagtgctgatgctagtagcccactatgctattatcggccccggactgcaagcaaaggccacaagagaggcgcagaagaggactgctgccggcattatgaaaaacccaacggtggatgggatcgtcgcaatagacctcgatcctgttgtgtacgacgccaagttcgaaaaacagcttggacagattatgctgttgatcctgtgtaccagccaaatcctcctgatgcgcacaacttgggctttatgcgagtccattacccttgccacaggccccctgaccactctctgggagggttctccagggaagttttggaatacgacaatcgcagtctcaatggctaacatattccggggaagctatctagccggcgcgggtctggccttttccttgatgaaaagtctgggcgggggacgaagaggcaccggggcacagggagaaactctcggcgagaagtggaagaggcagcttaatcagctgtctaaaagcgagttcaacatttacaagcgctcaggtatcatggaggtggaccggtccgaagctaaagaggggttgaagagaggagagaccacacgtcacgccgtaagtaggggcactgcaaaactgcggtggttcgtggaacgcaatctcgttaagcctgagggtaaggtgattgatttaggctgtgggcgaggaggctggagctattactgcgctgggctgaaaaaggtcaccgaagtgaaaggatatacaaagggcggtcccgggcatgaggaaccgatcccaatggccacgtacggatggaaccttgtcaaactgcactctggcaaggacgtgtttttcacccctcccgagaaatgtgatactctactctgcgacataggcgagtcctcaccaaatcccacaatcgaagaggggagaaccctgagggttttgaagatggtagaaccttggctgcggggaaaccaattttgtattaagatcctcaatccgtacatgcccagcgtggtcgagactcttgagcagatgcagcgcaaacatggtggcatgctggtgagaaacccattatcgagaaattctacacacgaaatgtattgggttagttgcgggaccggaaacattgtgtccgccgtcaatatgacgagccgaatgctgttgaaccggttcaccatggcgcaccgtaagcctacatacgagagagatgtggacctcggcgctggtactcgccatgtagcagtggaacccgaggttgccaacctggatatcattgggcagaggatcgaaaatataaaacacgagcataagtcaacctggcactatgacgaggataacccttacaaaacatgggcttatcatggatcctacgaagtcaagccatctggcagcgccagttccatggtgaatggcgtggtcaagctacttactaaaccctgggacgttattcctatggtgacccaaatcgcaatgacagataccactccatttgggcagcagcgggtattcaaggagaaagtggacacgagaacacccaaggccaaacgcggaaccgctcaaatcatggaagtcactgcgaggtggctgtggggttttctcagccgaaacaagaagccgcggatttgtaccagagaggagttcacaaggaaagtgcgctctaatgccgcaataggcgctgtttttgtggacgagaaccagtggaactcagccaaggaggcagtcgaagatgagcgtttctgggacctggtgcagaaagaacgggagttgcacaagcaggggaaatgcgccacgtgcgtatataacatgatgggaaagagagaaaagaaactgggcgagtttggtaaggctaaagggagtagggccatctggtacatgtggctcggagcgcgcttccttgagtttgaagcactgggcttcatgaatgaggatcactggttctcccgagaaaacagcttatctggcgttgagggggagggactgcataagttgggttacattctccgggacatctcgaaaattcctggcgggaatatgtatgccgatgacaccgctggatgggatactagaatcacagaagacgatctgcaaaacgaggccaagataaccgacatcatggaaccagagcacgcactacttgctacttcaatttttaaactgacataccagaataaggtggtcagggtgcagcgccccgccaagaacggcaccgtgatggatgtcatcagcagacgggaccagaggggttccgggcaagttggaacatatggcctcaatactttcaccaacatggaagctcagctgattcgtcagatggagagtgagggcatctttttgccttctgaattagagacgccaaacctggccgaacgagtgctcgattggcttgagaaatacggggtagaacgcctgaagagaatggcaataagcggagacgactgtgtggtcaaacccattgatgaccggttcgcgaccgccctaacagctctgaatgatatgggtaaggtgaggaaagacatcccgcagtgggagccttccaagggctggaacgattggcaacaggttcccttttgctcacatcacttccaccagctcatcatgaaggacgggcgcgagattgtggtcccatgtagaaatcaggatgaattggtgggacgggccagggtaagtcaaggcgcaggttggtctctgcgagagactgcttgccttgggaaaagctatgcccagatgtggcagctgatgtactttcatcgtagagacctccgcttagcagccaacgcgatatgttccgctgttcctgtggattgggtccccacctcacggacaacttggagcatccacgcccatcaccaatggatgaccacggaagacatgctgtctgtgtggaatagggtttggattgaggaaaacccatggatggaggataagacacatgtgtccagttggggagacgtcccctatttgggcaaaagagaggaccagtggtgcggcagcctgatcgggctcaccgcacgcgccacttgggcttcgaatattcaggtggccatcaaccaggtacggaggcttataggaaatgaaaactacctggattacatgacatccatgaagcgattcaaaaatgagggtgaccctgaaggcgcactatggtga

SEQ ID NO: 13793 - RNA, 9879 nt, synthetic construct
  misc_feature 1..9879: note = derived and/or modified CDS sequence (opt3) from DENV-1__FJ882551__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagttctgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagagcaggacgcaaactttgtttgccgccgaacattcgtggatagaggctggggtaatgggtgtggactgtttggcaaaggctccttgataacttgcgctaagttcaagtgcgtaaccaaactcgaggggaagattgtgcagtacgaaaacctgaaatattcagtcatcgtgacagttcacaccggagaccagcatcaagtgggtaatgagagtactgaacacggcacgacagccaccattactccccaggcgcctagcaccgagatccagttaacagactacggggccctgaccctcgattgttctccaaggactggacttgactttaacgaaatggtcctgttgacaatgaaggagaaatcctggctagtgcataagcagtggttcctggatctcccgctgccctggacgtcaggcgcaagcaccagtcaagagacttggaatcggcaggaccttctggtaacatttaaaaccgctcacgccaagaagcaggaagttgtggtcttgggttctcaagagggggctatgcacacagccctcactggcgcaaccgaaatccagacgtccggaaccacaactattttcgccggccatctgaaatgccgtttaaagatggataaactgaccctaaaggggatgagctatgtgatgtgtacaggatcgttcaaactcgagaaggaagtcgctgagactcagcacggtaccgtgctggttcagataaagtacgagggcacggacgcgccttgcaaaatcccattttctacacaagatgaaaagggggtgacccagaacggacgccttattactgcaaatcccatcgtaacagacaaagagaagcctgtcaacatagaagccgagccacccttcggcgagtcctatattgtgatcggtgctggggaaaaagccttgaagctgtcatggtttaagaaaggcagtagcatcggaaagatgttcgaggcaaccgccagaggcgctaggcggatggccattctcggggatactgcatgggactttggatccatcggtggcgttttcacctctgtggggaaactggtccatcagatttttggaacagcgtacggcgtgcttttcagcggtgtatcatggacgatgaagatagggatcggcgtgctgttgacctggctcggactgaatagtcgatccactagcttatctatgacatgtattgctgttggcctggtcaccctatacctcggggtgatggtgcaggccgattcaggatgcgtcatcaactggaaaggccgcgaactgaagtgtggtagtgggatctttgttacaaatgaggtgcacacttggaccgaacaatataagttccaggcagacagcccgaaaagactttccgccgctattggaaaggcctgggaggagggcgtgtgcggtataaggtctgcaacgcggttggaaaacatcatgtggaaacagatttcgaacgagctgaatcatatcctcctggaaaacgacatgaagttaacagtagtcgtgggcgatgttgctgggattctggcccagggaaaaaagatgatccgccctcaacccatggagtacaaatatagctggaagtcctggggcaaggcgaaaataatcggggccgacgtgcagaataccacttttattatcgatggaccaaacacccctgaatgtcccgacgatcagagagcttggaatatttgggaggtcgaggactacggcttcggtatctttacaactaacatatggcttaagttgagggattcatatacccaggtgtgcgaccaccgtctcatgagtgcagccattaaagattctaaggctgttcacgccgacatggggtactggatcgaaagcgagaaaaatgaaacatggaagctggcacgggcgtccttcattgaggtgaagacgtgtatctggccaaaatcacataccctatggagcaacggagtactggaatctgagatgataatccccaagatttatggcggtcctacttcccaacacaattaccgaccaggctacttcacacagaccgccgggccgtggcatctcggaaaactggagcttgattttgacttgtgcgaaggcactacagtcgtggtggatgagcactgcgggaacagaggacccagtctgaggaccacgactgtcaccggcaagatcattcacgaatggtgttgccgcagctgtacattacctccactccggttcaaaggtgaggacgggtgctggtatggaatggagatcagacccgttaaggaaaaggaggaaaatctggtgaaatctatggtatccgctggctcaggtgaggtggacagttttagccttggcctgttgtgtatatcgattatgatcgaagaggtcatgaggtcccgctggtctcgaaagatgctcatgaccgggactctggccgtgttctttctactgatcattggacagctcacatggaacgatctgatccggctttgcattatggttggcgcaaatgctagcgaccgtatggggatgggaaccacatacttggccctgatggcaactttcaaaatgagacctatgtttgccgtgggcttactcttcaggcgcctgacctcacgggaggtccttctgctaacgataggtctcagtctggtggcttccgttgaattgccaaactctctggaggaattaggggatggactcgcgatgggcatcatgattctgaagcttctgacagactttcaaagccatcagttgtgggccaccctcctgtccctaactttcatcagaaccacattttcactgcactatgcatggaaaactatggctatggtgcttagcattgtcagtctcttccccctgtgtttgtctaccacgtcccagaagacaacctggctgccggtattactcggcagcctggggtgcaagcctcttactatgtttctgatcgccgagaataaaatatggggaaggaagtcgtggccattgaacgaaggtatcatggccgtgggcattgtttcaatcctcctgtctagtctactgaaaaacgatgtgccccttgctgggcctctcattgcaggaggcatgctgatcgcctgttacgtcatatccggtagctctgcggacttgagcttagagaaggctgccgtggtatcctgggaggaagaggcagaacattcaggggccagtcacaatattctggtggaggtccaggatgacggaacaatgaaaatcaaggatgaagagcgagacgataccctcactatcctgcttaaagctacactgttggcagttagcggcgtgtatcccctatctattccagccaccctgttcgtgtggtacttctggcaaaagaagaaacagcgctccggcgtcctctgggacacgccttcacccccagaggtggaacgggcggttctggatgacgggatatatagaatcatgcagaggggacttttaggtcgtagtcaggtaggcgtgggggtctttcaagagaacgtgttccatactatgtggcacgttacccgcggagctgtgctgatgtaccagggcaagcggctcgaaccgagctgggcctccgtcaaaaaggacttgatttcttacggtgggggatggagactgcagggctcgtggaatacaggcgaggaggtgcaggtaatcgcagtcgaacctgggaaaaaccccaagaatgtgcaaaccgccccaggaacatttaagactagcgagggtgaagttggcgctattgccctcgatttcaaacccgggacctcaggatcccctatcgtgaacagggagggcaagatagtcggtctgtatgggaatggagtggttacgacaagtggcacttacgtgtctgcaatcgctcaggccaaagcgagccaggaaggcccacttcccgagattgaggacgaagtctttcgaaagcggaacctgaccatcatggatttgcaccctgggtccggaaaaacacgcagatatctaccggccattgtgagggaggcaatcaagcggaagctgcgaaccctcatattagctccaactagagtagtggcctcagaaatggctgaggcactgaaaggtatgcccattcgctaccaaaccacagccgttaagtctgaacatacgggcaaagagatcgtcgaccttatgtgccacgccactttcaccatgaggctgctcagccctgtgcgtgtgccaaattataacatgatcattatggatgaggctcattttacagaccccagttccatcgcggcacgggggtacataagcaccagagtcggaatgggcgaagccgctgccattttcatgactgcaacacctccgggttctgtagaggcctttccccagtcaaatgctgtgatccaggatgaagagagggacattccagaacgctcctggaacagtgggtatgagtggatcaccgatttccctggaaagacggtttggtttgtgcccagcataaaatcgggcaatgacattgcgaactgtttgcgaaagaatggcaagagagtcatccagctgtctcggaaaactttcgatacagagtaccaaaagaccaaaaacaacgactgggactacgtggttaccactgatatctccgaaatgggggccaatttcagggcagaccgcgtgattgatccacgtagatgcctcaagcctgtcatcctgaaagacggacccgagcgggtgattcttgctggtccaatgccggtaacagtggccagcgcagcccagaggcgcggccgaatagggagaaaccacaataaggaaggagatcagtatatctacatgggccagcctctaaacaatgacgaggatcatgctcactggaccgaggccaagatgctgttggacaacattaatacacccgaaggtatcatcccagcgttatttgagcccgaacgggagaaatcagcagccattgatggggaatataggctgcgcggcgaggctagaaagactttcgttgagctcatgaggcggggagacctgcctgtctggcttagtcacaaagtggcctctgaaggctttcaatactccgatcgtcgctggtgcttcgacggggagcgaaacaatcaggtgctggaagagaacatggatgtcgaaatatggacgaaggagggagagagaaaaaagctcaggccacggtggttggacgctcgcacctatagcgaccccctggcactaagagaatttaaagagttcgccgctggtaggcggtcagttagtggcgatctgatcctcgaaattgggaagcttcctcagcatctgacacagcgagcccaaaatgcattagacaacttggtgatgctgcacaatagcgagcagggaggcagagcgtaccgccatgccatggaagagctcccggatactatcgagaccctgatgcttctggctctcattgccgtattgacaggtggggtgaccctgtttttcttatccggcaggggactaggcaagacttctatcgggctgctctgtgtcatggcaagctccgtgcttctgtggatggcttcagttgaaccacactggatagccgcatctatcattttggagtttttcctgatggtgctcctgatccccgaacctgaccggcagcgtacgccccaggataaccaacttgcctatgtcgtaattggactcctgtttatgatcttgaccgtggctgcgaatgagatgggtctgttagagacaactaaaaaggacctaggcatagggcacgttgccgtggaaaaccatcaccatgcagctatgctggatgtcgacctccacccagccagtgcctggaccctttacgcagtggctacaaccattatcactcctatgatgagacatacaattgagaacacgaccgccaatatctcgctgactgcgatagctaaccaggccgcaatcttgatgggactggataaaggctggcccattagcaagatggacatcggtgtcccactcctggcccttgggtgctactcccaggtgaatcctttaacactgaccgctgcagttctcatgttggtggcccactatgcgattatcggcccgggactgcaagctaaagccaccagggaagcacagaagcgcacagccgctggcataatgaagaaccccactgtagatgggattgtggccatcgacctagatccagtcgtttacgacgcaaaattcgagaagcagctgggacagatcatgctccttattctgtgtacgtctcaaatcttgctgatgcggaccacatgggctctctgcgaatcaataactctggccaccggccctttaacaaccctttgggagggtagccccgggaaattttggaatactacgattgcggtgtccatggccaacatcttccgaggaagttatctggcaggcgctggtctcgccttctctctaatgaagagcctgggcgggggaagaaggggcacaggggcacagggagagaccttgggcgaaaaatggaagcgccagctgaatcagctctcaaagtccgagtttaacacttacaaacggagtggtattatggaagtcgacagaagcgaggctaaggaagggcttaaacgtggagagaccacaaagcacgccgtgtctaggggcactgccaaactgcggtggttcgtagagcgcaatttggtgaagccagaaggtaaggttatcgatctgggctgtgggcgaggaggctggtcctattactgcgcggggctcaaaaaggtgaccgaggtcaaaggatatacaaagggcggtcctgggcatgaagagcccataccgatggctacgtacggatggaacttagtgaaactgcactcaggcaaggacgtctttttcatcccacctgaaaaatgtgatacccttctgtgcgacattggcgagagctcgcccaatccaactatcgaggaagggagaacactaagggtgctcaagatggttgagccctggctgcggggaaaccaattttgtattaagatcttgaatccttacatgccgtctgtagtggaaaccctggagcagatgcagcgcaaacatggtggcatgctcgtcagaaacccccttagtaggaattccactcacgagatgtattgggtgagctgcgggacaggaaacattgtttcagcagtgaatatgacctcccgaatgctgttaaaccggttcacgatggcccaccgtaagccaacctacgaaagagatgtcgacctgggcgctggtacacgccatgtggccgtagagcctgaagtggcaaacttggatatcatagggcagaggattgagaatatcaaacaagaacacaagtctacttggcattatgacgaggataacccctacaaaacctgggcctatcacggaagctacgaggttaagcctagtggctccgctagctctatggtcaatggcgtggtgaagctcctgacaaaaccatgggacgtcatccccatggttactcagattgcgatgaccgatacaaccccttttgggcagcaacgggtgttcaaggaaaaagtagacactagaacgccaaaggccaaacgcggaacagcacagataatggaggtgaccgctaagtggctatggggttttctttcaaggaacaagaaaccccgaatctgtactcgggaagagttcaccagaaaggtcaggagtaatgccgcaattggcgccgtgtttgttgacgaaaaccagtggaattccgctaaagaggccgtggaggatgaacgcttctgggacctggtccatcgtgagcgggaactccacaagcaggggaaatgcgcgacatgcgtgtataacatgatgggaaagagagagaagaaactgggcgaatttggtaaggcaaaagggagcagggccatctggtacatgtggttgggagctcgcttcctggagttcgaggccctcggctttatgaatgaagatcactggttctctcgagagaactcgctttcaggcgtagaaggggagggactgcataagttaggttacattctgcgggacatcagcaaaataccgggcgggaatatgtatgcagatgacacggctggatgggataccagaatcactgaggacgatttgcaaaacgaagccaagattacagacatcatggagcctgaacacgctctcctggccaaatccatttttaagctaacctaccagaataaggttgtgagggtccagcgcccagcaaaaaacggcactgtgatggatgtgatcagtagacgggaccagaggggttctgggcaagtcggaacatatggccttaataccttcacaaacatggaggcgcagctgatacgtcagatggaaagcgagggcattttttccccctcagagctcgaaactcctaacctggccgggcgagttttggattggttaaagaaacatggagtggagcgcctgaagagaatggctatcagtggtgacgactgtgtagtgaaaccaatcgatgaccggttcgccaccgcactcacggctcttaatgatatgggcaaggtcaggaaggacattccccagtgggaaccgtctaaagggtggaacgattggcaacaggtgcctttttgcagccaccacttccatcagctgataatgaaggacggacgcgagctagttgtgccctgtagaaatcaggatgaactggtcggccgggccagggtgtcccaaggtgcagggtggtcactccgagagaccgcctgcttgggaaaaagctacgcgcagatgtggcagctgatgtattttcaccgtagagaccttcgcctggctgccaacgcaatctgttctgccgtaccagttgattgggtgcctacatcccggactacctggagtattcatgctcaccatcaatggatgacaactgaggacatgctcagcgtctggaatagggtgtggatcgaagagaacccctggatggaagataagacccacatttcgtcctggggcgacgttccatacttaggcaaaagagaggaccagtggtgcgggtctctgatcggattgacggcccgcgcaacatgggctaccaatatacaggtggccatcaaccaggtccggaggctgctcggtaatgaaaactatcttgattacatgacttcaatgaagcgattcaagaatgagagcgaccccgagggcgcgctgtggtga

SEQ ID NO: 13794 - RNA, 9879 nt, synthetic construct
  misc_feature 1..9879: note = derived and/or modified CDS sequence (opt3) from DENV-1__FJ882552__SS-prME
  source 1..9879: mol_type = other RNA
agcgtgaccatgctgctaatgcttatgcccaccgcactggctttccacttgactacgagaggcggggaacctcatatgatcgtctccaagcaggaaagggggaaatctttactgtttaagacctcagccggtgttaacatgtgcacactaattgccatggacctcggcgagttctgtgaagatactatgacctacaaatgcccacggataacagaagcggaaccggacgatgtggactgttggtgcaatgctaccgatacttgggtgacatatgggacctgtagtcaaacgggagaacaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaagacgcaaactttgtttgccgccgaacattcgtggatagaggctggggtaatgggtgtggactgtttggcaaaggctccttgataacttgcgctaagttcaagtgcgtaaccaaactcgaggggaagacagtgcagtacgaaaacctgaaatattcagtcattgtgaccgttcacactggagaccagcatcaagtgggtaatgagagtacggaacacggcacaaccgccactatcacaccccaggcgcctagcacagagattcagttaaccgactacggggccctgactctcgattgttctccaaggacaggacttgactttaacgaaatggtcctgttgacgatgaaggagaaatcctggctagtgcataagcagtggttcctggatctcccgctgccctggacctcaggcgcaagcacaagtcaagagacatggaatcggaaagaccttctggtaacctttaagacagctcacgccaagaaacaggaagttgtggtcttgggttctcaggagggggctatgcacactgccctcaccggcgcaacggaaatccaaacctccggaacaactaccatcttcgccggccatctgaagtgccgtttaaaaatggataagctgacactaaaagggatgagctatgtgatgtgtactggatcgttcaagctcgagaaggaagtcgctgagacccagcacggtacggtgctggttcagattaaatacgagggcacagacgcgccttgcaagataccattttctacccaggatgaaaaaggggtgactcaaaacggacgccttatcacagcaaatcccattgtaaccgacaaggagaaacctgtcaacatcgaagccgagccacccttcggcgagtcctatatagtgattggtgctggggaaaaggccttgaagctgtcatggtttaaaaagggcagtagcatcggaaaaatgttcgaggcaactgccagaggcgctaggcggatggccatcctcggggataccgcatgggactttggatccattggtggcgttttcacatctgtggggaagctggtccatcagatctttggaacggcgtacggcgtgcttttcagcggtgtatcatggaccatgaaaattgggataggcgtgctgttgacttggctcggactgaatagtcgatccactagcttatctatgacctgtatcgctgttggcctggtcacactatacctcggggtgatggtgcaggccgattcaggatgcgtcattaactggaagggccgcgaactgaagtgtggtagtgggatctttgttactaatgaggtgcacacctggacggaacagtataaattccaagcagacagcccgaagagactttccgccgctatcggaaaagcctgggaggagggcgtgtgcggtattaggtctgcaacacggttggaaaacataatgtggaagcagatctcgaacgagctgaatcatattctcctggaaaacgacatgaaatttaccgtagtcgtgggcgatgttgctgggatcttagcccagggaaagaaaatgattcgccctcagcccatggagtacaagtatagctggaagtcctggggcaaagcgaagatcataggggccgacgtgcaaaatactaccttcatcattgatggaccaaacacacctgaatgtcccgacgatcagagagcttggaatatctgggaggtcgaggactacggctttggtattttcactaccaacatctggctgaaacttagggattcatatacacaggtgtgcgaccaccgtttgatgagtgcagccataaaggattctaaagctgttcacgccgacatggggtactggattgaaagcgagaagaatgaaacgtggaagctcgcacgggcgtccttcatcgaggtgaaaacctgtatttggccaaagtcacatactctgtggagcaacggagtactagaatctgagatgatcatacccaaaatctatggcggtcctatttcccagcacaattaccgaccaggctactttacacaaaccgccgggccgtggcatctgggaaagctcgagctggatttcgacctttgcgaaggcactacagtcgtggtggatgagcactgcgggaacagaggacccagtttgaggaccacgactgtcaccggcaaaatcattcacgaatggtgttgccgcagctgtacactgcctccattacggtttaagggtgaggacgggtgctggtatggaatggagatcagacccgttaaggaaaaagaggaaaatctcgtgaagtctatggtatccgctggctcaggtgaggtggacagtttcagcctgggccttctgtgtatatcgattatgatcgaagaggtcatgaggtcccgctggtctcgaaaaatgttgatgaccgggactctcgccgtgtttttcctgctaatcatgggacagctgacatggaacgatctcattcggctgtgcatcatggttggcgcaaatgctagcgaccgtatggggatgggaaccacataccttgccttgatggcaacttttaagatgagacctatgttcgccgtgggcctgttatttaggcgcctcacctcacgggaggtcctgcttctgacgattggtctaagtctcgtggcttccgttgaactgccaaactctttggaggaactgggggatggattagcgatgggcataatgatcctcaaactgcttacagacttccagagccatcaactgtgggccaccttgctctccctgacttttattaagaccacatcaagcctacactatgcatggaagactatggctatggtgctgagtatcgtctctcttttccccctctgtctgtccaccacgagccagaaaacaacctggttgccggtactgttaggctcgctcgggtgcaagcctctgactatgtttcttattgccgagaataaaatctggggaagaaagtcatggccactgaacgaaggtataatggccgtgggcatcgtttctattttgctcagttccctgctcaagaacgatgtgcccctggctgggcctcttatcgcaggaggcatgctcattgcctgttacgtcatcagcggttctagcgcggacctgtccttggagaaggctgccgaggtgtcatgggaagaggaagcagagcatagtggggccagccacaatatattagtagaagtgcaggatgacggaacaatgaaaattaaggatgaggagagggacgataccctgactatcctcctgaaggctacacttctggcagtctctggcgtttatcccttgtccatcccagccaccctattcgtgtggtacttctggcagaaaaagaaacaacgatcaggcgtgctgtgggacacgcctagtcccccagaagtcgagcgcgcggtgctcgatgacgggatttatcggataatgcagagaggactgcttggtaggagccaggttggcgtaggggtgtttcaggaaaacgtcttccatactatgtggcacgtgacccgtggagctgttttaatgtaccaaggcaagcgcctggagccgtcctgggcctctgtgaaaaaggacctcatctcgtacggtgggggatggcggttgcagggcagctggaatacaggcgaggaagtccaggtgattgcagtagagcctgggaagaaccccaaaaatgtccagaccgccccaggaacatttaagacttcagaaggtgaggtgggcgctatcgccctggatttcaaacccgggacctccggaagtcctattgttaacagagaaggcaagatcgtgggtctctatgggaatggagtcgtgacgacatctggcacttacgttagcgcaatagctcaagccaaagcgtcccaggagggcccactgcccgagatcgaagacgaggtgtttaggaagcgaaaccttaccattatggatctgcaccctgggtcaggaaagacacggcgctatttgccggccatcgtcagagaagcaattaaaaggaagctacggaccctgatcctcgctccaactcgagtggtagcctctgagatggctgaagcattaaaaggtatgcccataagataccagaccacagccgtaaagagcgagcatacgggcaaagagattgttgacctgatgtgccacgccactttcaccatgcgccttctgagtcctgtcagggtgccaaattataacatgatcatcatggatgaagctcattttacagacccctccagcattgcggcacgtgggtacatctctacccgggtgggaatgggcgaggccgctgccatattcatgactgcaacacctccgggttcagtcgaagcctttccccaatccaatgctgtaattcaggatgaggaaagagacatcccagagaggagttggaacagcgggtatgagtggattaccgatttccctggaaagacggtgtggtttgttccctcgatcaagtctggcaatgacatagcgaactgtctccgcaaaaatggcaagcgagtgattcagttgtccagaaaaactttcgatacagaataccagaagaccaaaaacaacgactgggactacgtcgtgaccactgatatcagcgagatgggggccaatttccgggcagacagggttatcgatccacgccgttgcctgaagcctgtgattctcaaggacggacccgaaagagtcatcctggctggtccaatgccggtgacagtagcctcagcagcccaacggaggggccgcattgggcgaaaccacaataaagagggagatcagtatatatacatgggccagcctcttaacaatgacgaggatcatgctcactggaccgaagccaagatgctactggacaacatcaatacacccgagggtattatcccagcgttgtttgaacccgagagagagaagagtgcagccatcgatggggagtatcggttaaggggcgaggctcgcaagactttcgtggaactgatgagaaggggagacctccctgtttggctgtcttacaaagtcgcctccgagggctttcagtatagcgatcggcgttggtgcttcgacggggaacgcaacaatcaagtgcttgaggaaaacatggatgtggagatttggacgaaggagggagaacgaaagaaactgagaccaaggtggctcgacgctcggacctactcagaccccttggcactgcgcgagtttaaagagttcgccgctggtagaaggagtgtcagcggcgatctaatactggagatcgggaaactccctcagcaccttacacagcgggcccagaatgcactggacaacttagttatgttgcataattccgaacaaggaggccgagcgtatagacacgccatggaggagctgccggatactattgaaaccctcatgctgcttgctctgatcgccgtgctcacaggtggggtaaccttgtttttcctgtctggccgcggattaggcaagactagcattgggctactgtgtgtgatggcatcctcagtcctcctttggatggcttctgtggagccacattggatcgccgcaagtataatcctggaatttttcttgatggttctgctcattcccgagcctgacaggcagcggacgccccaggataaccagctggcctacgtggtcatcggacttctctttatgattctgaccgtagctgcgaatgagatgggtttgctggaaacaactaaaaaggacttaggcatcgggcacgtggccgttgagaaccaccatcacgcagctatgctagatgtggacctgcatccagcctcggcctggaccctctacgcagtcgctacaaccataattactcctatgatgcgtcacacaatcgaaaacacgaccgccaatattagccttactgcgatcgctaaccaagccgcaatactgatgggattggataaaggctggcccatctccaagatggacattggtgtgccactgctcgccctggggtgctattctcaggtcaatcctcttacattaaccgctgcagtgctgatgctcgttgcccattacgcgatcattggcccgggattgcaggctaaggccaccagagaggcacagaaaaggacagccgctggcatcatgaagaaccccactgtggatgggatagtagccattgacctggatccagtggtctatgacgcaaaattcgaaaagcagctaggacagatcatgctgctcatcctttgtacgtcacagattctgttgatgcgcaccacatgggctctgtgcgagagcatcactctcgccaccggccctctgacaaccttatgggagggttcccccgggaaattttggaatactacgatagcggttagtatggccaacattttccggggatcttaccttgcaggcgctggtctggccttcagcctcatgaagtcactaggcgggggacgaagaggcacaggggcacaaggagaaaccctgggcgagaagtggaaaaggcagttgaatcagctgtccaagagtgaatttaacacttataaacgcagcggtatcatggaggtggaccggtctgaagctaaggaggggctcaaaagaggagagaccacaaatcacgccgtctcccgtggcactgccaaacttaggtggttcgtggaacggaacctggtaaagccagagggtaaagtgattgatttgggctgtgggcgcggaggctggtcatactattgcgcggggctgaagaaagttaccgaagtgaagggatacacaaaaggcggtcctgggcacgaggaacccatcccgatggctacgtacggatggaatctcgtcaagttacatagcggcaaagacgtgtttttcataccacctgagaagtgtgataccctgctttgcgacatcggcgagtcgtctcccaacccaactattgaagaggggcgaacactgagagtcctaaagatggtggaaccctggctcaggggaaatcagttttgtatcaaaattctgaacccttatatgccgagtgttgtagagaccttggagcaaatgcagcggaagcacggtggcatgctggtgcgcaatcccctctccagaaacagcactcatgaaatgtactgggtctcatgcgggacaggaaatatcgtgtccgcagttaacatgacctctaggatgcttctgaaccgattcacgatggcccaccggaaaccaacctatgagcgtgatgtggacttaggcgctggtacaagacacgtcgccgtggaacctgaggtagcaaatctggatattatcgggcagcgcatagaaaacattaagcatgagcacaaaagcacttggcattacgacgaggataatccctataagacctgggcctaccacggaagttatgaagtgaagccttccggcagcgcttcttcaatggttaacggcgtcgtgaaattgctcacaaagccatgggacgtgatccccatggtcactcagatcgcgatgaccgatacaaccccttttgggcaacagagggttttcaaagagaaggtggacactcggacgccaaaagccaagagaggaacagcacagattatggaagtaaccgctaagtggctgtggggttttctaagtcgcaataaaaagcccaggatatgtactcgagaggagttcacccggaaagtgagatccaacgccgcaatcggcgccgtctttgtggacgagaatcaatggaacagcgctaaggaggccgttgaagatgagaggttctgggaccttgtgcatcgcgaacgtgagctgcacaaacaggggaagtgcgcgacatgcgtctacaatatgatgggaaagcgggagaaaaagctcggcgagtttggtaaagcaaaggggtctagagccatttggtacatgtggctgggagctaggttcttggagttcgaagccctgggctttatgaacgaggatcactggttctcgcgcgaaaattcactcagcggcgtggagggggagggacttcataaactgggttatatcttacgagacatttccaagatcccgggcgggaacatgtacgcagatgacacggctggatgggatacccggataactgaagacgatctgcagaatgaggccaaaatcacagacattatggaacctgagcacgctttgctcgccaagagtatctttaagctgacctatcagaacaaagtagttagagtgcaaaggccagcaaagaatggcactgtcatggatgtgatttctcgcagagaccagcggggtagcggacaggtgggaacatacggcctaaacaccttcacaaacatggaagcgcagcttatcaggcaaatggagtccgagggcatattttcacccagtgaactggagactcctaatctcgcccgtcgagtcctggattggttggaaaaacatggggttgagcgcttaaagagaatggctatttctggagacgactgtgtggtaaaaccaatcgatgaccggttcgccaccgcactgacggctctcaacgatatgggtaaggtgaggaaggacatcccccagtgggaaccgagcaaaggctggaatgattggcagcaggtccctttttgctcccaccacttccatcaacttattatgaaggacgggcgcgagatagtggttccctgtagaaaccaggatgagctggtgggacgggccagggtctcacagggcgcaggttggagcctacgagaaaccgcctgcctggggaaatcttatgcgcagatgtggcaactcatgtactttcaccgtagagacttgcgcctggctgccaatgcaatctgttccgccgtgccagtagattgggttcctacaagtcggactacctggagcattcatgctcaccatcagtggatgacaactgaggacatgctttcggtgtggaacagggtctggatcgaagagaatccctggatggaagataagacccacatttcctcttggggagacgtgccatatctgggcaaaagagaggaccagtggtgcggctcactcatcgggttaacggcccgcgcaacatgggctaccaacatacaagttgccatcaatcaggtgcggaggctgattggaaacgagaattacttggattacatgactagcatgaagcgattcaagaacgaaagtgaccccgagggtgcgctgtggtga

SEQ ID NO: 13795 - RNA, 9879 nt, synthetic construct
  misc_feature 1..9879: note = derived and/or modified CDS sequence (opt3) from DENV-1__FJ882553__SS-prME
  source 1..9879: mol_type = other RNA
agcgtgaccatgctgctcatgcttatgcccaccgccctggctttccacttgactacgcggggcggggaacctcatatgatcgtctccaagcaggaaaggggaaagtctttactgtttaagacctcagccggtgttaatatgtgcacgctaattgccatggacctcggcgaactgtgtgaagatactatgacctacaaatgcccacggattacagaaaccgaaccggacgatgtggactgttggtgcaatgcgactgatacatgggtgacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaggacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaggcccctacaaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccgggagcttcaaactggagaaggaagtcgccgagacgcagcacggtacagtgcttgttcagataaagtacgagggcaccgacgctccttgcaaaatcccattctcgactcaagatgaaaagggggtgacacagaacggacgcttgattaccgcgaatcccatcgtaactgacaaagagaagcctgtcaacatagaagcagagccaccctttggcgagtcttatattgtgatcggtgccggggaaaaagctctgaagctctcctggttcagaaagggctcaagtatcggaaaaatgtttgaggccaccgcaaggggcgcccggcgaatggctattctgggggatacagcctgggacttcggaagcatcggtggcgtttttacgtccgtggggaaacttgtccatcagattttcggaaccgcatacggcgtgctgttttctggtgtaagctggactatgaaaatagggatcggcgtgttgctcacatggctgggattaaattcacgcagtacctccctgagcatgacatgtattgcggttggcctagtcactctctacctgggggtgatggtgcaggctgattctggatgcgtcatcaactggaagggcagagaacttaaatgtggttcagggatcttcgttaccaatgaggtgcacacgtggacagaacaatataagtttcaggccgacagtccgaagaggttgagcgcagccattggaaaggcttgggaggagggcgtgtgcggtatacggtccgccacccgcctggaaaacatcatgtggaagcagatttctaacgagctcaatcatatcctgttagaaaacgacatgaaattcactgtagtcgtgggcgatgttgcagggattctggctcagggaaagaaaatgatcagacctcaacccatggagtacaagtattcgtggaaaagctggggcaaggccaagataatcggggcggacgtgcagaataccacatttattatcgatggaccaaacactcctgaatgtcccgacgatcagagggcctggaatatttgggaggtcgaggactacggcttcggtatctttaccacaaacatatggcttaaattgcgtgattcctatacacaggtgtgcgaccaccggctcatgtcagctgcaattaaggatagtaaagccgttcacgctgacatggggtactggatcgaatctgagaagaatgaaacctggaaactggcccgagcatccttcattgaggtgaagacttgtatctggccaaagtcccatacactatggtcaaacggagtactggaaagcgagatgataatccccaaaatttatggcggtcctatctctcaacacaattacagaccaggctacttcacccagactgcggggccgtggcatctcggaaagctggagcttgattttgacttgtgcgaaggcacaaccgtcgtggtggatgagcactgcgggaacaggggaccctccctgcgcacgactaccgtcacaggcaaaattatccacgaatggtgttgccggagttgtaccttacctccactcagattcaggggtgaggacgggtgctggtatggaatggagatacgccccgttaaggaaaaagaggaaaatctggtaaagagcatggtatctgccggctccggtgaggtggactcatttagtcttggcctgttgtgtattagcatcatgatcgaagaggtcatgcgatcgcggtggtcccgtaagatgctcatgactgggacactggctgtgttctttctactgattatgggacagctcacctggaacgatctgatcagactttgcattatggttggcgccaatgcatctgacaggatggggatgggaacaacttacttggctctgatggccaccttcaaaatgcgccctatgtttgcagtgggcttactcttccggagactgacgagcagggaggtccttctgctaacaataggtctctcactggtggccagtgttgaattgccaaactccctggaggaattaggggatggactcgctatgggcatcatgattctgaaacttctgaccgactttcaatctcatcagttgtgggcgactctcctgagcctaaccttcatcaaaacaactttttccctgcactatgcctggaagaccatggcaatggtgctttcaattgtcagcctcttccccctgtgtttgagtacgacatctcagaaaaccacttggctgccggtattactcggctccctggggtgcaagcctcttacaatgtttctgatcgctgagaataagatatggggacgacgcagctggccattgaacgaaggtatcatggccgtgggcattgtttcgatcctcctgtcatctctactgaaaaacgatgtgccccttgccgggcctctcattgctggaggcatgctgatcgcatgttacgtcataagtggttccagcgccgacttgtctttagagaaggcggctgaggtgagctgggaagaggaagccgagcattccggggcatcacacaatattctggtagaagtgcaggatgacggaaccatgaaaatcaaggatgaggagcgggacgatactctcacaatcctgcttaaagccaccctgttggctgtcagtggcgtttatcccctaagcattccagcaacgctgttcgtgtggtacttctggcaaaagaaaaagcagagatctggcgtgctctgggacactccttcacccccagaagtcgagagggccgtgctggatgacgggatatatcgtatcatgcagcgcggacttttaggtcggagccaggttggcgtaggggtgtttcaagaaaacgtcttccataccatgtggcacgtgacaagaggagcggttctgatgtaccagggcaagaggctcgagccgagttgggctagcgtgaaaaaggacttgatttcctacggtgggggatggcgactgcagggctcttggaataccggcgaggaagtccaggtgatcgccgtagagcctgggaaaaaccccaagaatgtccaaacagcaccaggaacttttaaaacccccgaaggtgaggtgggcgccattgctctcgatttcaagcctgggacgtcgggaagcccaatcgttaaccgggaaggcaagatagtgggtctgtatgggaatggagtcgtgacaacttcaggcacctacgtttccgccatcgcacaggctaaagccagtcaggagggcccccttcctgagattgaagacgaggtgtttcgcaagagaaacctgacaatcatggatttgcacccggggtctggaaaaaccaggcggtatctaccagcgattgtccgagaagccatcaagagaaaactgcgcactctcatattagcacccaccagggtggtagctagcgagatggccgaagctctgaagggtatgcctattcgttaccaaacaacggcagtgaagtccgagcatactggcaaagagatcgttgaccttatgtgccacgccaccttcacaatgcggctgctctcaccagtcagagtgcccaattataacatgatcattatggatgaagcccattttaccgacccttctagcatcgctgcgagggggtacataagtactcgcgtgggaatgggcgaggcagccgctattttcatgacagccaccccgcccggttccgtcgaagcatttccacagagcaatgccgtaatccaggatgaggaacgagacattcctgagagatcttggaactcagggtatgagtggatcacggatttccccggaaagactgtgtggtttgttccatccataaaaagtggcaatgacattgctaactgtttgcggaagaatggcaaaagggtgatccagctgagccgcaagacattcgataccgaataccaaaagaccaaaaacaacgactgggactacgtcgtgactacagatatctcggagatgggggcgaatttccgtgccgacagagttattgatcctcggaggtgcctcaagcccgtgatcctgaaagacggaccagaacgcgtcattcttgcaggtccgatgcctgtgaccgtagcttctgccgcacagcgaagaggccggatagggaggaaccacaataaggagggagatcagtatatctacatgggccagcccctaaacaatgacgaggatcatgcccactggacagaagctaaaatgctgttggacaacattaatactccagagggtatcatccccgccttatttgaacctgagcgcgaaaagtccgcggcaattgatggggagtatagactgaggggcgaggcccggaagacgttcgtggaactcatgcgtcgcggagacctgccagtttggcttagctacaaagtcgcttcagagggctttcaatatagtgatcgaagatggtgcttcgacggggaaaggaacaatcaggtgctggaggaaaacatggatgtggagatatggaccaaggagggagaacggaaaaagctccgccccagatggttggacgccaggacatactctgaccctctggctctacgggagtttaaagagttcgcagccggtcgaagatccgtcagcggcgatctgatcctcgagattgggaaacttccgcagcacctgactcagcgcgctcaaaatgccttagacaacttggttatgctgcataattcagaacagggaggcagggcatatcggcacgcgatggaggagctcccagataccatcgaaacactgatgcttctggccctcattgctgtgttgaccggtggggtaactctgtttttcttaagtggccgtggactaggcaaaacgagcatcgggctgctctgtgtgatggcctcctctgtccttctgtggatggcaagcgtggagccccattggatagctgcctccatcattttggaatttttcctgatggttctcctgatccctgagcccgacagacagaggaccccacaggataaccaacttgcatacgtggtcattggactcctgtttatgatcttgacagtagccgctaatgagatgggtctgttagaaactaccaagaaggacctaggcatagggcacgtggcggttgagaaccaccatcacgccgcaatgctggatgtggacctccatcctgcttcagcctggacactttacgccgtcgcaaccactattatcacacccatgatgcgccacacgattgaaaacaccactgctaatatctctctgacagccatagcgaaccaggctgccatcttgatgggactggataaaggctggccaattagtaagatggacatcggtgtgcctctcctggcacttgggtgctattcgcaggtcaatccgttaaccctgaccgccgctgtgctcatgttggttgcacattacgccattatcggccccggactgcaagcgaaagctacacgggaggcccagaagcgaactgcagccggcataatgaaaaacccaacggtggatgggattgtagctatcgacctagatcctgtggtctatgacgccaagttcgaaaagcagctgggacagatcatgctccttattctgtgtaccagccaaatcttgctgatgagaacaacttgggcactctgcgagtccataaccctggctacaggccccttaaccactctttgggagggttctccagggaaattttggaatacgacaattgccgtttcaatggcgaacatcttcaggggaagctacctggccggcgcaggtctcgctttctccctaatgaagagtctgggcgggggacgccggggcaccggggcccagggagaaactttgggcgagaaatggaagagacagctgaatcagctctctaaaagcgaatttaacacctataagcgttcaggtattatggaggtggacaggtccgaagcaaaggaggggcttaaacggggagagacaactaagcacgctgtcagtcgcggcaccgccaaactgcgatggttcgtggaaagaaatttggtaaagcctgagggtaaagtgatcgatctgggctgtgggaggggaggctggagctactattgcgccgggctcaagaaggttacagaagtgaaaggatacacgaagggcggtcccgggcacgaggaaccgataccaatggcgacctacggatggaacttagtcaaactgcattctggcaaggacgtgtttttcatccctcccgagaaatgtgatactcttctgtgcgacattggcgagtcctcaccaaatcccacaatcgaagaggggcggaccctacgcgtcctcaagatggtggaaccttggctgagaggaaaccaattttgtattaaaatcttgaatccgtatatgcccagcgttgtagagactctggagcagatgcagaggaagcacggtggcatgctcgtgcgaaacccactttcgagaaattctacacatgaaatgtactgggtcagttgcgggaccggaaacattgtgtccgctgttaatatgacgagccgtatgctgttaaacagattcaccatggcacaccgcaagcctacatatgagagggatgtggacctgggcgccggtactcggcacgtcgctgtggaacccgaggtagccaacttggatatcatagggcagagaattgaaaatatcaaacatgagcacaagtcaacctggcattacgacgaggataacccttataaaacatgggcataccacggatcctatgaagtgaagccatctggcagcgccagttccatggttaatggcgtcgtgaaactcctgactaagccctgggacgtgatccctatggtcacccaaattgctatgacagataccactccatttgggcagcagcgcgttttcaaggagaaagtggacacgaggacacccaaggcgaaacgaggaaccgcccaaataatggaagtaactgcaaagtggctatggggttttcttagccggaacaaaaagccgagaatctgtaccagggaggagttcacacgcaaggtgcgttctaatgctgccattggcgcagtctttgtggacgagaaccagtggaactcagccaaagaggctgttgaagatgagcggttctgggacctggtgcatagagaaagggagctccacaagcaggggaaatgcgccacgtgcgtctacaacatgatgggaaagcgcgagaagaagctgggcgagtttggtaaggcgaaagggagtcgagcaatctggtacatgtggttgggagcccggttcctggagttcgaagctctcggctttatgaatgaggatcactggttctccagagaaaacagcctttctggcgtggagggggagggactgcataagttaggttatattctgagggacatctcgaaaatacctggcgggaatatgtacgccgatgacaccgcaggatgggatactcgcatcacagaagacgatttgcagaacgaggctagaattaccgacatcatggaaccagagcacgccctcctggctaagtcaatttttaaactaacttatcaaaataaggtagttcgggtgcagaggcccgccaaaaacggcacagtcatggatgtgatcagccgtcgagaccagcgcggttccggacaggtgggaacctacggccttaatacattcactaacatggaagcacaactgataagacagatggagagtgagggcatattttctcctagcgaactcgagaccccaaacctggcggaacgggtcttggattggttagagaagtatggggttgaaaggctgaagcgcatggccatctccggagacgactgtgtggtaaaacccatcgatgacagattcgctacggccctcaccgcacttaatgatatgggtaaggtgcggaaagacattccgcagtgggagccttcaaagggctggaacgattggcagcaagtccccttttgcagtcatcacttccaccagctgataatgaaagacgggagggagatcgtggttccatgtcgaaatcaggatgagctagtgggacgtgctagagtctctcagggcgccggttggagcctgcgcgagacagcatgcctcgggaagtcctacgcccaaatgtggcagttgatgtattttcatcggagggacctgagacttgcggctaacgccatttgttcagcagtgcctgtagattggatccccactagccgcaccacatggtctattcacgcccatcaccagtggatgactaccgaagacatgctgtccgtttggaatcgggtgtggatcgaggaaaacccatggatggaggataagacgcatataagtagctggggagacgtcccctacctcggcaaaagggaggaccaatggtgcggctcgttaatcgggctgacagctcgagccacctgggcaactaatattcaggtggctatcaaccaggttagacggttgattggaaatgaaaactacctggattatatgacatccatgaagaggttcaaaaatgagtctgaacctgagggtgccctctggtga

SEQ ID NO: 13796 - RNA, 9879 nt, synthetic construct
  misc_feature 1..9879: note = derived and/or modified CDS sequence (opt3) from DENV-1__FJ882554__SS-prME
  source 1..9879: mol_type = other RNA
agcgtgaccatgctgctcatgcttatgcccaccgccctggctttccacttgactacgagaggaggggaacctcatatgatcgtctccaagcaggaaagggggaagtctttactgtttaagacctcagccggtgttaacatgtgcacgctaattgccatggacctcggagagctgtgtgaagatactatgacctacaaatgcccacggattacagagaccgaaccggacgatgtggactgttggtgcaatgcgactgatacatgggtgacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagaacaggacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattacaccccaggcccctacaaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccggcagcttcaaactggagaaggaagtcgccgagacgcagcacggtacagtgcttgttcagataaagtacgagggcaccgacgctccttgcaaaatcccattcttgactcaagatgaaaagggggtgacacagaacggacgcctgattaccgcgaatcccatcgtaactgacaaagagaagcctgtcaacatagaagcagagccaccctttggcgagtcgtatattgtgatcggtgccggggaaaaagctctcaagctgtcttggttcaagaaaggctcctcaatcggaaagatgtttgaggccaccgcaagaggcgccaggcggatggctattcttggggatacagcctgggacttcggaagtatcggtggcgtttttacgagcgtggggaaactggtccatcagattttcggaaccgcatacggcgtgttgttttccggtgtatcttggactatgaagatagggatcggcgtgctcctgacatggttaggactgaatagccgatcaaccagtctatccatgacatgtattgcggttggcctcgtcactctgtaccttggggtgatggtgcaggctgatagcggatgcgtcatcaactggaaaggccgcgaattgaagtgtggttctgggatcttcgttaccaatgaggtgcacacgtggacagaacaatataagtttcaggccgactcaccgaaaagactgagtgcagccattggaaaggcttgggaggagggcgtgtgcggtataaggagcgccacccggctcgaaaacatcatgtggaaacagatttccaacgagctgaatcatatcttactggaaaacgacatgaagttcactgtagtcgtgggcgatgttgcagggattcttgctcagggcaagaaaatgatccgccctcaacccatggagtacaaatattcttggaagtcgtggggcaaggccaaaataatcggggcggacgtgcagaataccacatttattatcgatggaccaaacactcctgaatgtcccgacgatcagagagcctggaatatttgggaggtcgaggactacggcttcggtatctttaccacaaacatatggttgaagctcagggatagctatacacaggtgtgcgaccaccgtctgatgtccgctgcaattaaagattcaaaggccgttcacgctgacatggggtactggatcgaaagtgagaaaaatgaaacctggaagctagcccgggcatctttcattgaggtgaagacttgtatctggccaaaaagccatacactgtggtccaacggagtactcgaatcagagatgataatccccaagatttatggcggtcctatcagccaacacaattaccgaccaggctacttcacccaggcggccgggccgtggcatctgggaaaacttgagttggattttgacctgtgcgaaggcactacagtcgtggtggatgagcactgcgggaacagaggaccctctttaaggaccacgactgtcaccggcaagattatccacgaatggtgttgccgctcctgtacactccctccactgcggttcagaggtgaggacgggtgctggtatggaatggagataaggcccgttaaagaaaaggaggaaaatcttgtgaagagtatggtaagcgctggctctggtgaggtggactccttttcactgggcttgctctgtattagtatcatgatcgaagaggtcatgcgcagccgatggtcgcggcgtatgctgatgaccgggactctagccgtgttctttctgctcattatgggacagctgacatggaacgatcttatcagattgtgcattatggttggcgcaaatgcttccgacaggatggggatgggaaccacatacctggccttaatggcaactttcaaaatgcgccctatgtttgccgtgggcctcctgttccggagacttacctctagggaggtcctgctactcacgataggtctgagcttggtggcttcagttgaactgccaaacagtttagaggaactcggggatggactggcgatgggcatcatgattcttaagctgttgacagactttcaatcccatcagctctgggccaccctgctatctctgactttcatcaaaaccacatttagccttcactatgcatggaagactatggctatggtgctctccattgtctcactgttccccttgtgtctgagcaccacgagtcagaaaacaacctggttaccggtactcctgggctctcttgggtgcaagcctctgactatgtttttgatcgccgagaataagatatggggacgacgctcctggccactcaacgaaggtatcatggccgtgggcattgttagcatcctgctatcgtcactgcttaaaaacgatgtgcccctcgctgggcctctgattgcaggaggcatgttgatcgcctgttacgtcatatctggtagttccgcggacttaagcctggagaaggctgccgaggtgtcttgggaagaggaagcagagcatagcggggcctcccacaatattctcgtagaagtgcaggatgacggaacaatgaaaatcaaggatgaggagcgggacgataccctgactatccttctgaaagctacattgctagcagtctcaggcgtttatcccctgagtattccagccaccctcttcgtgtggtacttctggcaaaagaaaaagcagagaagcggcgtgctgtgggacacgccttctcccccagaagtcgagagggcggtgcttgatgacgggatatatcgtatcatgcagcgcggattactgggtcggtcccaggttggcgtaggggtgtttcaagaaaacgtcttccatactatgtggcacgtgaccagaggagctgttctcatgtaccagggcaagaggttggagccgtcatgggccagtgtgaaaaaggacctgattagctacggtgggggatggcgactccagggctcctggaatacaggcgaggaagtccaggtgatcgcagtagagcctgggaaaaaccccaagaatgtccaaaccgccccaggaacatttaaaactcccgaaggtgaggtgggcgctattgccctggatttcaagcctgggacctctggatcgccaatcgttaaccgggaaggcaagatagtgggtctttatgggaatggagtcgtgacgacaagcggcacttacgtttcagcaatcgctcaggccaaagcgtcccaggagggccccctgcctgagattgaagacgaggtgtttcgcaagagaaacttgaccatcatggatctacacccggggagtggaaaaacaaggcggtatctgccagccattgtccgagaagcaatcaagagaaaactccgcaccttaatactggctcccactagggtggtagcctctgagatggctgaagcacttaagggtatgcctattcgttaccaaaccacagccgtaaagagcgagcatacgggcaaagagatcgttgacctgatgtgccacgccactttcaccatgcggctcttgtccccagtcagagtgcccaattataacatgatcattatggatgaagctcattttacagacccttactcaatcgcggcaagggggtatatatctacccgcgtgggaatgggcgaggccgctgccattttcatgactgcaacaccgcccggtagcgtcgaagcctttccacagagtaatgctgtaatcaaggatgaggaacgagacattcctgagagatcctggaacagcgggtacgagtggatcaccgatttccccggaaaaacggtgtggtttgttccatctataaagtcaggcaatgacattgcgaactgtctgcggaaaaatggcaagagggtgatccagctctcccgcaagactttcgatacagaataccagaaaaccaagaacaacgactgggactatgtcgtgaccactgatatcagtgagatgggggccaatttccgtgcagacagagttattgatcctcggaggtgcctgaaacccgtgatccttaaggacggaccagaacgcgtcattctagctggtccgatgcctgtgacagtagccagcgcagcccaacgaagaggccggatagggaggaaccacaataaagagggagatcagtacatctatatgggccagcccctgaacaatgacgaggatcatgctcactggaccgaagccaagatgttgttagacaacattaatacaccagagggtatcatccccgcgctgtttgaacctgagcgcgaaaagtcggcagccattgatggggagtacagactcaggggcgaggctcggaaaactttcgtggaactgatgcgtcgcggagaccttccagtttggctgtcttataaggtcgcctccgagggctttcagtacagcgatcgaagatggtgcttcgacggggaaaggaacaatcaagtgctcgaggaaaacatggatgtggagatatggacgaaagagggagaacggaagaaattgcgccccagatggctggacgctaggacctattcagaccctctagcactgcgggagtttaaggagttcgccgctggtcgaagaagtgtctctggcgatctcatccttgagattgggaaactgccgcagcacttaacacagcgcgcccagaatgcattggacaacctggttatgctccataattccgaacaaggaggcagggcgtaccggcacgccatggaggagctgccagatactatcgaaacccttatgctgctcgctttgattgccgtgctgacaggtggggtaaccttatttttcctaagcggccgtggactgggcaagacttcaatcgggctcctttgtgtgatggcaagtagcgtcctgttgtggatggcttccgtggagccccattggatagccgcatctatcattctggaatttttcctcatggttctgcttatccctgagcccgacagacagaggacgccacaggataaccagctcgcctacgtggtcattggactgttgtttatgatcctgaccgtagctgcgaatgagatgggtttactagaaacaactaagaaagacctgggcatagggcacgtggccgttgagaaccaccatcacgcagctatgctcgatgtggaccttcatcctgccagcgcctggaccctgtatgcagtcgctacaaccattatcactcccatgatgcgccacacaattgaaaacacgaccgccaatatctccttgactgcgatagctaaccaagccgcaatcctgatgggactcgataagggctggccaatttcaaaaatggacatcggtgtgcctctgcttgccttagggtgctactctcaggtcaatccgctgacactcaccgctgcagtgttgatgctggttgcccattatgcgattatcggccccggactacaggctaaggccacccgggaggcacaaaaacgaacagccgctggcataatgaagaacccaactgtggatgggattgtagccatcgacctggatcctgtggtctacgacgcaaagttcgaaaaacagctcggacagatcatgcttctgattttgtgtacgagtcagatcctgctcatgagaaccacatgggctctgtgcgagtcgataactttagccaccggcccccttacaaccctgtgggagggtagcccagggaagttttggaatactacgattgcggtttccatggccaacatcttcaggggatcttatctcgcaggcgctggtctagccttctcactgatgaagtccttgggcgggggacgccggggcacaggggcacaaggagaaaccctgggcgagaagtggaaaagacagctcaatcagcttagcaagagtgaatttaacacttacaagcgttctggtattatggaggtggacaggagcgaagctaaagaggggctgaagcggggagagaccacaaaacacgccgtctcacgcggcactgccaagttgcgatggttcgtggaaagaaatctggtaaaacctgagggtaaggtgatcgatctcggctgtgggaggggaggctggtcctattactgcgcggggttaaagaaagttaccgaagtgaagggatacacaaaaggcggtcccgggcacgaggaaccgataccaatggctacgtatggatggaacctggtcaaacttcatagtggcaaagacgtgtttttcatccctcccgagaagtgtgataccctgctatgcgacattggcgagagctctccaaatcccactatcgaagaggggcggacactccgcgtcctgaaaatggtggaaccttggttgagaggaaaccagttttgtattaagatcctgaatccgtacatgccctccgttgtagagaccctcgagcaaatgcagaggaagcacggtggcatgcttgtgcgaaacccactgtcacggaatagcactcatgaaatgtattgggtctcgtgcgggacaggaaacattgtgtctgcagttaatatgaccagtcgtatgttactgaacagattcacgatggcccaccgcaaacctacctacgagagggatgtggacttgggcgctggtacacggcacgtcgccgtggaacccgaggtagcaaacctcgatatcatagggcagagaattgaaaatatcaagcatgagcacaaatccacttggcattatgacgaggataacccttacaagacctgggcctatcacggaagctacgaagtgaaaccatcaggctccgcttctagcatggttaatggcgtcgtgaagctgctaacaaagccctgggacgtgatccctatggtcactcagattgcgatgaccgatacaaccccatttgggcaacagcgcgttttcaaagagaaggtggacactaggacgcccaaagccaagcgaggaacagcacagataatggaagtaaccgctaaatggctttggggttttctgagtcggaacaagaagccgagaatctgtactagggaggagttcacccgcaaagtgcgttccaatgccgcaattggcgccgtctttgtggacgagaaccaatggaatagcgctaaggaggccgttgaagatgagcggttctgggacctcgtgcatagagaaagggagctgcacaaacaggggaagtgcgcgacatgcgtctacaacatgatgggaaaacgcgaaaagaagttgggcgagtttggtaaagcaaaggggtctcgagccatctggtatatgtggctgggagctcggttcctcgagttcgaagcccttggctttatgaatgaggatcactggttctcaagagaaaacagtctgtccggcgtggagggggagggattacataaactgggttacattttgagggacatcagcaagatacctggcgggaatatgtatgcagatgacacggctggatgggatacccgcatcactgaagacgatctccagaacgaggccagaattacagacatcatggaaccagagcacgctctgctagccaaatctatttttaaacttacctaccagaataaagtagttcgggtgcaaaggcccgcaaagaacggcactgtcatggatgtgatctcgcgtcgagaccagcgcggttcaggacaggtgggaacatatggcctgaataccttcacaaacatggaagcgcagctcataagacaaatggagagcgagggcatattttcccctagtgaactggagactccaaacttggccgaacgggtcttagattggctggagaagtacggggttgaaaggctcaaacgcatggctatctctggagacgactgtgtggtaaagcccatcgatgacagattcgccaccgcacttacggctctgaatgatatgggtaaagtgcggaaggacattccgcagtgggagcctagcaaaggctggaacgattggcagcaggtccccttttgctcccatcacttccaccaactaataatgaaggacgggagggagatcgtggttccatgtcgaaatcaggatgaactggtgggacgtgccagagtctcacagggcgcaggttggagtctccgcgagaccgcctgcttggggaagtcttatgcgcagatgtggcaactgatgtactttcatcggagggaccttagactggctgccaacgcaatttgtagcgccgtgcctgtagattggatccccacatcccgcactacctggtcaattcacgctcatcaccagtggatgacaactgaagacatgctcagcgtttggaatcgggtgtggatcgaggaaaacccatggatggaggataaaacccatatatcttcctggggagacgtcccctacttaggcaagagggaggaccagtggtgcggcagtctgatcgggttgacggcccgagcaacatgggctaccaatattcaagtggccatcaaccaggttagacggctgattggaaatgaaaactatctcgattacatgactagcatgaaaaggttcaagaatgagtcggaccctgaaggtgcgctttggtga

SEQ ID NO: 13797 - RNA, 9879 nt, synthetic construct
  misc_feature 1..9879: note = derived and/or modified CDS sequence (opt3) from DENV-1__GQ868610__SS-prME
  source 1..9879: mol_type = other RNA
agcgtgaccatgctgctcatgcttatgcccaccgcactggctttccacttgactacgagaggaggggaacctcatatgatcgtcaccaagcaggaaaggggaaaatccttactgtttaagacatctgccggtgttaatatgtgcactctaattgccatggacctcggcgaactgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactgggagcttcaaactggagaaggaagtggctgagacccagcacggtacggtccttgtgcagataaagtacgagggcacagacgcgccttgcaaaatcccattctcgacccaagatgaaaagggggttactcagaacggacgcttgattacagcaaatcccatcgtgaccgacaaagagaagcctgtaaacatagaagccgagccaccctttggcgagtcttatattgtcatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtgtttacatccgttgggaaacttgtgcatcagattttcggaacggcgtacggcgtcctgttttctggtgtgagctggaccatgaagatagggatcggcgtattgctcacttggctgggattaaattcacgaagtacatccctgagcatgacctgtattgctgtgggcctaatcacactctacctgggggttatggtccaggccgattctggatgcgtgatcaactggaaaggccgcgaacttaagtgtggttcagggattttcgtgactaatgaggtccacacctggacggaacaatataagtttcaggcagacagtccgaaaagattgagcgccgctataggaaaggcctgggaggagggcgtttgcggtatcaggtccgcaacacggctggaaaacattatgtggaaacagatctctaacgagctcaatcatattctgttagaaaacgacatgaagttcaccgtggtggtaggcgatgtcgtggggatcctggctcagggcaagaagatgatacgccctcaacccatggagcacaaatactcgtggaaaagctggggcaaggccaaaatcattggggcggacgttcagaatactacctttatcattgatggaccaaacacacctgaatgtcccgacgatcagagagcctggaatatctgggaggtggaggactatggcttcggtatatttactaccaacatttggcttaagttgagggattcctacacacaggtctgcgaccaccgtctcatgtcagctgcaatcaaagatagtaaggccgtgcatgctgacatggggtattggattgaatctgagaaaaatgaaacgtggaagctggcccgggcatccttcatcgaggttaagacctgtatatggccaaaatcccacactctatggtcaaacggagtgctggaaagcgagatgatcattcccaagatctacggcggtcctatttctcaacataattatcgaccaggctacttcacacagaccgcggggccgtggcacctcggaaaactggagcttgattttgacttgtgcgaaggcactacagtagtcgtggatgagcactgcgggaacagaggaccctccctgaggaccacgactgtgaccggcaagatcatacatgaatggtgttgccgcagttgtacattacctccactccggttcaaaggtgaggacgggtgctggtacggaatggagattagacccgtcaaggaaaaggaggaaaatctggttaaaagcatggtgtctgccggctccggtgaggtagactcatttagtcttggcctgttgtgtatcagcatcatgattgaagaggtgatgaggtcgcgctggtcccgaaagatgctcatgaccgggactctggctgtcttcctactgctcatcatgggacagctgacatggaacgatcttattcggttgtgcataatggtgggcgccaatgcatctgaccgtatggggatgggaaccacatatctggctttaatcgccacttttaaaatgagacctatgttcgcagttggcctcctgtttaggcgccttaccagccgggaggtgctgctactcacgattggtctgtcattggtcgccagtgtggaactgccaaactccttagaggaactcggggatggactggctatgggcatcatgattcttaagctgttgacagacttccaatctcaccagctctgggcgaccctgctgagctttactttcatcaaaaccacattatcccttcattacgcctggaagactatggcaatggttctctcaatagtgagcctgtttcccttgtgtctgagtaccacgtctcagaagacaacctggttaccggtcctcctgggctcccttgggtgcaaacctctgactatgttcttgatcgctgagaataagatttggggaagaaaaagctggccactcaacgaaggtatcatggccgtaggcgtggtttcgattctgctatcatctctgcttaagaacgatgtgcccctcgccgggcctctgatcgctggaggcatgttgatagcatgttatgtcattagtggttccagcgccgacttatctctggagaaagcggctgaggtgagctgggaagaggaagccgagcactccggggcatcacataatatcctcgtagaagtgcaggatgacggaacaatgaagatcaaagatgaggagagggacgataccctgactattcttctgaaggccacattgctagctgtcagtggcgtttaccccctgagcataccagcaaccctctttgtgtggtatttctggcaaaagaaaaagcagcgatctggcgtgctgtgggacacgccttcacccccagaagtcgagcgcgccgtgcttgatgacgggatctaccggattatgcagagaggattactgggtaggagccaggttggcgtaggggtgttccaagaaaacgtctttcacactatgtggcacgtgacccgtggagcggttctcatgtatcagggcaaacgcttggagccgagttgggctagcgtgaagaaagacctgatctcctacggtgggggatggcggctccagggctcttggaatacaggcgaggaagtccaggtgattgccgtagagcctgggaagaaccccaagaatgtccaaaccgcaccaggaacattcaaaactcccgaaggtgaggtgggcgccatcgctctggattttaagcctgggacctcgggaagcccaatagttaacagagaaggcaaaatcgtgggtctttacgggaatggagtcgtgacgacatcaggcacttatgtttccgccattgcacaggctaaggccagtcaggagggccccctgcctgagatcgaagacgaggtgttcaggaaacgaaacttgaccattatggatctacatccggggtctggaaagacacggcgctacctgccagcgatcgtcagagaagccataaagaggaaactccggaccttaattctggcacccactcgagtggtagctagcgagatggccgaagctcttaagggtatgcctatcagatatcaaaccacagcagtgaaatccgagcacacgggcaaggagatcgttgacctgatgtgccatgccacttttaccatgcgcctcttgtcaccagtcagggtgcccaattacaacatgattatcatggatgaagcccacttcacagacccttctagcatagctgcgcgtgggtatattagtacccgggtgggaatgggcgaggcagccgctatctttatgactgccacaccgcccggttccgtcgaagcattcccacagagcaatgccgtaattcaggatgaggaaagagacatccctgagaggtcttggaactcagggtacgagtggataaccgattttcccggaaaaacggtgtggttcgttccatccattaagagtggcaatgacatcgctaactgtctgcgcaagaatggcaaacgagtgatccagctcagcagaaagacttttgatacagaatatcagaaaaccaagaacaacgactgggactacgtcgtgaccactgatatttcggagatgggggcgaatttccgggccgacagggttatcgatcctcgccgttgcctgaaacccgtgattcttaaggacggaccagaaagagtcatactagcaggtccgatgcctgtgacagtagcttctgccgcacagcggaggggccgcatcgggcgaaaccataataaggagggagatcagtacatttatatgggccagcccctgaacaatgacgaggatcacgcccactggaccgaagctaaaatgttgttagacaacatcaatacaccagagggtatcattcccgccctgttcgaacctgagagagaaaagtccgcggcaatagatggggagtaccggctcaggggcgaggcccgcaaaacttttgtggaactgatgagaaggggagaccttccagtttggctgagctataaggtcgcttcagagggcttccaatacagtgatcggcgttggtgctttgacggggaacgcaacaatcaggtgctcgaggaaaacatggatgtggagatctggacgaaagagggagaacgaaagaaattgagacccaggtggctggacgcccggacctattctgaccctctagctctgcgcgagttcaaggaatttgcagccggtagaaggtccgtcagcggcgatctcattcttgagatcgggaagctgccgcagcatttaacacagcgggctcaaaatgccttggacaacctggttatgctccacaattcagaacagggaggccgagcatacagacatgcgatggaggagctgccagatactattgaaacccttatgctgctcgccttgatcgctgtgctgacaggtggggtaaccttattctttctaagtggccgcggactgggcaaaactagcatagggctcctttgtgtgatggcctcctctgtcctgttgtggatggcaagcgtggagccccactggatcgctgcctccattatcctggagttctttctcatggttctgcttattcctgagcccgacaggcagcggacgccacaggataaccaactcgcatatgtggtcatcggactgttgttcatgatactgaccgtagccgctaatgagatgggtttactagaaacaactaagaaagacctgggcattgggcacgtggcggttgagaaccatcaccatgccaccatgctcgatgtggaccttcaccctgcatcagcttggacactgtacgccgtcgccaccactatcattacacccatgatgcgtcatacgatcgaaaacaccactgcaaatatatctttgacagctatcgccaaccaggcggctattctgatgggactcgataagggctggccaatcagtaaaatggacattggtgtgcctctgcttgccttagggtgctactcgcaggtcaatccgctgaccctcaccgcagccgtgttgatgctggttgctcactatgcaatcataggccccggactacaagccaaggcgacaagagaggctcagaagaggactgccgcaggcattatgaaaaacccaacggtggatgggatcgtagccatcgacctggatcctgtggtctacgacgctaagtttgaaaaacagctcggacagattatgcttctgatcttgtgtaccagccaaatactgctcatgcgcacaacttgggccctgtgcgagtccattaccttagcaacaggcccccttaccactctgtgggagggttctccagggaagttctggaatacgacaatcgctgtttcaatggccaacatttttcggggaagctatctcgcgggcgccggtctagcattctccctgatgaaaagtttgggcgggggacgaagaggcaccggggctcagggagaaactctgggcgagaagtggaagaggcagctcaatcagctttctaaaagcgagttcaacacctacaagcgctcaggtatcatggaggtggaccggtccgaagccaaagaggggctgaagagaggagagacaactcgtcacgcagtcagtaggggcaccgctaaattgcggtggtttgtggaacgcaatctggtaaagcctgagggtaaggtgatagatctcggctgtgggcgaggaggctggagctattactgcgccgggctaaagaaggttacagaagtgaaaggatatacgaagggcggtcccgggcatgaggaaccgatcccaatggccacctacggatggaacctggtcaaacttcactctggcaaggacgtgttctttactcctcccgagaaatgtgatacactgctatgcgacattggcgagtcctcaccaaatcccaccatcgaagaggggagaactctcagggtcctgaagatggtggaaccttggttgcggggaaaccaattctgtattaagatcctgaatccgtacatgcccagcgttgtagagacactcgagcagatgcagcgcaaacatggtggcatgcttgtgagaaacccactgtcgagaaattctacccacgaaatgtattgggtcagttgcgggacgggaaacattgtgtccgcggttaatatgaccagccgaatgttactgaaccggtttacaatggctcaccgtaagcctacttacgagagagatgtggacttgggcgcaggtacccgccatgtcgccgtggaacccgaggtagctaacctcgatatcatagggcagaggattgaaaatatcaaacacgagcataagtcaacatggcactatgacgaggataacccttacaaaacttgggcctatcatggatcctacgaagtgaagccatctggcagcgcaagttccatggttaatggcgtcgtgaagctgctaaccaaaccctgggacgtgatccctatggtcacacaaattgccatgaccgatactacgccattcgggcagcagcgggtttttaaggagaaagtggacacaagaacccccaaggctaaacgcggaactgcgcaaataatggaagtaaccgccaagtggctttggggtttcctgagcaggaacaagaaaccgcgaatctgtacacgggaggaatttacgagaaaggtgaggtctaatgcagctattggcgccgtcttcgtggacgagaaccagtggaactcagcaaaagaggccgttgaagatgagcgcttttgggacctcgtgcagaaggaacgtgagctgcacaaacaggggaagtgcgctacctgcgtctataacatgatgggaaagcgggagaaaaagttgggcgagttcggtaaagccaaggggagtagagcgatctggtacatgtggctgggagcaaggtttctcgagttcgaagcccttggcttcatgaatgaggatcactggttttcccgcgaaaacagcctgtctggcgtggagggggagggattacataaactgggttacattttgcgagacatctcgaagatacctggcgggaatatgtatgctgatgacactgccggatgggatacacggatcaccgaagacgatctccaaaacgaggcaaaaattactgacatcatggaaccagagcacgctctgctagccacatcaattttcaaacttacctaccagaataaggtagttagagtgcagaggcccgctaaaaacggcacagtcatggatgtgatcagccgcagagaccagcggggttccgggcaagtgggaacttatggcctgaatacctttacgaacatggaagcccagctcataaggcagatggagagtgagggcattttcctgccttctgaattggagaccccaaacttagcagaacgtgtcctggattggctcgagaagtacggggttgaacgacttaaacgcatggcgatcagcggagacgactgtgtggtaaagcccatcgatgacagatttgccacagctctgactgccctaaatgatatgggtaaagtgcggaaggacattccgcagtgggagccttccaagggctggaacgattggcaacaggtccccttctgctcacatcactttcaccagctgataatgaaagacgggagggagatcgtggttccatgtcgcaatcaggatgaactcgtgggaagggcacgggtcagtcaaggcgctggttggtctttgagggagaccgcctgcctgggaaagagctatgcacagatgtggcagcttatgtacttccatcgacgtgacctgagactcgccgcgaacgctatttgttccgccgtgcctgtagattgggttcccacatcacgcactacctggagcatccacgcacatcaccaatggatgacgacagaagacatgttatctgtgtggaatcgggtctggattgaggaaaacccatggatggaggataaaacccatgtgtccagttggggagacgttccctatctgggcaagagggaggaccagtggtgcggcagcttgatcgggctgactgccagagctacatgggcctcgaatatacaggtggcaatcaaccaggtccgccggctcattggaaatgaaaactaccttgattacatgacctccatgaaaaggtttaagaatgagggtgaccctgaaggcgctctgtggtga

SEQ ID NO: 13798 - RNA, 9879 nt, synthetic construct
  misc_feature 1..9879: note = derived and/or modified CDS sequence (opt3) from DENV-1__GQ868611__SS-prME
  source 1..9879: mol_type = other RNA
agcgtgaccatgttcctgatgctcatgcccacagcccttgcttttcacctgactacgcggggaggggaacctcatatgatcgtctccaagcaggaaaggggaaaatctttgttattcaagacctcagccggtgttaatatgtgcacactgattgccatggacctaggcgaactctgtgaagatactatgacctacaaatgcccacggataacagaaaccgaaccggacgatgtggactgttggtgcaatgcgactgatacatgggtaacctatgggacgtgtagtcaaactggagagcaccgccgagacaagcgtagcgtggctctggcaccccatgtcggccttggtctggagaccagaacagaaacttggatgtcctctgagggggcatggaaacagatccagagggtggaaacctgggccttgcggcaccctggatttacagttattgctctcttcctggcacatgccatcggcacctcgattacgcagaagggcatcatatttatcctgctcatgttagtgactccatcaatggctatgcgctgcgtcgggattggaagcagagatttcgtggagggtctgagtggcgccacatgggtagacgttgtgcttgagcacgggtcctgtgtcaccactatggcgaaggataaacccacattggacatcgaactgctaaagaccgaggtgacgaaccctgcagtgctcaggaaactgtgcattgaagccaagatctctaataccacaactgatagccggtgtccaacccaaggagaggctacacttgtcgaagaacaggacgccaactttgtttgccgccgaactttcgtggatagaggctggggtaatgggtgtggactgtttggcaaaggctccttgataacctgcgcaaagttcaagtgcgtaacaaaactcgaggggaagattgtgcagtacgaaaacctgaaatattcagtcatcgtgaccgttcacactggagaccagcatcaagtgggtaatgagagtacggaacacggcacaaccgctactattacaccccaagcccctaccaccgagatccagttaactgactacggggcgctgacactcgattgtagcccaaggacgggacttgactttaacgaaatggtcctgttgaccatgaaggagaaatcttggctagtgcataagcagtggttcctggatctcccgctgccctggacttccggcgcctcaacaagccaagagacctggaatcggcaggaccttctggtaacatttaaaactgcacacgctaagaagcaggaagttgtggtcttgggtagtcaagagggggccatgcacaccgctctcacgggcgccaccgaaatccagacatctggaactaccacaattttcgcaggccatctgaaatgccgtttaaagatggataaactgactctaaaggggatgtcctatgtgatgtgtaccgggtcgttcaaactcgagaaggaactggccgagacgcagcacggtacagtccttgtgcagataaagtacgagggcaccgacgctccttgcaaaatcccattttcgactcaagatgaaaagggggttacacagaacggacgcttgattaccgcgaatcccatcgtgactgacaaagagaagcctgtaaacatagaagcagagccacccttcggcgagtcttatattgtcatcggtgccggggaaaaagctctgaagctctcctggtttaagaaaggctcaagtatcggaaagatgttcgaggccaccgcaagaggcgccaggcggatggctattctgggggatacagcctgggactttggaagcatcggtggcgtgttcacgtccgttgggaaacttgtgcatcagatttttggaaccgcatacggcgtcctgttctctggtgtgagctggactatgaagatagggatcggcgtattgctcacatggctgggattaaattcacgaagtacctccctgagcatgacatgtattgcggtgggcctagttactctctacctgggggtcatggtgcaggctgattctggatgcgtgatcaactggaaaggccgcgaacttaagtgtggttcagggatctttgtcaccaatgaggttcacacgtggacagaacaatataagttccaggccgacagtccgaaaagattgagcgcagccattggaaaggcttgggaggagggcgtgtgcggtataaggtccgccacccggctggaaaacatcatgtggaaacagatttctaacgagctcaatcatatcctgttagaaaacgacatgaagtttactgtggtagtcggcgatgtggcagggattctggctcagggcaagaagatgatccgccctcaacccatggagtacaaatattcgtggaaaagctggggcaaggccaagataatcggggcggacgttcagaataccacattcattatcgatggaccaaacactcctgaatgtcccgacgatcagagagcctggaatatttgggaggtggaggactacggctttggtatcttcaccacaaacatatggcttaagttgagggattcctatacgcaggtctgcgaccaccgtctcatgtcagctgcaattaaagatagtaaggccgtgcacgctgacatggggtactggatcgaatctgagaaaaatgaaacctggaagctggcccgggcatccttcattgaggttaagacttgtatctggccaaaatcccatacactatggtcaaacggagtgctggaaagcgagatgataatccccaagatttatggcggtcctatctctcaacacaattaccgaccaggctactttacccagactgcggggccgtggcatctcggaaaactggagcttgatttcgacttgtgcgaaggcacaaccgtagtcgtggatgagcactgcgggaacagaggaccctccctgaggacgactaccgtgacaggcaagattatccacgaatggtgttgccgcagttgtaccttacctccactccggtttagaggtgaggacgggtgctggtatggaatggagataaggcccgtcaaagaaaaggaggaaaatctggttaagagcatggtgtctgccggctccggtgaggtagactcattcagtcttggcctgttgtgtattagcatcatgatcgaagaggtgatgcgctcgcgatggtcccggaaaatgctcatgactgggacactggctgtctttttcctactgattatgggacagctcacctggaacgatctgatccgtctttgcattatggtgggcgccaatgcatctgacagaatggggatgggaacaacttacttggctctgatggccacctttaagatgaggcctatgttcgcagttggcttactctttcgccggctgacgagcagagaggtgcttctgctaacaataggtctctcactggtcgccagtgtggaattgccaaactccctggaggaattaggggatggactcgctatgggcatcatgattctgaaacttctgaccgacttccaatctcatcagttgtgggcgactctcctgagcctaacctttatcaagacaactttctccctgcactatgcctggaaaaccatggcaatggttctttcaattgtgagcctctttcccctgtgtttgagtacgacatctcagaagaccacttggctgccggtcttactcggctccctggggtgcaagcctcttacaatgttcctgatcgctgagaataaaatatggggaaggcgaagctggccattgaacgaaggtatcatggccgtaggcattgtgtcgatcctcctgtcatctctactgaagaacgatgttccccttgccgggcctctcattgctggaggcatgctgatcgcatgttacgtgataagtggttccagcgccgacttgtctttagagaaagcggctgaggtcagctgggaagaggaagccgagcattccggggcatcacacaatattctggtggaagtacaggatgacggaaccatgaagatcaaagatgaggagcgcgacgatactctcacaatcctgcttaaggccaccctgttggctgtgagtggcgtctatcccctaagcattccagcaacgctgttcgtttggtacttttggcagaaaaagaagcagcggtctggcgtgctctgggacactccttcacccccagaagtggagagagccgtcctggatgacgggatatataggatcatgcagcgtggacttttaggtcgcagccaggtgggcgttggggtattccaagaaaacgtgtttcataccatgtggcacgtcacacggggagcggtgctgatgtaccagggcaaaagactcgagccgagttgggctagcgttaagaaagacttgatttcctacggtgggggatggaggctgcagggctcttggaataccggcgaggaagtgcaggtcatcgccgtggagcctgggaagaaccccaaaaatgtacaaacagcaccaggaactttcaagacccccgaaggtgaggtcggcgccattgctctcgattttaagcctgggacgtcgggaagcccaatcgtgaaccgagaaggcaaaatagttggtctgtatgggaatggagtggtcacaacttcaggcacctacgtgtccgccatcgcacaggctcgggccagtcaggagggcccccttcctgagattgaagacgaggttttccgcaagagaaacctgacaatcatggatttgcacccggggtctggaaaaaccaggcggtatctaccagcgattgtgcgagaagccatcaagagaaaactgcgcactctcatattagcacccaccagggtcgtggctagcgagatggccgaagctctgaagggtatgcctattcgttaccaaacaacggcagtaaagtccgagcatactggcaaagagatcgtggaccttatgtgccacgccacctttacaatgcggctgctctcaccagttagagtccccaattataacatgatcattatggatgaagcccatttcaccgacccttctagcatcgctgcgagggggtacataagtactcgcgtgggaatgggcgaggcagccgctatttttatgacagccaccccgcccggttccgtggaagcattcccacagagcaatgccgtcatccaggatgaggaacgagacattcctgagagatcttggaactcagggtatgagtggatcacggattttcccggaaagactgtatggttcgtgccatccataaaaagtggcaatgacattgctaactgtttgcggaagaatggcaaaagggttatccagctgagccgcaagacattcgataccgaataccaaaagaccaaaaacaacgactgggactacgtggtcactacagatatctcggagatgggggcgaattttcgtgccgacagagtgattgatcctcggaggtgcctcaagcccgttatcctgaaagacggaccagaacgcgtgattcttgcaggtccgatgcctgtcaccgtggcttctgccgcacagcgaagaggccggatagggaggaaccacaataaggagggagatcagtatatctacatgggccagcccctaaacaatgacgaggatcatgcccactggacagaagctaaaatgctgttggacaacattaatactccagagggtatcatccccgccttattcgaacctgagcgcgaaaagtccgcggcaattgatggggagtatagactgaggggcgaggcccggaagacgtttgtagaactcatgcgtcgcggagacctgccagtgtggcttagctacaaagttgcttcagagggcttccaatatagtgatcgaagatggtgctttgacggggaaaggaacaatcaggtcctggaggaaaacatggatgtggagatatggaccaaggagggagaacggaaaaagctccgccccagatggttggacgccaggacatactctgaccctctggctctacgggagttcaaagaatttgcagccggtcgaagatccgtgagcggcgatctgatcctcgagattgggaaacttccgcagcacctgactcagcgcgctcaaaatgccttagacaacttggtcatgctgcataattcagaacagggaggcagggcatatcggcacgcgatggaggagctcccagataccatcgaaacactgatgcttctggccctcattgctgttttgaccggtggggtgactctgttctttttaagtggccgtggactaggcaaaacgagcatcgggctgctctgtgtaatggcctcctctgtgcttctgtggatggcaagcgtcgagccccattggatagctgcctccatcattttggagttctttctgatggtgctcctgatccctgagcccgacagacagaggaccccacaggataaccaacttgcatacgttgtgattggactcctgttcatgatcttgacagtcgccgctaatgagatgggtctgttagaaactaccaagaaggacctaggcatagggcacgtagcggtggagaaccaccatcacgccgcaatgctggatgttgacctccatcctgcttcagcctggacactttacgccgtggcaaccactattatcacacccatgatgcgccacacgattgaaaacaccactgctaatatctctctgacagccatagcgaaccaggctgccatcttgatgggactggataaaggctggccaattagtaagatggacatcggtgtccctctcctggcacttgggtgctatagccaggtgaatccgttaaccctgaccgccgctgtcctcatgttggtggcacattacgccattatcggccccggactgcaagcgaaagctacacgggaggcccagaagcgaactgcagccggcataatgaaaaacccaacggttgatgggattgtggctatcgacctagatcctgtagtgtatgacgccaagtttgaaaagcagctgggacagatcatgctccttattctgtgtaccagccaaatcttgctgatgagaacaacttgggcactctgcgagtccataaccctggctacaggccccttaaccactctttgggagggttctccagggaaattctggaatacgacaattgccgtctcaatggcgaacatcttcaggggaagctacctggccggcgcaggtctcgctttttccctaatgaagagtctgggcgggggacgccggggcaccggggcccagggagaaactttgggcgagaaatggaagagacagctgaatcagctctctaaaagcgagttcaacacctataagcgttcaggtattatggaggttgacaggtccgaagcaaaggaggggcttaaacggggagagacaactaagcacgctgtgagtcgcggcaccgccaaactgcgatggtttgtcgaaagaaatttggtgaagcctgagggtaaagtaatcgatctgggctgtgggaggggaggctggagctactattgcgccgggctcaagaaggtgacagaagttaaaggatacacgaagggcggtcccgggcacgaggaaccgataccaatggcgacctacggatggaacttagtgaaactgcattctggcaaggacgtcttctttatccctcccgagaaatgtgatactcttctgtgcgacattggcgagtcctcaccaaatcccacaatcgaagaggggcggaccctacgcgtgctcaagatggtcgaaccttggctgagaggaaaccaattctgtattaaaatcttgaatccgtatatgcccagcgtggttgagactctggagcagatgcagaggaagcacggtggcatgctcgtacgaaacccactttcgagaaattctacacatgaaatgtactgggtgagttgcgggaccggaaacattgtctccgctgtgaatatgacgagccgtatgctgttaaacagatttaccatggcacaccgcaagcctacatatgagagggatgttgacctgggcgccggtactcggcacgtggctgtcgaacccgaggtggccaacttggatatcatagggcagagaattgaaaatatcaaacatgagcacaagtcaacctggcattacgacgaggataacccttataaaacatgggcataccacggatcctatgaagtaaagccatctggcagcgccagttccatggtgaatggcgttgtcaaactcctgactaagccctgggacgtgatccctatggtgacccaaattgctatgacagataccactccattcgggcagcagcgcgtctttaaggagaaagttgacacgaggacacccaaggcgaaacgaggaaccgcccaaataatggaagtgactgcaaagtggctatggggtttccttagccggaacaaaaagccgagaatctgtaccagggaggaatttacacgcaaggtacgttctaatgctgccattggcgcagtgttcgtcgacgagaaccagtggaactcagccaaagaggctgtggaagatgagcggttttgggacctggttcatagagaaagggagctccacaagcaggggaaatgcgccacgtgcgtgtacaacatgatgggaaagcgcgagaaaaagctgggcgagttcggtaaggcgaaagggagtcgagcaatctggtacatgtggttgggagcccggttcctggagtttgaagctctcggcttcatgaatgaggatcactggttttccagagaaaacagcctttctggcgtcgagggggagggactgcataagttaggttatattctgagggacatctcgaaaatacctggcgggaatatgtacgccgatgacaccgcaggatgggatactcgcatcacagaagacgatttgcagaacgaggctagaattaccgacatcatggaaccagagcacgccctcctggctaagtcaattttcaaactaacttatcaaaataaggtggtacgggttcagaggcccgccaaaaacggcacagtgatggatgtcatcagccgtcgagaccagcgcggttccggacaggtgggaacctacggccttaatacatttactaacatggaagcacaactgataagacagatggagagtgagggcattttctctcctagcgaactcgagaccccaaacctggcggaacgggtgttggattggttagagaagtatggggtcgaaaggctgaagcgcatggccatctccggagacgactgtgttgtgaaacccatcgatgacagatttgctacggccctcaccgcacttaatgatatgggtaaggtacggaaagacattccgcagtgggagccttcaaagggctggaacgattggcagcaagtgcccttctgcagtcatcactttcaccagctgataatgaaagacgggagggagatcgtcgtgccatgtcgaaatcaggatgagctagttggacgtgctagagtgtctcagggcgccggttggagcctgcgcgagacagcatgcctcgggaagtcctacgcccaaatgtggcagttgatgtatttccatcggagggacctgagacttgcggctaacgccatttgttcagcagtccctgtggattggatccccactagccgcaccacatggtctattcacgcccatcaccagtggatgactaccgaagacatgctgtccgtatggaatcgggtttggatcgaggaaaacccatggatggaggataagacgcatataagtagctggggagacgtgccctacctcggcaaaagggaggaccaatggtgcggctcgttaatcgggctgacagctcgagccacctgggcaactaatattcaggtcgctatcaaccaggtgagacggttgattggaaatgaaaactacctggattatatgacatccatgaagaggtttaaaaatgagtctgaccctgaaggtgccctctggtga

SEQ ID NO: 13799 - RNA, 9879 nt, synthetic construct
  misc_feature 1..9879: note = derived and/or modified CDS sequence (opt3) from DENV-1__FJ882555__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagttctgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagagcaggacgcaaactttgtttgccgccgaacattcgtggatagaggctggggtaatgggtgtggactgtttggcaaaggctccttgataacttgcgctaagttcaagtgcgtaaccaaactcgaggggaagattgtgcagtacgaaaacctgaaatattcagtcatcgtgacagttcacaccggagaccagcatcaagtgggtaatgagagtactgaacacggcacgacagccaccattactccccaggcgcctagcaccgagatccagttaacagactacggggccctgaccctcgattgttctccaaggactggacttgactttaacgaaatggtcctgttgacaatgaaggagaaatcctggctagtgcataagcagtggttcctggatctcccgctgccctggacgtcaggcgcaagcgctagtcaagagacctggaatcggcaggaccttctggtaacttttaaaacagcccacgctaagaagcaggaagttgtggtcttgggttctcaagagggggccatgcacaccgcactcacaggcgccactgaaatccagacctccggaacgaccacaattttcgctggccatctgaaatgccgtttaaagatggataaactgactctaaaggggatgagctatgtgatgtgtaccggatcgttcaaactcgagaaggaagtcgcggagacacagcacggtactgtgctggttcagataaagtacgagggcaccgacgcaccttgcaaaatcccattttctacgcaagatgaaaagggggtgacacagaacggacgccttattaccgccaatcccatcgtaactgacaaagagaagcctgtcaacatagaagctgagccacccttcggcgagtcctatattgtgatcggtgccggggaaaaagcattgaagctgtcatggtttaagaaaggcagtagcatcggaaagatgttcgaggccacagctagaggcgccaggcggatggcaattctcggggataccgcgtgggactttggatccatcggtggcgttttcacttctgtggggaaactggtccatcagatttttggaaccgcttacggcgtgcttttcagcggtgtatcatggacaatgaagatagggatcggcgtgctgttgacgtggctcggactgaatagtcgatccaccagcttatctatgacttgtattgccgttggcctggtcacactatacctcggggtgatggtgcaggcagattcaggatgcgtcatcaactggaaaggccgcgaactgaagtgtggtagtgggatctttgttaccaatgaggtgcacacatggactgaacaatataagttccaggccgacagcccgaaaagactttccgctgccattggaaaggcatgggaggagggcgtgtgcggtataaggtctgctacccggttggaaaacatcatgtggaaacagatttcgaacgagctgaatcatatcctcctggaaaacgacatgaagttaacggtagtcgtgggcgatgttgccgggattctggcgcagggaaaaaagatgatccgccctcaacccatggagtacaaatatagctggaagtcctggggcaaggccaaaataatcggggctgacgtgcagaatacaacctttattatcgatggacagaacactccagaatgtcctgacgatcagagagcatggaatatttgggaggtcgaggactacggcttcggtatctttaccacaaacatatggcttaagttgagggattcatatactcaagtgtgcgaccaccgtctcatgagtgccgctattaaagattctaaggccgttcacgcagacatggggtactggatcgaaagcgagaaaaatgaaacctggaagctggcgcgggcctccttcattgaggtgaagacatgtatctggcccaaatcacatacgctatggagcaacggagtactggaatctgagatgataatcccaaagatttatggcggtcccatctcccagcacaattaccgacctggctacttcacccagactgctgggccatggcatctcggaaaactggagcttgattttgacttgtgcgaaggcacaaccgtcgtggtggatgagcactgcgggaacagaggaccgagtctgaggactacaaccgtcacgggcaagattatccacgaatggtgttgccgcagctgtactttaccccctctccggttcaaaggtgaggacgggtgctggtatggaatggagataagaccagttaaggaaaaggaggaaaatctggtgaaatctatggtatccgccggctcaggtgaggtggacagttttagccttggcctgttgtgtatttcgatcatgatcgaagaggtcatgaggtcccgctggtctcgaaagatgctcatgaccgggacactggcagtgttctttctactgattatgggacaactcacctggaacgatctgatccggctttgcattatggttggcgctaatgccagcgaccgtatggggatgggaactacatacttggcactgatggccaccttcaaaatgagacccatgtttgctgtgggcttactcttcaggcgcctgacatcacgggaggtccttctgctaactataggtctcagtctggtggcgtccgttgaattgcctaactctctggaggaattaggggatggactcgccatgggcatcatgattctgaagcttctgaccgactttcagagccatcagttgtgggcaacgctcctgtccatgacattcatcagaaccactttttcactacactatgcttggaaaaccatggccatggtgctgagcattgtcagtcttttcccactctgtctgtctacaacttcccagaagaccacgtggttgcccgtactgttaggcagcctcgggtgcaagccgctgacaatgtttcttatcgccgagaataaaatatggggaaggaagtcgtggcctctgaacgaaggtatcatggctgtgggcattgtttcaatcttgctctctagtctgctaaaaaacgatgtgccactggcagggccccttattgccggaggcatgctcatcgcgtgttacgtcatatccggtagctctgctgacctgagcttggagaaggccgcagtggtatcctgggaggaagaggccgaacattcaggggctagtcacaatattttagtggaggtccaagatgacggaaccatgaaaatcaaggatgaagagcgagacgatactctgacaatcctcctgaaagcaacccttctggccgttagcggcgtgtatcctttgtctattcccgcgactctattcgtgtggtacttctggcagaagaagaaacagcgctccggcgtcctgtgggacacaccatcacctcccgaggtggaacgggctgttctcgatgacgggatatatagaatcatgcagaggggactgcttggtcgtagtcaagtaggcgtgggggtctttcaggagaacgtgttccataccatgtggcacgttacgcgcggagccgtgttaatgtaccagggcaagcggctggaaccaagctgggcatccgtcaaaaaggacctcatttcttacggtgggggatggagattgcagggctcgtggaatactggcgaggaggtgcaagtaatcgccgtcgaaccggggaaaaaccctaagaatgtgcagaccgctcccggaacatttaagaccagcgagggtgaagttggcgccattgcactggatttcaaaccagggacatcaggatcccccatcgtgaacagggagggcaaggtcgtgggtctctatgggaatggagttgtgactaccagtggcacgtacgtctctgctatagcccaggcgaaagccagccaagaaggccctctgccagagatcgaggacgaagtgtttcgaaagcggaaccttacaattatggatctgcaccccgggtccggaaaaactcgcagatatttgcctgcaatcgtaagggaggctattaagcggaagctacgaaccctgatcctcgccccgacaagagtggttgcttcagaaatggcagaggccttaaaaggtatgccaatacgctaccagaccactgccgtcaagtctgaacataccggcaaagagattgtggacctgatgtgccacgctacattcacgatgaggcttctgagccccgtgcgtgtccctaattataacatgatcatcatggatgaggcgcattttactgacccaagttccattgcagcccgggggtacatcagcaccagagtaggaatgggcgaagctgccgcaatattcatgacagccaccccccctggttctgtggaggcttttccgcagtcaaatgcggttattcaggatgaagagagggacatccccgaacgctcctggaacagtgggtatgagtggattactgatttcccaggaaagacagtgtggtttgtccctagcatcaaatcgggcaatgacatagccaactgtctccgaaagaatggcaagagagtgattcaattgtctcggaaaaccttcgatacggagtaccagaagactaaaaacaacgactgggactacgttgtgacaaccgatatctccgaaatgggggcaaatttcagggctgaccgcgtcatcgatccccgtagatgcctgaagccagtgattctcaaagacggacctgagcgggtaatcctggccggtcccatgccagtgaccgttgcaagcgccgctcagaggcgcggccgaattgggagaaaccacaataaggaaggagatcagtatatatacatgggccaaccgcttaacaatgacgaggatcatgcccactggactgaggcgaagatgctactggacaacatcaatacacctgaaggtattatccccgcattgtttgagccagaacgggagaaatcagccgctatcgatggggaatataggttacgcggcgaggccagaaagaccttcgtcgagctgatgaggcggggagacctccccgtgtggctgagttacaaagtggcttctgaaggctttcagtattccgatcgtcgctggtgcttcgacggggagcgaaacaatcaggtccttgaagagaacatggatgttgaaatttggacaaaggagggagagagaaaaaagctgaggcctcggtggctcgacgcacgcacttacagcgacccattggccctgagagaatttaaagagttcgctgccggtaggcggtcagtgagtggcgatctaatactggaaatcgggaagctcccccagcaccttacgcaacgagcacagaatgcgctggacaacttagtaatgttgcataatagcgagcagggaggcagagcctatcgccacgctatggaagagctgcctgataccattgagacactcatgctgcttgccctgatcgcagtgctcactggtggggtcaccttgtttttcctgtccggcaggggattaggcaagacatctattgggctactgtgtgtgatggctagctccgttctcctttggatggcctcagtggaaccgcattggatcgcagcctctataatcctggagtttttcttgatggtcctgctcattccagaacccgaccggcagcgtacccctcaagataaccagctggcttacgtagtgatcggacttctctttatgattctgactgttgcggccaatgagatgggtttgctggagacgaccaaaaaggacttaggcatcgggcacgtggcagtcgaaaaccaccatcacgctgccatgctagatgtggacctgcatcccgccagtgcatggacactctacgctgtcgccactaccataattacaccaatgatgagacacaccatcgagaacactacagcgaatatttcgcttacggctatcgccaaccaggcagccatactgatgggattggataaaggctggcctatcagcaagatggacattggtgtgcccctgctcgctctggggtgctattcccaagttaatccacttaccttaactgcagccgtgctgatgctcgtagcgcattacgctatcattggccctggattgcaggccaaagcaacaagggaagcccagaagcgcaccgctgccggcatcatgaagaacccgaccgtggatgggatagtcgcaattgacctggatcccgttgtgtatgacgctaaattcgagaagcagctaggacaaatcatgctgctcatcctttgtacatctcagattctgttgatgcggactacgtgggccctgtgcgaatcaatcaccctcgcgacaggcccactgactaccttatgggagggtagccctgggaaattttggaatacaaccatagccgtctccatggcaaacattttccgaggaagttaccttgctggcgccggtctggcattctctctcatgaagagcctaggcgggggaagaaggggcactggggctcagggagagacgctgggcgaaaaatggaagcgccagttgaatcaactgtcaaagtccgagtttaacacatataaacggagtggtatcatggaagtggacagaagcgaggccaaggaagggctcaaacgtggagagaccactaagcacgccgtatctaggggcaccgcgaaacttcggtggttcgtggagcgcaatctggttaagcccgaaggtaaggtgattgatttgggctgtgggcgaggaggctggtcctactattgcgctgggctgaaaaaggtcacagaggtgaaaggatacactaagggcggtccagggcacgaagagcctatccccatggcaacctacggatggaacctcgtcaaattacattcaggcaaggacgtgtttttcataccgccagaaaaatgtgatacactgctttgcgacatcggcgagagctcgcctaatcccacgattgaggaagggagaaccctgagggttctaaagatggtagagccatggctccggggaaaccagttttgtatcaagattctgaatccctatatgccttctgtggtcgaaactttggagcagatgcagcgcaaacacggtggcatgctggtgagaaacccgctcagtaggaattccacacatgagatgtactgggttagctgcgggaccggaaacatcgtgtcagccgtcaatatgacttcccgaatgcttctgaaccggttcacaatggctcaccgtaagcccacctatgaaagagatgtggacttaggcgccggtacgcgccacgtagcagtggagccagaagttgccaacctggatattatcgggcaaaggatagagaatattaaacatgaacacaagtctacctggcattacgacgaggataacccttataaaacatgggcttaccacggaagctatgaggtcaagcccagtggctccgcgagctctatggtgaatggcgtggtcaagttgctcactaaaccttgggacgttatcccaatggtgacccagatcgccatgacagatactaccccctttgggcagcaacgggtattcaaggaaaaagtggacacaagaacccctaaggcaaaacgcggaactgctcagattatggaggtcacggccaagtggctgtggggttttctatcaaggaacaagaaaccacgaatatgtacacgggaagagttcaccagaaaggtgaggagtaatgcagccatcggcgctgtttttgtggacgaaaaccagtggaattccgccaaagaggcggtcgaggatgaacgcttctgggaccttgtgcatcgtgagcgggaactgcacaagcaggggaaatgcgcaacttgcgtatacaacatgatgggaaagagagagaagaaactcggcgaatttggtaaggccaaagggagcagggctatttggtacatgtggctgggagcccgcttcttggagttcgaggcactgggctttatgaatgaagatcactggttctctcgagagaactcgctctcaggcgttgaaggggagggacttcataagctgggttatatcttacgggacattagcaaaatccccggcgggaatatgtacgctgatgacaccgccggatgggatacaagaataacggaggacgatctgcaaaacgaagctaagatcaccgacattatggagccggaacacgccttgctcgcaaaatccatctttaagctgacttatcagaataaggtggtcagggtgcagcgccctgcgaaaaacggcacagtgatggatgtcattagtagacgggaccagaggggttctgggcaagttggaacctacggcctaaatactttcacaaacatggaggcccagcttatccgtcagatggaaagcgagggcatattttccccatcagagctggaaacccccaacctcgctgggcgagccctggattggttggagaagcatggagtggaacgcttaaaaagaatggcaattagtggtgacgactgtgtagtgaagcctatcgatgaccggttcgctacagccctgactgcactcaatgatatgggcaaagtcaggaaggacatcccacagtgggagccctctaaggggtggaacgattggcaacaggtgccgttttgcagccaccacttccatcagcttattatgaaagacggacgcgaaatagttgtgccttgtagaaatcaggatgagctggtcggccgggccagggtgtcccaaggtgcggggtggtcactacgagagaccgcttgcctgggaaagagctatgcccagatgtggcagctcatgtactttcaccgtagagacttgcgcctggcagccaacgctatctgttctgccgtacccgttgattgggtgccaacgtcccggaccacatggagtattcatgcacaccatcaatggatgactaccgaagacatgcttagcgtctggaatagggtgtggatcgaggaaaacccttggatggaggataaaacacacatttcgtcctggggcgacgttccctatctgggcaagagagaagaccagtggtgcgggtctctcatcggattaactgctcgcgccacctgggcgacgaatatacaggtggctatcaaccaggtccggaggctgttgggtaatgagaactacctggattacatgacatcaatgaaacgattcaagaatgagagcgacccagaaggcgccctctggtga

SEQ ID NO: 13800 - RNA, 9879 nt, synthetic construct
  misc_feature 1..9879: note = derived and/or modified CDS sequence (opt3) from DENV-1__GQ199821__SS-prME
  source 1..9879: mol_type = other RNA
agcgtgaccatgctgctaatgcttatgcccaccgcactggctttccacttgactacgagaggcggggaacctcatatgatcgtctccaagcaggaaagggggaaatctttactgtttaagacctcagccggtgttaacatgtgcacactaattgcaatggacctcggcgagttctgtgaagatactatgacctacaaatgcccacggataacagaagcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggttgacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaagacgcaaactttgtttgccgccgaacattcgtggatagaggctggggtaatgggtgtggactgtttggcaaaggctccttgataacttgcgctaagttcaagtgcgtaaccaaactcgaggggaagacagtgcagtacgaaaacctgaaatattcagtcattgtgaccgttcacactggagaccagcatcaagtgggtaatgagagtacggaacacggcacaaccgccactatcacaccccaggcgcctagcacagagattcagttaaccgactacggggccctgactctcgattgttctccaaggacaggacttgactttaacgaaatggtcctgttgacgatgaaggagaaatcctggctagtgcataagcagtggttcctggatctcccgctgccctggacctcaggcgcaagcacaagtcaagagacatggaatcggaaagaccttctggtaacctttaagacagctcacgccaagaaacaggaagttgtggtcttgggttctcaggagggggctatgcacactgccctcaccggcgcaacggaaatccaaacctccggaacaactaccatcttcgccggccatctgaagtgccgtttaaaaatggataagctgacactaaaagggatgagctatgtgatgtgtactggatcgttcaagctcgagaaggaagtcgctgagacccagcacggtacggtgctggttcagattaaatacgagggcacagacgcgccttgcaagataccattttctacccaggatgaaaaaggggtgactcaaaacggacgccttatcacagcaaatcccattgtaaccgacaaggagaaacctgtcaacatcgaagccgagccacccttcggcgagtcctatatagtgattggtgctggggaaaaggccttgaagctgtcatggtttaaaaagggcagtagcatcggaaaaatgttcgaggcaactgccagaggcgctaggcggatggccatcctcggggataccgcatgggactttggatccattggtggcgttttcacatctgtggggaagctggtccatcagatctttggaacggcgtacggcgtgcttttcagcggtgtatcatggaccatgaaaattgggataggcgtgctgttgacttggctcggactgaatagtcgatccactagcttatctatgacctgtatcgttgtcggcctggtgacactatacctcggggtgatggtccaggctgattcaggatgcgttattaactggaagggccgcgaactgaagtgtggtagtgggatctttgtgactaatgaggtgcacacctggacggaacagtataaattccaagccgacagcccgaagagactttccgcagccatcggaaaggcttgggaggagggcgtatgcggtattaggtctgccacacggttggaaaacataatgtggaagcagatctcgaacgagctgaatcatattctcctggaaaacgacatgaaatttaccgtcgtggttggcgatgtggcagggatcttagctcagggaaagaaaatgattcgccctcagcccatggagtacaagtatagctggaagtcctggggcaaagccaagatcataggggcggacgtccaaaatactaccttcatcattgatggaccaaacacacctgaatgtcccgacgatcagagagcctggaatatctgggaggtggaggactacggctttggtattttcactaccaacatctggctgaaacttagggattcatatacacaggtttgcgaccaccgtttgatgagtgctgcaataaaggattctaaagccgtgcacgctgacatggggtactggattgaaagcgagaagaatgaaacgtggaagctcgcccgggcatccttcatcgaggtaaaaacctgtatttggccaaagtcacatactctgtggagcaacggagtcctagaatctgagatgatcatacccaaaatctatggcggtcctatttcccagcacaattaccgaccaggctactttacacaaaccgcggggccgtggcatctgggaaagctcgagctggatttcgacctttgcgaaggcactacagtggtggtcgatgagcactgcgggaacagaggacccagtttgaggaccacgactgttaccggcaaaatcattcacgaatggtgttgccgcagctgtacactgcctccattacggtttaagggtgaggacgggtgctggtatggaatggagatcagacccgtgaaggaaaaagaggaaaatctcgtaaagtctatggtgtccgccggctcaggtgaggtcgacagtttcagcctgggccttctgtgtatatcgattatgatcgaagaggtgatgaggtcccgctggtctcgaaaaatgttgatgaccgggactctcgctgtatttttcctgctaatcatgggacagctgacatggaacgatctcattcggctgtgcatcatggtgggcgccaatgcaagcgaccgtatggggatgggaaccacataccttgctttgatggccacttttaagatgagacctatgttcgcagtcggcctgttatttaggcgcctcacctcacgggaggtgctgcttctgacgattggtctaagtctcgttgcctccgtggaactgccaaactctttggaggaactgggggatggattagctatgggcataatgatcctcaaactgcttacagacttccagagccatcaactgtgggcgaccttgctctccctgacttttattaagaccacattctcactacactatgcctggaagactatggcaatggtcctgagcatcgtaagtctttttcccctctgtctgtctaccacgtcccagaaaacaacctggttgccggtgctgttaggcagcctcgggtgcaagcctctgactatgttccttattgctgagaataaaatctggggaagaaagtcgtggccactgaacgaaggtataatggccgttggcatcgtgtcaattttgctctctagtctgctcaagaatgatgtccccctggccgggcctcttatcgctggaggcatgctcattgcatgttacgtgatctccggtagctctgccgacctgagcttggagaaggcggctgaggtatcctgggaagaggaagccgagcattcaggggcaagtcacaatatattagtggaagtccaggatgacggaacaatgaaaattaaggatgaggagagggacgataccctgactatcctcctgaaggccacacttctggctgttagcggcgtgtatcccttgtctatcccagcaaccctattcgtgtggtacttttggcagaaaaagaaacaacgatccggcgtcctgtgggacacgccttcacccccagaagtggagcgcgccgttctcgatgacgggatttatcggataatgcagagaggactgcttggtaggagtcaggtaggcgtgggggtcttccaggaaaacgtgtttcatactatgtggcacgttacccgtggagcggtgttaatgtaccaaggcaagcgcctggagccgagctgggcttccgtcaaaaaggacctcatctcttacggtgggggatggcggttgcagggctcgtggaatacaggcgaggaagtgcaggtaattgccgtcgagcctgggaagaaccccaaaaatgtgcagaccgcaccaggaacattcaagactagcgaaggtgaggttggcgccatcgctctggattttaaacccgggacctcaggatcccctattgtgaacagagaaggcaagatcgtcggtctctatgggaatggagtggttacgacaagtggcacttacgtgtctgccatagcacaagctaaagccagccaggagggcccactgcccgagatcgaagacgaggtcttcaggaagcgaaaccttaccattatggatctgcaccctgggtccggaaagacacggcgctatttgccggcgatcgtgagagaagccattaaaaggaagctacggaccctgatcctcgcaccaactcgagtagtggcttcagagatggccgaggctttaaaaggtatgcccataagataccagaccacagcagttaagtctgagcatacgggcaaagagattgtcgacctgatgtgccacgccacttttaccatgcgccttctgagccctgtgagggtgccaaattataacatgatcatcatggatgaagcccatttcacagaccccagttccattgctgcgcgtgggtacatcagcacccgggtcggaatgggcgaggcagccgctatatttatgactgccacacctccgggttctgtagaagcattcccccaatcaaatgccgtgattcaggatgaggaaagagacatcccagagaggtcctggaacagtgggtatgagtggattaccgattttcctggaaagacggtttggttcgtgcccagcatcaagtcgggcaatgacatagctaactgtctccgcaaaaatggcaagcgagtcattcagttgtctagaaaaactttcgatacagaataccagaagaccaaaaacaacgactgggactacgtggttaccactgatatctccgagatgggggcgaattttcgggccgacagggtgatcgatccacgccgttgcctgaagcctgtcattctcaaggacggacccgaaagagtgatcctggcaggtccaatgccggtaacagtggctagcgccgcacaacggaggggccgcattgggcgaaaccacaataaagagggagatcagtatatatacatgggccagcctcttaacaatgacgaggatcatgcccactggaccgaagctaagatgctactggacaacatcaatacacccgagggtattatcccagccttgttcgaacccgagagagaaaaatcagcggcaatcgatggggagtatcggttaaggggcgaggcccgcaagacttttgttgaactgatgagaaggggagacctccctgtctggctgagttacaaagtggcttctgagggcttccagtattccgatcggcgttggtgctttgacggggaacgcaacaatcaagtgcttgaggaaaacatggatgtcgagatttggacgaaggagggagaacgaaagaaactgagaccaaggtggctcgacgcccggacctacagcgaccccttggctctgcgcgagttcaaagaatttgcagccggtagaaggtcagttagtggcgatctaatactggagatcgggaaactccctcagcaccttacacagcgggctcagaatgccctggacaacttagtgatgttgcataatagcgaacaaggaggccgagcatatagacacgcgatggaggagctgccggatactattgaaaccctcatgctgcttgccctgatcgctgtactcacaggtggggtgaccttgttctttctgtccggccgcggattaggcaagacttctattgggctactgtgtgtcatggccagctccgcactcctttggatcgcttcagtggagccacattggatagccgcatctatcattctggagttctttttgatggttctgctcatccccgagcctgacaggcagcggacgccccaggataaccagctggcctacgtggtcattggacttctcttcatgatcctgaccgtagctgcgaatgagatgggtttgctggaaacaactaaaaaggacttaggcatagggcacgtggccgttgagaaccaccatcacgcagctatgctagatgtggacctgcatccagccagtgcctggaccctctacgcagtcgctacaaccattatcactcctatgatgcgtcacacaattgaaaacacgaccgccaatatctcgcttactgcgatagctaaccaagccgcaatcctgatgggattggataaaggctggcccattagcaagatggacatcggtgtgccactgctcgccctggggtgctattcccaggtcaatcctcttacattaaccgctgcagtgctgatgctcgttgcccattacgcgattatcggcccgggattgcaggctaaggccaccagagaggcacagaagaggacagccgctggcataatgaagaaccccactgtggatgggattgtagccatcgacctggatccagtggtctatgacgcaaaatttgaaaagcagctaggacagatcatgctgctcattctttgtacgtctcagatcctgttgatgcgcaccacatgggctctgtgcgagtcaataactctcgccaccggccctctgacaaccttatgggagggtagccccgggaaattctggaatactacgattgcggtttccatggccaacatcttccggggaagttaccttgcaggcgctggtctggccttttctctcatgaaaagcctaggcgggggacgaagaggcacaggggcacaaggagaaaccctgggcgagaagtggaaaaggcagttgaatcagctgtcaaagtccgagttcaacacttataaacgcagtggtattatggaggtggaccggagcgaagctaaggaggggctcaaaagaggagagaccacaaagcacgccgtctctcgtggcactgccaaacttaggtggtttgtggaacggaatctggtaaaaccagagggtaaggtgatcgatttgggctgtgggcgcggaggctggtcctactattgcgcggggctgaaaaaggttaccgaagtgaaaggatacacaaagggcggtcctgggcacgaggaacccataccgatggctacgtacggatggaacctcgtcaaattacattcaggcaaggacgtgttctttatcccacctgagaagtgtgataccctgctttgcgacattggcgagagctcgcccaatccaactatcgaagaggggcgaacactgagagtcctaaaaatggtggaaccctggctcaggggaaaccagttctgtattaagatcctgaatccttatatgccgtctgttgtagagaccttggagcaaatgcagcggaaacacggtggcatgctggtgcgcaaccccctcagtagaaattccactcatgaaatgtactgggtcagctgcgggacaggaaacattgtgtcagcagttaatatgacctccaggatgcttctgaaccgatttacgatggcccaccggaagccaacctatgagcgtgatgtggacttaggcgctggtacaagacacgtcgccgtggaacctgaggtagcaaacctggatatcatagggcagcgcattgaaaatatcaaacatgagcacaagtctacttggcattacgacgaggataacccctataagacctgggcctaccacggaagctatgaagtgaaacctagtggctccgctagctctatggttaatggcgtcgtgaagttgctcacaaaaccatgggacgtgatccccatggtcactcagattgcgatgaccgatacaacccctttcgggcaacagagggtttttaaggagaaagtggacactcggacgccaaaggccaagagaggaacagcacagataatggaagtaaccgctaaatggctgtggggtttcctatcacgcaacaagaaacccaggatctgtactcgagaggaatttacccggaaggtgagaagtaatgccgcaattggcgccgtcttcgtggacgagaaccaatggaactccgctaaagaggccgttgaagatgagaggttttgggaccttgtgcatcgcgaacgtgagctgcacaagcaggggaagtgcgcgacatgcgtctacaacatgatgggaaaacgggaaaagaaactcggcgagttcggtaaggcaaaagggagcagagccatctggtacatgtggctgggagctaggttcttggagtttgaagccctgggcttcatgaatgaggatcactggttttctcgcgaaaactcgctctcaggcgtggagggggagggacttcataagctgggttatattttacgagacatcagcaaaataccgggcgggaatatgtacgcagatgacacggctggatgggatacccggatcactgaagacgatctgcagaacgaggccaagattacagacatcatggaacctgagcacgctttgctcgccaagtccattttcaaactgacctatcagaataaggtagttagagtgcaaaggccagccaaaaacggcactgtcatggatgtgatcagtcgcagagaccagcggggttctggacaggtgggaacatacggcctaaatacctttacaaacatggaagcgcagcttataaggcaaatggagagcgagggcattttctccccctcagaactggagactcctaacctcgccgggcgtgtcctggattggttggaaaagcatggagttgagcgattaaaacgcatggctatcagtggtgacgactgtgtggtaaagccaatcgatgacagatttgccaccgcactgacggctctcaatgatatgggcaaggtgcggaaagacattccccagtgggaaccgtctaaggggtggaacgattggcagcaggtccctttctgcagccaccactttcatcaacttataatgaaagacggaagggagatcgtggttccctgtcgcaatcaggatgagctggtgggcagagcccgggtctcccagggtgcagggtggtcactaagggaaaccgcctgcctgggaaagagctatgcgcagatgtggcaactcatgtacttccaccgacgtgacttgagactggctgccaacgcaatttgttctgccgtgccagtagattgggttcctacatcccgcactacctggagtatccatgctcaccatcagtggatgacaactgaggacatgcttagcgtgtggaatcgggtctggattgaagagaacccctggatggaagataaaacccacatctcgtcctggggcgacgtgccatatctgggcaagagggaggaccagtggtgcgggtctctcataggattaacggccagagcaacatgggctaccaatatccaagttgccattaaccaggtgcgccggctgatcggtaatgagaactacttggattacatgacttcaatgaagaggtttaaaaatgaaagcgaccccgagggcgcgctgtggtga

SEQ ID NO: 13801 - RNA, 9879 nt, synthetic construct
  misc_feature 1..9879: note = derived and/or modified CDS sequence (opt3) from DENV-1__FJ882556__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagctgtgtgaagatactatgacctacaaatgcccacggataacagagaccgaaccggacgatgtggactgttggtgcaatgcgactgatacatgggtaacctatgggacgtgtagtcaaactggagagcaccgccgagacaagcgtagcgtggctcttgccccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactactcaagaccgaggtgacgaaccctgcagtgctgaggaaactttgcattgaagccaagatctctaataccacaactgatagccggtgtccaacccaaggagaggctacactggtcgaagagcaggacgccaacttcgtttgccgccgaacttttgtggatagaggctggggtaatgggtgtggattgttcggcaaaggctccctcataacctgcgcaaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgctactattaccccccaggcccctacaaccgagatccagctgactgactacggggcgctcacacttgattgtagcccaaggacgggactggacttcaacgaaatggtcttgctaaccatgaaggagaaatcttggctggtgcataagcagtggtttctcgatctgccgcttccctggacttccggcgcctcaacaagccaagagacctggaatcggcaggacctgttggtaacattcaaaactgcacacgctaagaagcaggaagttgtggtcctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtgatgtgtaccggaagcttcaaactggagaaggaagtcgccgagacgcagcacggtacagtgcttgttcagataaagtacgagggcaccgacgctccttgcaaaatcccattctcgactcaagatgaaaagggggtgacacagaacggacgcttgattaccgcgaatcccatcgtatctgacaaagagaagcctgtcaacatagaagcagagccaccctttggcgagtcctatattgtgatcggtgccggggaaaaagctctgaagctctcatggttcaagaaaggcagtagcatcggaaagatgtttgaggccactgcaagaggcgccaggcggatggctattctgggggataccgcctgggacttcggatccatcggtggcgtttttacatctgtggggaaacttgtccatcagattttcggaacggcatacggcgtgctgtttagcggtgtatcatggaccatgaagatagggatcggcgtgttgctcacttggctgggattaaatagtcgatccacaagcctgtctatgacctgtattgcggttggcctagtcacactctacctgggggtgatggtgcaggctgattcaggatgcgtcatcaactggaaaggccgcgaacttaagtgtggtagtgggatcttcgttactaatgaggtgcacacctggacggaacaatataagtttcaggccgacagcccgaaaagattgtccgcagccattggaaaggcttgggaggagggcgtgtgcggtataaggtctgccacacggctggaaaacatcatgtggaaacagatttcgaacgagctcaatcatatcctgttagaaaacgacatgaagttcaccgtagtcgtgggcgatgttgcagggattctggctcagggaaaaaagatgatccgccctcaacccatggagtacaaatatagctggaagtcctggggcaaggccaaaataatcggggcggacgtgcagaatactacctttattatcgatggaccaaacacacctgaatgtcccgacgatcagagagcctggaatatttgggaggtcgaggactacggcttcggtatctttactaccaacatatggcttaagttgagggattcatatacacaggtgtgcgaccaccgtctcatgagtgctgcaattaaagattctaaggccgttcacgctgacatggggtactggatcgaaagcgagaaaaatgaaacgtggaagctggcccgggcatccttcattgaggtgaagacctgtatctggccaaaatcacatactctatggagcaacggagtactggaatctgagatgataatccccaagatttatggcggtcctatctcccaacacaattaccgaccaggctacttcacacaggcggccgggccgtggcatctcggaaaactggagcttgattttgacttgtgcgaaggcaccactgtcgtggtggatgagcactgcgggaacagaggacccagtctgaggacaaccacggtcactggcaagattatccacgaatggtgttgccgcagctgtaccttacctccactccggttcagaggtgaggacgggtgctggtatggaatggagataaggcccgttaaagaaaaggaggaaaatctggtgaagtctatggtatccgctggctcaggtgaggtggacagttttagccttggcctgttgtgtatttcgatcatgatcgaagaggtcatgcgctcccgatggtctcggcgtatgctcatgacagggaccctggccgtgttctttctactgattatgggacagctcacttggaacgatctgatcagactttgcattatggttggcgcaaatgctagcgacaggatggggatgggaacaacctacttggccctgatggcaacattcaaaatgcgccctatgtttgccgtgggcttactcttccggagactgacttcaagggaggtccttctgctaaccataggtctcagtctggtggcttccgttgaattgccaaactctctggaggaattaggggatggactcgcgatgggcatcatgattctgaagcttctgacggactttcaaagccatcagttgtgggccacactcctgtccctaaccttcatcaaaactaccttttcactgcactatgcatggaagacaatggctatggtgcttagcattgtcagtctcttccccctgtgtttgtctactacctcccagaaaacgacatggctgccggtattactcggcagcctggggtgcaagcctcttaccatgtttctgatcgccgagaataagatatggggacgacgctcgtggccattgaacgaaggtatcatggccgtgggcattgtttcaatcctcctgtctagtctactgaaaaacgatgtgccccttgctgggcctctcattgcaggaggcatgctgatcgcctgttacgtcatatccggtagctctgcggacttgagcttagagaaggctgccgaggtgtcctgggaagaggaagcagagcattcaggggccagtcacaatattctggtagaagtgcaggatgacggaactatgaaaatcaaggatgaggagcgggacgatacactcaccatcctgcttaaagctactctgttggcagtcagcggcgtttatcccctatctattccagccacactgttcgtgtggtacttctggcaaaagaaaaagcagagatccggcgtgctctgggacaccccttcacccccagaagtcgagagggcggtgctggatgacgggatatatcgtatcatgcagcgcggacttttaggtcggagtcaggttggcgtaggggtgtttcaagaaaacgtcttccatacgatgtggcacgtgactagaggagctgttctgatgtaccagggcaagaggctcgagccgagctgggcctccgtgaaaaaggacttgatttcttacggtgggggatggcgactgcagggctcgtggaataccggcgaggaagtccaggtgatcgcagtagagcctgggaaaaaccccaagaatgtccaaacagccccaggaacctttaaaacacccgaaggtgaggtgggcgctattgccctcgatttcaagcctgggactagcggatcaccaatcgttaaccgggaaggcaagatagtgggtctgtatgggaatggagtcgtgaccacgtccggcacatacgttagtgcaatcgctcaggccaaagcgtctcaggagggcccccttcctgagattgaagacgaggtgtttcgcaagagaaacctgactatcatggatttgcacccggggagcggaaaaaccaggcggtatctaccagccattgtccgagaagcaatcaagagaaaactgcgcacactcatattagctcccaccagggtggtagcctccgagatggctgaagcactgaagggtatgcctattcgttaccaaactaccgccgtgaagtcagagcatacaggcaaagagatcgttgaccttatgtgccacgccacgttcactatgcggctgctctctccagtcagagtgcccaattataacatgatcattatggatgaagctcattttaccgaccctagcagtatcgcggcaagggggtacatatccacacgcgtgggaatgggcgaggccgctgccattttcatgaccgcaactccgcccggtagcgtcgaagcctttccacagtctaatgctgtaatccaggatgaggaacgagacattcctgagagatcatggaactccgggtatgagtggatcacagatttccccggaaagaccgtgtggtttgttccaagtataaaaagcggcaatgacattgcgaactgtttgcggaagaatggcaaaagggtgatccagctgtcgcgcaagacgttcgatactgaataccaaaagacaaaaaacaacgactgggactacgtcgtgaccaccgatatctctgagatgggggccaatttccgtgcagacagagttattgatcctcggaggtgcctcaagcccgtgatcctgaaagacggaccagaacgcgtcattcttgctggtccgatgcctgtgactgtagcctccgcagcccagcgaagaggccggatagggaggaaccacaataaggagggagatcagtatatctacatgggccagcccctaaacaatgacgaggatcatgctcactggacagaagccaaaatgctgttggacaacattaataccccagagggtatcatccccgcgttatttgaacctgagcgcgaaaagagcgcagccattgatggggagtatagactgaggggcgaggctcggaagacattcgtggaactcatgcgtcgcggagacctgccagtttggctttcatacaaagtcgccagtgagggctttcaatattctgatcgaagatggtgcttcgacggggaaaggaacaatcaggtgctggaggaaaacatggatgtggagatatggactaaggagggagaacggaaaaagctccgccccagatggttggacgctaggacgtactccgaccctctggcactacgggagtttaaagaattcgccgctggtcgaagaagcgtctcaggcgatctgatcctcgagattgggaagcttccgcagcacctgacccagcgcgcccaaaatgcattagacaacttggttatgctgcataatagtgaacagggaggcagggcgtatcggcacgccatggaggagctcccagatacaatcgaaactctgatgcttctggctctcattgccgtgttgaccggtggggtaacactgtttttcttaagcggccgtggactaggcaaaacctccatcgggctgctctgtgtgatggcatctagcgtccttctgtggatggcttccgtggagccccattggatagccgcatcaatcattttggaatttttcctgatggttctcctgatccctgagcccgacagacagaggactccacaggataaccaacttgcctacgtggtcattggactcctgtttatgatcttgacggtagctgcgaatgagatgggtctgttagaaaccacaaagaaggacctaggcatagggcacgtggccgttgagaaccaccatcacgcagctatgctggatgtggacctccatcctgcctctgcctggactctttacgcagtcgctaccacaattatcacccccatgatgcgccacactattgaaaacacaacggccaatatcagtctgaccgcgatagctaaccaggccgcaatcttgatgggactggataaaggctggccaatttcgaagatggacatcggtgtgcctctcctggcccttgggtgctatagccaggtcaatccgttaactctgacagctgcagtgctcatgttggttgcccattacgcgattatcggccccggactgcaagctaaagccacccgggaggcacagaagcgaaccgccgctggcataatgaaaaacccaacagtggatgggattgtagccatcgacctagatcctgtggtctatgacgcaaagttcgaaaagcagctgggacagatcatgctccttattctgtgtacttcccaaatcttgctgatgagaacgacctgggctctctgcgagtctataacactggccactggccccttaaccacactttgggagggttcaccagggaaattttggaataccactattgcggttagcatggccaacatcttcaggggatcctacctggcaggcgctggtctcgccttcagtctaatgaagtctctgggcgggggacgccggggcacgggggcacagggagaaacattgggcgagaaatggaagagacagctgaatcagctcagcaaatcagaatttaacacctataagcgttccggtattatggaggtggacaggagtgaagctaaggaggggcttaaacggggagagactaccaagcacgccgtcagccgcggcacagccaaactgcgatggttcgtggaaagaaatttggtaaagcctgagggtaaagtgatcgatctgggctgtgggaggggaggctggtcttactattgcgcggggctcaagaaggttactgaagtgaaaggatacaccaagggcggtcccgggcacgaggaaccgataccaatggctacatacggatggaacttagtcaaactgcattccggcaaggacgtgtttttcatccctcccgagaaatgtgatacgcttctgtgcgacattggcgagtcaagcccaaatcccaccatcgaagaggggcggactctacgcgtcctcaagatggtggaaccttggctgagaggaaaccaattttgtattaaaatcttgaatccgtatatgccctcggttgtagagacactggagcagatgcagaggaagcacggtggcatgctcgtgcgaaacccactttctcggaatagtacccatgaaatgtactgggtctcctgcgggactggaaacattgtgagcgcagttaatatgacatcacgtatgctgttaaacagattcaccatggcccaccgcaagcctacgtatgagagggatgtggacctgggcgctggtacccggcacgtcgccgtggaacccgaggtagcaaacttggatatcatagggcagagaattgaaaatatcaaacatgagcacaagtccacatggcattacgacgaggataacccttataaaacttgggcctaccacggatcttatgaagtgaagccaagcggcagtgcttccagcatggttaatggcgtcgtgaaactcctgaccaagccctgggacgtgatccctatggtcacacaaattgcgatgactgataccacaccatttgggcagcagcgcgttttcaaggagaaagtggacaccaggactcccaaggccaaacgaggaacggcacaaataatggaagtaacagctaagtggctatggggttttctttctcggaacaaaaagccgagaatctgtaccagggaggaattcactcgcaaggtgcgttcaaatgccgcaattggcgccgtctttgtggacgagaaccagtggaatagtgctaaagaggccgttgaagatgagcggttctgggacctggtgcatagagaaagggagctccacaagcaggggaaatgcgcgacctgcgtctacaacatgatgggaaagcgcgaaaaaaagctgggcgagtttggtaaggcaaaagggtcccgagccatctggtacatgtggttgggagctcggttcctggagttcgaagccctcggctttatgaatgaggatcactggttcagcagagaaaactctctttcgggcgtggagggggagggactgcataagttaggttatattctgagggacatctcaaaaatacctggcgggaatatgtacgcagatgacacagctggatgggatacgcgcatcaccgaagacgatttgcagaacgaggccagaattactgacatcatggaaccagagcacgctctcctggccaagagcatttttaaactaacatatcaaaataaggtagttcgggtgcagaggcccgcaaaaaacggcaccgtcatggatgtgatctcccgtcgagaccagcgcggtagtgggcaggtgggaacttacggccttaatacattcaccaacatggaagcgcaactgataagacagatggagtctgagggcatttttagcccttccgaactcgagacaccaaacctggccgaacgggtcttggattggttagagaagtatggggttgaaaggctgaagcgcatggctatctcaggagacgactgtgtggtaaaacccatcgatgacagattcgccactgcactcaccgctcttaatgatatgggtaaggtgcggaaagacattccgcagtgggagcctagtaagggctggaacgattggcagcaagtccccttttgctctcatcacttccaccagctgataatgaaagacgggagggagatcgtggttccatgtcgaaatcaggatgaactagtgggacgtgccagagtcagccagggcgcaggttggtccctgcgcgagacggcctgcctcgggaagtcatacgcgcaaatgtggcagttgatgtattttcatcggagggacctgagacttgctgccaacgcaatttgtagcgccgtgcctgtagattggatccccacctctcgcacaacttggtccattcacgctcatcaccagtggatgaccacagaagacatgctgagtgtttggaatcgggtgtggatcgaggaaaacccatggatggaggataagactcatataagctcgtggggagacgtcccctacctcggcaaaagggaggaccaatggtgcggctccttaatcgggctgaccgcccgagcaacgtgggctacaaatattcaggtggccatcaaccaggttagacggttgattggaaatgaaaactacctggattatatgacctctatgaagaggttcaaaaatgagtcagaccctgaaggtgcgctctggtga

SEQ ID NO: 13802 - RNA, 9879 nt, synthetic construct
  misc_feature 1..9879: note = derived and/or modified CDS sequence (opt3) from DENV-1__GQ199822__SS-prME
  source 1..9879: mol_type = other RNA
agcgtgaccatgctgctcatgcttatgcccaccgccctggctttccacttgactacgagaggaggggaacctcatatgatcgtaaccaagcaggaaaggggaaaatccttactgtttaagacatctgccggtgttaatatgtgcactctaattgccatggacctcggcgaactgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcattttcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaggacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactgggagcttcaaactggagaaggaagtggctgagacccagcacggtacggtccttgtgcagataaagtacgagggcacagacgcgccttgcaaaatcccattctcgacccaagatgaaaagggggttactcagaacggacgcttgattacagcaaatcccatcgtgaccgacaaagagaagcctgtaaacatagaagccgagccaccctttggcgagtcttatattgtcatcggtgctggggaaaaagccctgaagctctcctggttcaagaaaggctcaagtatcggaaagatgtttgaggcaactgccagaggcgctaggcggatggccattctgggggataccgcatgggacttcggaagcgtgggtggcgtttttacatccgtggggaaacttgtccatcagatcttcggaacggcgtacggcgtgctgttttctggtgtaagctggaccatgaagattgggataggcgtgttgctcacttggctgggattaaattcacgaagtacatccctgagcatgacctgtatcgctgttggcctagtcacactctacctgggggtgatggtgcaggccgattctggatgcgtcattaactggaaaggccgcgaacttaagtgtggttcagggatcttcgttactaatgaggtgcacacctggacggaacaatataagtttcaggcagacagtccgaaaagattgagcgccgctatcggaaaggcctgggaggagggcgtgtgcggtattaggtccgcaacacggctggaaaacataatgtggaaacagatctctaacgagctcaatcatattctgttagaaaacgacatgaagttcaccgtagtcgtgggcgatgttgtggggatcctggctcagggcaagaagatgattcgccctcaacccatggagcacaaatactcgtggaaaagctggggcagagccaagatcataggggcggacgtccagaatactacctttatcattgatggaccaaacacacctgaatgtcccgacgatcagagggcctggaatatctgggaggtggaggactatggcttcggtatttttactaccaacatctggcttaagttgcgtgattcctacacacaggtttgcgaccaccggctcatgtcagctgcaataaaggatagtaaagccgtgcatgctgacatggggtattggattgaatctgagaagaatgaaacgtggaaactggcccgagcatccttcatcgaggtaaagacctgtatttggccaaagtcccacactctatggtcaaacggagtcctggaaagcgagatgatcatacccaaaatctacggcggtcctatttctcaacataattatagaccaggctacttcacacagaccgcggggccgtggcacctcggaaagctggagcttgattttgacttgtgcgaaggcactacagtggtggtcgatgagcactgcgggaacaggggaccctccctgcgcaccacgactgttaccggcaaaatcattcatgaatggtgttgccggagttgtacattacctccactcagattcaagggtgaggacgggtgctggtacggaatggagatcaggcccgtgaaagaaaaggaggaaaatctggtaaagagcatggtgtctgccggctccggtgaggtcgactcatttagtcttggcctgttgtgtataagcattatgatcgaagaggtgatgcgctcgcgatggtcccggaaaatgctcatgaccgggactctggctgttttcctactgctcatcatgggacagctgacatggaacgatcttattcgtttgtgcatcatggtgggcgccaatgcatctgacagaatggggatgggaaccacatatctggctttaatggccacttttaagatgaggcctatgttcgcagtcggcctcctgtttcgccggcttaccagcagagaggtgctgctactcacgattggtctgtcattggttgccagtgtggaactgccaaactccttagaggaactcggggatggactggctatgggcataatgatccttaaactgttgacagacttccaatctcaccagctctgggcgaccctgctaagcctgacttttattaagaccacactttccctccattacgcctggaaaactatggcaatggtcctgtcaatcgtcagcttgttccccctgtgtttaagtaccacgtctcagaagacaacctggctcccggtgctgcttggctccctggggtgcaagcctttgactatgtttctcattacagagaataaaatctggggaagaaagagctggccactgaacgaaggtataatggctgttggcgtggtctcgatcctactgtcatctcttctcaaaaacgatgtgcccctggccgggcctttgattgccggaggcatgttaatcgcttgttatgtaattagtggttccagcgcagacctgtctctcgagaaggccgcggaggtgagctgggaagaggaagctgagcactccggggcctcacataatatcctggtcgaagttcaggatgacggaaccatgaaaataaaggatgaggagcgagacgatactcttacaattctgttgaaagcaaccctactggccgtgagtggcgtgtaccccctcagcatcccagctacgctgttcgtctggtatttttggcaaaagaagaaacagcgctctggcgtgctttgggacactccttcacccccagaagttgagcgggcagtattagatgacgggatctacagaattatgcagaggggactgctcggtcgtagccaggtgggcgtcggggtgttccaagaaaacgttttccacaccatgtggcacgtgacacgcggagccgtcttgatgtatcagggcaagcggctggagccgagttgggcgagcgtgaaaaaggacctcatatcctacggtgggggatggagactgcagggctcttggaataccggcgaggaagtacaggtcatcgctgtggagcctgggaaaaaccccaagaatgttcaaacagccccaggaacttttaagacccccgaaggtgaggtgggcgcaattgcccttgatttcaaacctgggacgtcgggaagcccaatcgtcaacagggaaggcaagattgtgggtctgtacgggaatggagttgtgacaacttcaggcacctatgtctccgctatcgcccaggcaaaagctagtcaggagggccccttgcctgagatagaagacgaggtgtttcgaaagcggaacctaacaatcatggatctgcatccggggtctggaaaaacccgcagatacctcccagccttagtaagggaagcgattaagcggaagctgcgaactcttatcctggcccccaccagagtggttgcaagcgagatggctgaagccctcaaaggtatgcctattcgctatcaaacaacggctgtcaagtccgagcacactggcaaagagatcgtggacttgatgtgccatgcaaccttcacaatgaggctgctctcaccagtgcgtgtccccaattacaacatgataattatggatgaagcccactttaccgacccttctagcatcgccgctcgggggtatatcagtactagagtaggaatgggcgaggcggcagccattttcatgacagctaccccgcccggttccgtggaagcctttccacagagcaatgcagttatccaggatgaggaaagggacatacctgagcgctcttggaactcagggtacgagtggattacggatttccccggaaagactgtgtggtttgtcccatccatcaaaagtggcaatgacattgccaactgtctgcgaaagaatggcaagagagtgatccagcttagccggaaaacattcgataccgaatatcaaaagaccaaaaacaacgactgggactacgttgtgactacagatatatcggagatgggggctaattttagggcggaccgcgtcattgatcctcgtagatgcctaaagcccgtgatcctgaaagacggaccagaacgggtaatcttggccggtccgatgcctgtgaccgttgcatctgctgcccagaggcgcggccgaattgggagaaaccataataaggagggagatcagtacatctatatgggccagcccttaaacaatgacgaggatcacgcacactggacagaagccaagatgctgctcgacaacattaatactccagagggtataatccccgctctgttcgaacctgagcgggaaaaatccgccgcgattgatggggagtacaggcttcgcggcgaggcaagaaagacgttcgtcgaactgatgaggcggggagacctcccagtgtggttgagctataaagtggcctcagagggctttcaatacagtgatcgtcgctggtgcttcgacggggaacgaaacaatcaggtcctggaggaaaacatggatgttgagatctggaccaaggagggagaaaggaaaaagctaaggccccggtggctggacgctcgcacatattctgaccctctcgcccttagagagtttaaagagttcgctgcaggtaggcggtccgtgagcggcgatctgatcttagagattgggaagttgccgcagcatctgactcagcgagcccaaaatgctctcgacaacctggtaatgcttcacaattcagaacagggaggcagagcctaccgccatgcaatggaggagctgccagataccatagaaacactcatgttgctggcgttaatcgccgtgctaaccggtggggtcactctgtttttcctcagtggcaggggacttggcaagacgagcattgggctgttgtgtgtgatggcttcctctgttctgctctggatggccagcgtggagccccactggatcgcagcttccattatcctggaatttttccttatggtcctcctgatacctgagcccgaccggcagcgtaccccacaggataaccaattggcctatgtagtgatcggactgttatttatgattctaacagttgcagccaatgagatgggtctgctcgaaactaccaaaaaggaccttggcatcgggcacgtggctgtcgagaaccatcaccatgcgacaatgctggatgtggacttgcaccctgcctcagcatggaccctgtacgctgtcgccactacaattatcacgcccatgatgagacataccatagaaaacactacagccaatatttctctcaccgcaatcgctaaccaggccgcgattctgatgggacttgataaaggctggccaatcagtaagatggacataggtgtgcctttactggctctcgggtgctactcgcaggttaatccgttgaccctgacagccgcagtgctaatgctggtagcccactatgctatcattggccccggactccaagcaaaagccactagggaggcgcagaagcgcacggctgccggcatcatgaagaacccaaccgtggatgggattgtcgcaatcgaccttgatcctgttgtgtacgacgccaaattcgaaaagcagctgggacagataatgttgctgattctctgtacaagccaaatcctgttaatgcggactacctgggctctttgcgagtccatcacactggccaccggccccctcactacgctatgggagggttctccagggaaattttggaatacaaccattgcagtctcaatggctaacatcttccgaggaagctatctggccggcgcgggtttggccttttccctgatgaagagtctcggcgggggaagaaggggcactggggcacagggagaaacccttggcgagaaatggaagcgccagctgaatcagttgtctaagagcgagttcaacatatacaaacggtcaggtattatggaggtggacagatccgaagctaaggaggggctgaaacgtggagagacaactaggcacgccgtaagtcggggcaccgcaaagctccgctggttcgtggaacgaaatttagttaaacctgagggtaaggtgatcgatctgggctgtgggagaggaggctggagctattactgcgctgggcttaagaaagtcacagaagtgaagggatatacgaaaggcggtcccgggcatgaggaaccgattccaatggccacctacggatggaacctggtcaagctacactctggcaaagacgtgtttttcactcctcccgagaagtgtgatacactcctgtgcgacatcggcgagtcctcaccaaatcccaccatagaagaggggaggactttgcgggttctgaaaatggtagaaccttggctccgcggaaaccaattttgtatcaagattcttaatccgtacatgcccagcgtggtcgagacactggagcagatgcagagaaagcatggtggcatgttagtgaggaacccactgtcgcgaaattctacccacgaaatgtattgggttagttgcgggacgggaaacatcgtgtccgccgtcaatatgaccagccggatgttgctcaaccgtttcacaatggcgcacagaaaacctacttacgagcgcgatgtggacctgggcgctggtaccaggcatgtagcagtggaacccgaggttgccaacctagatattatcgggcagcggattgaaaatatcaagcacgagcataaatcaacatggcactatgacgaggataacccttacaagacttgggcttatcatggatcctacgaagtcaaaccatctggcagcgccagttccatggtgaatggcgtggtcaaacttctgaccaagccctgggacgttatacctatggtgacacaaattgcaatgaccgatactacgccatttgggcagcagagagtattcaaagagaaggtggacacacgcacccccaaagccaagaggggaactgctcaaatcatggaagtcaccgcgcgatggctctggggttttctgagccggaacaaaaagccgagaatctgtacaagggaggagttcacgcgcaaggtgcgttctaatgccgcaattggcgctgtttttgtggacgagaaccagtggaactcagccaaagaggcagtcgaagatgagcggttctgggacttggtgcagaaggaaagagagctgcacaaacaggggaagtgcgcaacctgcgtatataacatgatgggaaaaagggaaaagaagctcggcgagtttggtaaagctaaggggagtcgcgccatatggtacatgtggcttggagcgcgattcctggagtttgaagcattaggcttcatgaatgaggatcactggttctcccgggaaaacagcctgtctggcgttgagggggagggattgcataaactcggttacatcctgagagacatttcgaagatccctggcgggaatatgtatgccgatgacactgctggatgggatacaaggattaccgaagacgatctacaaaacgaggccaaaatcactgacataatggaaccagagcacgcacttctggctacatcaatctttaagctcacctaccagaataaagtggtccgcgtgcagagacccgccaagaacggcacagtgatggatgtcattagccggagggaccagcgtggttccgggcaagttggaacttatggcctgaataccttcacgaacatggaagctcagttgatccgacagatggagagtgagggcatatttttaccttctgaactggagaccccaaacctcgccgaacgcgtgcttgattggctggagaagtacggggtagaaagactaaaacggatggcaatcagcggagacgactgtgtggtcaagcccatagatgacaggttcgcgacagccctgactgctctcaatgatatgggtaaagtgcgcaaggacattccgcagtgggagccttccaaaggctggaacgattggcaacaggttcccttttgctcacatcacttccaccagttgatcatgaaggacgggagagagatcgtggtcccatgtcggaatcaggatgaactggtgggaagggcccgagtaagtcaaggcgcaggttggtctcttcgtgagaccgcttgcctgggaaagagctatgcccagatgtggcagctcatgtactttcatagacgcgacttacggctggcagccaacgcgatttgttccgctgttcctgtggattgggtccccacatcaaggactacctggagcatacacgcccatcaccaatggatgacgacagaagacatgttgtctgtgtggaatagagtttggatcgaggaaaacccatggatggaggataaaacccatgtgtccagttggggagacgtcccctatctgggcaagcgcgaggaccagtggtgcggcagcctcattgggcttactgcacgggccacatgggcttcgaatatccaggtggccattaaccaggtaaggcgactgatcggaaatgaaaactacctagattacatgacctccatgaaaagattcaagaatgagggtgaccctgaaggcgcactgtggtga

SEQ ID NO: 13803 - RNA, 9879 nt, synthetic construct
  misc_feature 1..9879: note = derived and/or modified CDS sequence (opt3) from DENV-1__FJ882557__SS-prME
  source 1..9879: mol_type = other RNA
agcgtgaccatgctgctcatgcttatgcccactgcactggctttccacttgactacgagaggaggggaacctcatatgatcgtctccaagcaggaaaggggaaaatctttactgtttaagacctcagccggtgttaacatgtgcacactaattgccatggacctcggagaactgtgtgaagatactatgacctacaaatgcccacggattacagaggcggaaccggacgatgtggactgttggtgcaatgctaccgatacttgggtgacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccgtgctgaggaaactttgcattgaagctaagatctctaatacgaccacagatagccggtgtccaactcaaggagaggccaccctggtcgaagaacaggacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatgtgtactggcagcttcaaactggagaaggaagtcgctgagacccagcacggtacggtgcttgttcagataaagtacgagggcacagacgcgccttgcaaaatcccattctcgacccaagatgaaaagggggtgactcagaacggacgcttgattacagcaaatcccatcgtaaccgacaaagagaagcctgtcaacatagaagccgagccaccctttggcgagtcttatattgtgatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtttttacatccgtggggaaacttattcatcagatattcggaacggcgtacggcgtcctgttttctggtgtgagctggaccatgaagatcgggattggcgtattgctcacttggctgggattaaattcacgaagtacatccctgagcatgacctgtatcgctgtgggcctagttacactctacctgggggtcatggtgcaggccgattctggatgcgtgatcaactggaaaggccgcgaacttaagtgtggttcagggattttcgtcactaatgaggttcacacctggacggaacaatataagtttcaggcagacagtccgaaaagattgagcgccgctataggaaaggcctgggaggagggcgtgtgcggtatcaggtccgcaacacggctggaaaacattatgtggaaacagatctctaacgagctcaatcatattctgttagaaaacgacatgaagctgaccgtggtagtcggcgatgtggctgggatccttggacagggcaaaaagatgatacgccctcaacccatggagtacaaatattcgtggaaaagctgggggaaggccaagatcattggagcggacgcccagaatactaccttcatcattgatggcccaaacacacctgaatgtcccgacgatcagagagcttggaatatctgggaggttgaggactacggttttgggatattcactaccaacatttggttgaagctcagggattcctatacacaggtgtgcgaccaccgtctgatgtcagcagccatcaaagatagtaaggctgtccacgccgacatgggatactggattgaatctgagaaaaatgaaacgtggaagctagcacgggcgagctttatcgaggtgaagacctgtatatggccaaaatcccatactctgtggtcaaacggcgttctcgaaagcgagatgatcattcccaagatctatggtggccctatttctcaacacaattaccgaccagggtacttcacacagaccgccggaccgtggcatctgggcaaacttgagttggatttcgacctgtgcgaagggactacagtggtagtcgatgagcactgcggaaacagaggcccctccttaaggaccacgactgtgaccggtaagatcatacacgaatggtgttgccgcagttgtacactccctccactgcggtttagaggggaggacggatgctggtatggcatggagattaggcccgtgaaagaaaaggaggaaaatcttgtcaagagcatggtttctgctggttccggcgaggtggactcattcagtctggggttgctctgtatcagcatcatgattgaagaggtaatgcgctcgcgatggtcccggaaaatgctgatgaccggaactctagccgtgtttttcctgctcatcatgggccagctgacatggaacgatcttattcgtttgtgcataatggtcggggcaaatgcttttgacagaatgggaatgggcaccacatacctggccttaatggcaactttcaagatgaggcctatgtttgccgtgggtctcctgttccgccggcttacctctagagaggttctgctactcacgatcgggctgagcttggtggcttcagtcgaactgccaaacagtttagaggaactcggagatggcctggcgatgggcattatgatccttaaactgttgacagactttcaatcccatcagctctgggccaccctgctatctctgactttcattaagaccacatttagccttcactatgcatggaaaactatggctatggtgctctccatcgtttcactgttccccttgtgtctgagcaccacgagtcagaagacaacctggttaccggtgctcctggggtctcttggatgcaagcctctgactatgtttttgatagccgagaataaaatctggggtaggaagtcctggccactcaacgaaggcattatggccgtcgggatcgtaagcattctgctatcgtcactgcttaaaaacgatgtgcccctcgctggacctctgatcgcaggcggtatgttgatagcctgttacgttatttctgggagttccgcggacttaagcctggagaaggctgccgaggtgtcttgggaagaggaagcagagcatagcggagcctcccacaatatcctcgtcgaagtgcaggatgacggcacaatgaaaatcaaggatgaggagcgagacgataccctgactattcttctgaaagctacattgctagcagtatcaggcgtgtatcccctgagtataccagccaccctcttcgtctggtacttctggcaaaagaagaaacagcgcagcggggttctgtgggacacgccttctcccccagaagtggagcgggcggtgcttgatgacggaatctatagaattatgcagaggggtttactgggccgttcccaggtcggggtgggagtttttcaagaaaacgtattccatactatgtggcacgtgacccgcggcgctgtcctcatgtaccagggtaagcggttggagccgtcatgggccagtgtgaaaaaggacctgatcagctacgggggaggctggagactcaggggctcctggaatacaggggaggaagttcaggtgattgcagtcgagcctggcaaaaatcccaagaatgtgcagaccgccccaggtacatttaagactcccgaaggcgaggtaggggctatcgccctggatttcaaacctggaacctctggctcgccaatagtcaaccgagaaggtaagatcgtggggctttatggaaatggcgttgtgacgacaagcggcacttacgtctcagcaattgctcaagccaaagcgtcccaggaggggcccctgcctgagatcgaagacgaggtgtttcggaagcgcaacttgaccattatggatctacacccgggaagtggtaaaacaagaaggtatctgccagccatcgttcgggaagcaataaagcgaaagctcagaaccttaattctggctcccactcgcgtggtcgcctctgagatggctgaagcacttaaaggcatgcctatcaggtaccagaccacagccgtaaagagcgagcatacggggaaagagatcgtagacctgatgtgccacgccactttcaccatgcgtctcttgtccccagtgcgggttcccaattataacatgattatcatggatgaagctcattttacagacccttcatctatagcggcaagaggatacattagcaccagggtcggcatgggtgaggccgctgccatcttcatgactgcaacaccgcccgggagtgtggaagcctttccacaatccaatgctgtgattcaggatgaggaacgcgacatccctgagcgaagctggaactctggacacgagtggataaccgatttccccggcaagacggtctggtttgtaccatcaattaaatccggcaatgacatcgcgaactgtctgagaaagaatgggaagcgggtgatccagctcagtaggaaaactttcgatacagaatatcagaagaccaaaaacaacgactgggactacgttgtgaccactgatattagcgagatgggagccaatttccgcgcagaccgtgtcatcgatcctagacggtgcctgaagcccgtgattcttaaagacggtccagaaagggttatactagctggcccgatgcctgtgacagtcgcctcggcagcccaacgccgagggagaatcggacggaaccataataaggagggcgatcagtacatttatatgggtcagcccctgaacaatgacgaggatcacgctcactggaccgaagccaagatgttgttagacaacatcaatacaccagaggggatcattcccgcgctgtttgaacctgagagggaaaaatctgcagccgtggatggcgagtaccgcctcagaggagaggctaggaagactttcgtagaactgatgcggcgtggcgaccttccagtgtggctgtcctataaagttgccagcgaggggtttcagtactcagatcgccgatggtgcttcgacggagaaagaaacaatcaagtcctcgaggaaaacatggatgtggagatatggacgaaggagggtgaaaggaaaaagttgcggccccgctggctggacgctagaacctatagtgaccctctagcactgagggagtttaaagagttcgccgctggccggcgatctgtgtccggggatctcatccttgagattggaaagctgccgcagcatttaacacagagagcccagaatgcattggacaacctggtcatgctccacaatagcgaacaaggcggtcgcgcgtacaggcatgccatggaggagctgccagatactatcgaaacccttatgctgctcgctttgattgccgttctgacagggggcgtgaccttatttttcctatcaggacggggcctggggaagacaagtatcggactcctttgtgtaatggcaagctccgtgctgttgtggatggcttctgtcgagccccactggatagccgcaagcatcattctggaatttttcctcatggtgctgcttatccctgagcccgaccgtcagagaacgccacaggataaccagctcgcctatgttgtgattggtctgttgtttatgatcctgaccgtcgctgcgaatgagatgggcttactagaaacaactaaaaaggacctggggataggacacgtagccgtggagaaccatcaccatgcagctatgctcgatgttgaccttcaccctgcctccgcctggaccctgtacgcagtggctacaaccattatcactcccatgatgaggcatacaattgaaaacacgaccgccaatatctcattgactgcgatagctaaccaagccgcaatcctgatgggcctcgataaaggttggccaatttctaagatggacatcggggtccctctgcttgccttaggctgctacagtcaggtgaatccgctgacaatgaccgctgcagtcctcatgttggtggcccactatgcgattatcggacccggcctgcaggctaaagccacccgcgaggcacaaaagcggacagccgctgggataatgaagaacccaactgttgatggaattgtggccatcgacctagatcctgtagtgtacgacgcaaaattcgaaaagcagctgggccagatcatgctccttattctgtgtacgtcgcagatcttgctgatgcgaaccacatgggctctctgcgagagcataactctggccaccggtcccttaacaaccctttgggaggggtccccaggaaaattttggaatactacgattgcggtctctatggccaacatcttcagaggctcatatctggcaggagctggcctcgccttcagcctaatgaagtccctagggggtggcaggcgcgggacaggagcacaaggcgaaaccttgggtgagaaatggaagcggcagctgaatcagctcagtaagtctgaatttaacacttacaaaagaagcgggattatggaggttgaccgttcagaagctaaggagggacttaaaaggggcgagaccacaaagcacgccgtgtcccggggtactgccaaactgcgctggttcgtcgaacgaaatttggtgaagcctgagggcaaggtaatcgatctggggtgtggaagaggcgggtggagttattactgcgcgggactcaaaaaggtgaccgaagttaaaggctatacaaagggtgggcccggacatgaggaaccgataccaatggctacgtacggctggaacttagtgaaactgcacagcggcaaggacgtctttttcatccctcccgagaaatgtgatacccttctgtgcgacattggggagtcttccccaaatcccactatcgaagagggaaggacactacgggtgctcaagatggtcgaaccttggctgcgcggtaaccagttttgtattaagatcttgaatccgtacatgccctcagtggttgagaccctggagcaaatgcagagaaaacatggcgggatgctcgtaaggaacccacttagccgaaattcgactcacgaaatgtattgggtgtcttgcggaacaggcaacattgtcagtgcagtgaatatgacctcccggatgctgttaaaccgtttcacgatggcccacagaaagcctacctacgagcgcgatgttgacctgggtacagggactaggcatgtggctgtcgaacccgaggtggccaacttggatatcataggacagcggattgaaaatatcaaacacgagcataagagcacctggcactatgacgaggataacccttacaaaacatgggcatatcatggctcatacgaagtaaagccatccggctctgccagcagtatggtgaatggggttgtcaagctcctgactaaaccctgggacgtgatccctatggtgacccagattgctatgacagataccactccatttggacaacagagagtcttcaaggagaaagttgacacgcgcacacccaaggcgaaaaggggtaccgcccagataatggaagtgactgcacgatggctatggggctttctttcccggaacaagaagccgagaatctgtaccagggaggagttcacacgcaaagtacgtagcaatgctgccattggggcagtgtttgtcgacgagaaccaatggaactctgccaaggaggctgtggaagatgagcggttctgggacctggttcacagagaaagggagctccacaaacagggaaagtgcgccacgtgcgtgtataacatgatgggcaaacgcgaaaagaagctgggtgagtttgggaaagcgaagggatcacgagcaatctggtacatgtggttgggcgcccggttcctggagttcgaagctctcggctttatgaatgaggatcattggttcagtagagaaaactcccttagcggggtcgagggagagggtctgcacaaattaggctacattctgagggacatctctaagatacctgggggaaatatgtatgccgatgacaccgcaggctgggatactcgcatcacagaagacgatttgcagaacgaggctaaaattaccgacatcatggaaccagagcatgccctcctggctaaggccatttttaaactaacttaccagaataaggtggtaagagttcaacggcccgcaaagaacggtacagtgatggatgtcatctcgaggcgtgaccagcgagggtcaggacaggtgggcacctatggccttaatacattcactaacatggaagcgcagctgatacgccaaatggagagcgaggggatattttcccctagtgaactcgagaccccaaacctggccgaaagagctttggattggttagagaaatacggagtggaacggctgaagaggatggccatctctggtgacgactgtgtcgttaaacccatcgatgaccgcttcgcaacggctctcaccgcccttaatgatatgggcaaggtgagaaaagacattccgcagtgggagcctagcaaggggtggaacgattggcagcaggtacccttttgctcccaccacttccatcaactgataatgaaggacggacgggagatcgtggtcccatgtaggaatcaggatgagctggtgggccgagcacgtgtttcacagggtgccgggtggagtctgagagagacagcgtgcctcggaaaatcttatgctcagatgtggcaattgatgtactttcaccgccgggacctgaggcttgccgcaaacgccatttgtagcgctgtgcctgtcgattgggtgcccacttccagaaccacatggtcaatccatgcccaccatcagtggatgactaccgaagacatgctgagcgtatggaatcgcgtttggattgaggaaaacccatggatggaggataagacgcacatctcttcctgggaggacgtgccctatctcggcaaacgggaagaccagtggtgcggcagtttaatagggctgacagcaagggctacctgggccactaatatccaagtcgcgattaaccaggtgcgaagattgatcggaaatgagaactacctggattacatgacaagcatgaagcggttcaaaaatgaatcggaccctgagggtgctctctggtga

SEQ ID NO: 13804 - RNA, 9879 nt, synthetic construct
  misc_feature 1..9879: note = derived and/or modified CDS sequence (opt3) from DENV-1__FJ882558__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagttctgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagagcaggacgcaaactttgtttgccgccgaacattcgtggatagaggctggggtaatgggtgtggactgtttggcaaaggctccttgataacttgcgctaagttcaagtgcgtaaccaaactcgaggggaagacagtgcagtacgaaaacctgaaatattcagtcattgtgaccgttcacactggagaccagcatcaagtgggtaatgagagtacggaacacggcacaaccgccactatcaccccccaggcgcctagcacagagattcagttaaccgactacggggccctgactctcgattgttctccaaggacaggacttgactttaacgaaatggtcctgttgacgatgaaggagaaatcctggctagtgcataagcagtggttcctggatctcccgctgccctggacctcaggcgcaagcactagtcaagagacatggaatcggaaagaccttctggtaacctttaagacagctcacgccaagaaacaggaagttgtggtcttgggttctcaggagggggctatgcacactgccctcaccggcgcaacggaaatccaaacctccggaacaactaccatcttcgccggccatctgaagtgccgtttaaaaatggataagctgacactaaaagggatgagctatgtgatgtgtactggatcgttcaagctcgagaaggaagtcgctgagacccagcacggtacggtgctggttcagattaaatacgagggcacagacgcgccttgcaagataccattttctacccaggatgaaaaaggggtgactcaaaacggacgccttatcacagcaaatcccattgtaaccgacaaggagaaacctgtcaacatcgaagccgagccacccttcggcgagtcctatatagtgattggtgctggggaaaaggccttgaagctgtcatggtttaaaaagggcagtagcatcggaaaaatgttcgaggcaactgccagaggcgctaggcggatggccatcctcggggataccgcatgggactttggatccattggtggcgttttcacatctgtggggaagctggtccatcagatctttggaacggcgtacggcgtgcttttcagcggtgtatcatggaccatgaaaattgggataggcgtgctgttgacttggctcggactgaatagtcgatccacaagcttatctatgacctgtatcgctgttggcctggtcacactatacctcggggtgatggtgcaggccgattcaggatgcgtcattaactggaagggccgcgaactgaagtgtggtagtgggatctttgttactaatgaggtgcacacctggacggaacagtataaattccaagcagacagcccgaagagactttccgccgctatcggaaaagcctgggaggagggcgtgtgcggtattaggtctgcaacacggttggaaaacataatgtggaagcagatctcgaacgagctgaatcatattctcctggaaaacgacatgaaatttaccgtagtcgtgggcgatgttgctgggatcttagcccagggaaagaaaatgattcgccctcagcccatggagtacaagtatagctggaagtcctggggcaaagcgaagatcataggggccgacgtgcaaaatactaccttcatcattgatggaccaaacacacctgaatgtcccgacgatcagagagcttggaatatctgggaggtcgaggactacggctttggtattttcactaccaacatctggctgaaacttagggattcatatacacaggtgtgcgaccaccgtttgatgagtgcagccataaaggattctaaagctgttcacgccgacatggggtactggattgaaagcgagaagaatgaaacgtggaagctcgcacgggcgtccttcatcgaggtgaaaacctgtatttggccaaagtcacatactctgtggagcaacggagtactagaatctgagatgatcatacccaaaatctatggcggtcctatttcccagcacaattaccgaccaggctactttacacaaaccgccgggccgtggcatctgggaaagctcgagctggatttcgacctttgcgaaggcactacagtcgtggtggatgagcactgcgggaacagaggacccagtttgaggaccacgactgtcaccggcaaaatcattcacgaatggtgttgccgcagctgtacactgcctccattacggtttaagggtgaggacgggtgctggtatggaatggagatcagacccgttaaggaaaaagaggaaaatctcgtgaagtctatggtatccgctggctcaggtgaggtggacagtttcagcctgggccttctgtgtatatcgattatgatcgaagaggtcatgaggtcccgctggtctcgaaaaatgttgatgaccgggactctcgccgtgtttttcctgctaatcatgggacagctgacatggaacgatctcattcggctgtgcatcatggttggcgcaaatgctagcgaccgtatggggatgggaaccacataccttgccttgatggcaacttttaagatgagacctatgttcgccgtgggcctgttatttaggcgcctcacctcacgggaggtcctgcttctgacgattggtctaagtctcgtggcttccgttgaactgccaaactctttggaggaactgggggatggattagcgatgggcataatgatcctcaaactgcttacagacttccagagccatcaactgtgggccaccttgctctccctgacttttattaagaccacattctcactacactatgcatggaagactatggctatggtgctgagcatcgtcagtctttttcccctctgtctgtctaccacgtcccagaaaacaacctggttgccggtactgttaggcagcctcgggtgcaagcctctgactatgttccttattgccgagaataaaatctggggaagaaagtcgtggccactgaacgaaggtataatggccgtgggcatcgtttcaattttgctctctagtctgctaaaaaacgatgtgcccctggctgggcctcttatcgcaggaggcatgctcattgcctgttacgtcatctccggtagctctgcggacctgagcttggagaaggctgccgaggtgtcctgggaagaggaagcagagcattcaggggccagtcacaatatattagtagaagtgcaggatgacggaacaatgaaaattaaggatgaggagagggacgataccctgactatcctcctgaaggctacacttctgaccgtcagcggcgtttatcccttgtctatcccagcaacgctattcgtgtggtacttttggcagaaaaagaaacaacgatccggcgtgctgtgggacactccttcacccccaaaggtcgaacgcgccgtgctcgatgacgggatttatcggataatgcagagaggactgcttggtaggagtcaggttggcgtaggggtgttccaggagaacgtctttcataccatgtggcacgtgacacgtggagcggttttaatgtaccaaggcaaacgcctggaaccgagctgggcttccgtgaagaaggacctcatctcttacggtgggggatggcggttgcagggctcgtggaataccggcgaggaggtccaggtgattgccgtagaacctgggaaaaaccccaagaatgtccagacagcaccaggaactttcaaaaccagcgagggtgaagtgggcgccatcgctctggattttaagcccgggacgtcaggatcccctattgttaacagagagggcaaaatcgtgggtctctatgggaatggagtcgtgacaactagtggcacctacgtttctgccatagcacaagctaaggccagccaggaaggcccactgcccgagatcgaggacgaagtgttcaggaagcgaaaccttacaattatggatctgcaccctgggtccggaaaaacccggcgctatttgccggcgatcgtcagagaggccattaagaggaaactacggactctgatcctcgcaccaacccgagtggtagcttcagaaatggccgaggctttaaagggtatgcccataagataccagacaacggcagtgaaatctgaacatactggcaaggagattgttgacctgatgtgccacgccacctttacaatgcgccttctgagccctgtcagggtgccaaattataacatgatcatcatggatgaggcccatttcaccgaccccagttccattgctgcgcgtgggtacatcagcactcgggtgggaatgggcgaagcagccgctatatttatgacagccacccctccgggttctgtcgaggcattcccccaatcaaatgccgtaattcaggatgaagagagagacatcccagaaaggtcctggaacagtgggtatgagtggattacggattttcctggaaagactgtgtggttcgttcccagcatcaaatcgggcaatgacatagctaactgtctccgcaagaatggcaaacgagtgattcagttgtctagaaagacattcgataccgagtaccagaaaaccaagaacaacgactgggactacgtcgtgactacagatatctccgaaatgggggcgaattttcgggccgacagggttatcgatccacgccgttgcctgaagcctgtgattctcaaagacggacccgagagagtcatcctggcaggtccaatgccggtgaccgtagctagcgccgcacaacggaggggccgcattgggcgaaaccacaataaggaaggagatcagtatatatacatgggccagcctcttaacaatgacgaggatcatgcccactggacagaggctaaaatgctactggacaacatcaatactcccgaaggtattatcccagccttgttcgagcccgaaagagagaagtcagcggcaatcgatggggaatatcggttaaggggcgaggcccgcaaaacgtttgtggagctgatgagaaggggagacctccctgtttggctgagttacaaggtcgcttctgaaggcttccagtattccgatcggcgttggtgctttgacggggagcgcaacaatcaagtgcttgaagagaacatggatgtggaaatttggaccaaagagggagagcgaaagaagctgagaccaaggtggctcgacgcccggacatacagcgaccccttggctctgcgcgaattcaaagagtttgcagccggtagaaggtcagtcagtggcgatctaatactggaaatcgggaagctccctcagcaccttactcagcgggctcagaatgccctggacaacttagttatgttgcataatagcgagcaaggaggccgagcatatagacacgcgatggaagagctgccggataccattgagacaatgatgctcctggcccttatcgctgtgctgaccggtggggtaactctcttctttttgtccggccgcggactgggcaaaacgtctattgggttactatgtgtgatggccagctccgtcctgctctggatggcatcagtggaaccacattggatcgctgcctctataatccttgagttctttctgatggttttgctgattcccgaacctgacaggcagcggaccccccaggataaccagctcgcatacgtggtcatcggactgcttttcatgattctcacagtagccgctaatgagatgggtctgttggagactaccaagaaagacctgggcatcgggcacgtggcggttgaaaaccaccatcacgccgcaatgttagatgtggacctacatccagctagtgcctggacactgtacgccgtcgcaaccactataattacacctatgatgcgtcacacgatcgagaacaccactgctaatatttcgctcacagccatcgcgaaccaagctgccatacttatgggactggataagggctggcccatcagcaagatggacattggtgtgccattgctggcactcgggtgctattcccaggtcaatcctctgacccttaccgccgctgtgttaatgctggttgcacattacgccatcattggcccgggactccaggcgaaagctacaagagaagcccaaaagaggactgcagccggcatcatgaaaaaccccacggtggatgggatagtagctattgacttggatccagtggtctatgacgccaagtttgagaaacagctgggacagatcatgctactgatcctctgtacctctcagattcttctgatgcgcacaacttgggcattgtgcgaatcaatcaccctggctacaggccctctcaccactctgtgggagggtagccccgggaagttctggaatacgacaatagccgtttccatggcgaacattttccggggaagttacttagccggcgcaggtcttgctttttctctgatgaagagcctcggcgggggacgaagaggcaccggggcccaaggagagactctaggcgaaaaatggaagaggcagctgaatcagttgtcaaaatccgagttcaacacctataagcgcagtggtatcatggaagtggaccggagcgaggcaaaagaagggctgaagagaggagagacaactaagcacgctgtctctcgtggcaccgccaaactcaggtggtttgtggagcggaatcttgtaaagccagaaggtaaagtgattgatctgggctgtgggcgcggaggctggtcctactattgcgccgggttgaagaaagttacagaggtgaagggatacacgaaaggcggtcctgggcacgaagagcccatcccgatggcgacctacggatggaacctggtcaagctccattcaggcaaggacgtgttctttataccacctgaaaaatgtgatactttactgtgcgacatcggcgagagctcgcccaatccaacaattgaggaagggcgaacccttagagtcctgaagatggtggagccctggctaaggggaaaccagttctgtatcaaaattctcaatccttatatgccgtctgttgtagaaactctggagcaaatgcagcggaagcacggtggcatgttggtgcgcaaccccctgagtagaaattccacacatgagatgtactgggtcagctgcgggaccggaaacatcgtgtcagctgttaatatgacgtccaggatgctccttaaccgatttaccatggcacaccggaaaccaacatatgaacgtgatgtggacctgggcgccggtactagacacgtcgctgtggagcctgaagtagccaacttagatattatcgggcagcgcatagagaatattaagcatgaacacaagtctacctggcattacgacgaggataacccctataaaacatgggcataccacggaagctatgaggtgaagcctagtggctccgccagctctatggttaatggcgtcgtgaaactgttgactaagccatgggacgtgatccccatggtcacccagatcgctatgacagataccactcctttcgggcaacagagggtttttaaagaaaaggtggacacgcggacaccaaaggcgaaaagaggaaccgcccagattatggaggtaactgcaaagtggctctggggtttcctgtcacgcaacaaaaagcccaggatatgtacccgagaagagtttacacggaaagtgagaagtaatgctgccatcggcgcagtcttcgtggacgaaaaccaatggaattccgccaaggaggctgttgaggatgaaaggttttgggacctagtgcatcgcgagcgtgaacttcacaagcaggggaaatgcgccacgtgcgtctacaacatgatgggaaagcgggagaaaaagctgggcgaattcggtaaagcgaaggggagcagagcaatttggtacatgtggctcggagccaggttcctggagtttgaggctttgggcttcatgaatgaagatcactggttttctcgcgagaactcgctgtcaggcgtggaaggggagggactccataaacttggttatatcctgcgagacattagcaagatcccgggcgggaatatgtacgccgatgacaccgcaggatgggatactcggataacagaggacgatttacagaacgaagctaagatcaccgacattatggagcctgaacacgccctgttggctaaatccatcttcaagctcacttatcagaataaagtagttagagtgcaaaggccagccaagaacggcacagtcatggatgtgattagtcgcagagaccagcggggttctgggcaggtgggaacctacggcctgaatacatttactaacatggaggcacagctaatcaggcaaatggaaagcgagggcatattctccccctcagagcttgaaacccctaacctggcgcgtcgagtcctcgattggctggagaaacatggggttgaacgcttgaagagaatggccattagtggagacgactgtgtggtaaagccaatcgatgaccggtttgctacggccttaaccgcactgaatgatatgggtaaagtgaggaaggacatcccccagtgggagccgtctaaaggctggaacgattggcagcaggtccctttctgcagccaccactttcatcaactcattatgaaggacgggcgcgaaatagtggttccctgtagaaatcaggatgagcttgtgggacgggctagggtctcccagggcgccggttggtcactgcgagagacagcatgcctagggaaaagctatgcccagatgtggcaactgatgtacttccaccgtagagacctccgcttggcggctaacgccatctgttctgcagtgccagtagattgggttcctacttcccggaccacatggagtattcatgcccaccatcagtggatgactaccgaagacatgctgagcgtgtggaatagggtctggatcgaggaaaacccctggatggaggataagacgcacatttcgtcctggggagacgtgccatatcttggcaagagagaagaccagtggtgcggctctctgatcgggctcacagctcgcgccacctgggcaactaatatacaagttgctatcaaccaggtgcggaggttaattggaaatgagaactacctggattacatgacatcaatgaaacgatttaagaatgagagcgaccccgaaggtgccttgtggtga

SEQ ID NO: 13805 - RNA, 9879 nt, synthetic construct
  misc_feature 1..9879: note = derived and/or modified CDS sequence (opt3) from DENV-1__GQ199824__SS-prME
  source 1..9879: mol_type = other RNA
agcgtgaccatgctgctcatgcttatgcccaccgcactggctttccacttgactacgagaggcggggaacctcatatgatcgtctccaagcaggaaagggggaaatctttactgtttaagacctcagccggtgttaacatgtgcacactaattgcaatggacctcggcgagttctgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaagacgcaaactttgtttgccgccgaacattcgtggatagaggctggggtaatgggtgtggactgtttggcaaaggctccttgataacttgcgctaagttcaagtgcgtaaccaaactcgaggggaagacagtgcagtacgaaaacctgaaatattcagtcattgtgaccgttcacactggagaccagcatcaagtgggtaatgagagtacggaacacggcacaaccgccactatcacaccccaggcgcctagcacagagattcagttaaccgactacggggccctgactctcgattgttctccaaggacaggacttgactttaacgaaatggtcctgttgacgatgaaggagaaatcctggctagtgcataagcagtggttcctggatctcccgctgccctggacctcaggcgcaagcacaagtcaagagacatggaatcggaaagaccttctggtaacctttaagacagctcacgccaagaaacaggaagttgtggtcttgggttctcaggagggggctatgcacactgccctcaccggcgcaacggaaatccaaacctccggaacaactaccatcttcgccggccatctgaagtgccgtttaaaaatggataagctgacactaaaagggatgagctatgtgatgtgtactggatcgttcaagctcgagaaggaagtcgctgagacccagcacggtacggtgctggttcagattaaatacgagggcacagacgcgccttgcaagataccattttctacccaggatgaaaaaggggtgactcaaaacggacgccttatcacagcaaatcccattgtaaccgacaaggagaaacctgtcaacatcgaagccgagccacccttcggcgagtcctatatagtgattggtgctggggaaaaggccttgaagctgtcatggtttaaaaagggcagtagcatcggaaaaatgttcgaggcaactgccagaggcgctaggcggatggccatcctcggggataccgcatgggactttggatccattggtggcgttttcacatctgtggggaagctggtccatcagatctttggaacggcgtacggcgtgcttttcagcggtgtatcatggaccatgaaaattgggataggcgtgctgttgacttggctcggactgaatagtcgatccactagcttatctatgacctgtatcgctgttggcctggtcacactatacctcggggtgatggtgcaggccgattcaggatgcgtcattaactggaagggccgcgaactgaagtgtggtagtgggatctttgttactaatgaggtgcacacctggacggaacagtataaattccaagcagacagcccgaagagactttccgccgctatcggaaaagcctgggaggagggcgtgtgcggtattaggtctgcaacacggttggaaaacataatgtggaagcagatcctgaacgagctcaatcatattctgttagaaaacgacatgaaatttaccgtagtcgtgggcgatgttgctgggatcctggcccagggaaagaaaatgattcgccctcagcccatggagtacaagtattcgtggaaaagctggggcaaagcgaagatcataggggccgacgtgcaaaatactaccttcatcattgatggaccaaacacacctgaatgtcccgacgatcagagagcttggaatatctgggaggtcgaggactacggctttggtattttcactaccaacatctggcttaaattgagggattcctatacacaggtgtgcgaccaccgtctcatgtcagcagccataaaggatagtaaagctgttcacgccgacatggggtactggattgaatctgagaagaatgaaacgtggaagctggcacgggcgagcttcatcgaggtgaaaacctgtatttggccaaagtcccatactctatggtcaaacggagtactggaaagcgagatgatcatacccaaaatctatggcggtcctatttctcagcacaattaccgaccaggctactttacacaaaccgccgggccgtggcatctcggaaagctggagcttgatttcgacttgtgcgaaggcactacagtcgtggtggatgagcactgcgggaacagaggaccctccctgaggaccacgactgtcaccggcaaaatcattcacgaatggtgttgccgcagttgtacattacctccactccggtttaagggtgaggacgggtgctggtatggaatggagatcagacccgttaaggaaaaagaggaaaatctggtgaagtccatggtatctgctggctccggtgaggtggactcattcagtcttggcctgttgtgtataagcattatgatcgaagaggtcatgaggtcgcgctggtcccgaaaaatgctcatgaccgggactctggccgtgtttttcctactgatcatgggacagctcacatggaacgatctgattcggctttgcatcatggttggcgcaaatgcttctgaccgtatggggatgggaaccacatacttggccctgatggcaacttttaagatgagacctatgttcgccgtgggcttactctttaggcgcctgaccagccgggaggtccttctgctaacgattggtctctcactggtggctagtgttgaattgccaaactccctggaggaattaggggatggactcgcgatgggcataatgatcctgaaacttctgacagacttccagtctcatcaattgtgggccaccctcctgagcctaacttttattaagaccacattctccctgcactatgcatggaagactatggctatggtgctttcaatcgtcagcctctttcccctgtgtttgagtaccacgtctcagaaaacaacctggctgccggtattactcggctccctggggtgcaagcctcttactatgttcctgattgccgagaataaaatctggggaagaaagagctggccattgaacgaaggtataatggccgtgggcatcgtttcgattctcctgtcatctctactgaaaaacgatgtgccccttgctgggcctctcatcgcaggaggcatgctgattgcctgttacgtcatcagtggttccagcgcggacttgtctttagagaaggctgccgaggtgagctgggaagaggaagcagagcattccggggcctcacacaatatactggtagaagtgcaggatgacggaacaatgaaaattaaggatgaggagagggacgataccctcactatcctgcttaaggctacactgttggcagtcagtggcgtttatcccctaagcatcccagccaccctgttcgtgtggtacttttggcagaaaaagaaacaacgatctggcgtgctctgggacacgccttcacccccagaagtcgagcgcgcggtgctggatgacgggatttatcggataatgcagagaggacttttaggtaggagccaggttggcgtaggggtgttccaggaaaacgtctttcatactatgtggcacgtgacccgtggagctgttctgatgtaccaaggcaagcgcctcgagccgagttgggccagcgtgaaaaaggacttgatctcctacggtgggggatggcggctgcagggctcttggaatacaggcgaggaagtccaggtgattgcagtagagcctgggaagaaccccaaaaatgtccagaccgccccaggaacattcaagacttcggaaggtgaggtgggcgctatcgccctcgattttaaacccgggaccagcggatcacctattgttaacagagaaggcaagatcgtgggtctgtatgggaatggagtcgtgacgacatccggcacttacgttagtgcaatagctcaagccaaagcgtctcaggagggcccacttcccgagatcgaagacgaggtgttcaggaagcgaaacctgaccattatggatttgcaccctgggagcggaaagacacggcgctatctaccggccatcgtcagagaagcaattaaaaggaagctgcggaccctcatcttagctccaactcgagtggtagcctccgagatggctgaagcactgaaaggtatgcccataagataccagaccacagccgtgaagtcagagcatacgggcaaagagattgttgaccttatgtgccacgccacttttaccatgcgcctgctctctcctgtcagggtgccaaattataacatgatcatcatggatgaagctcatttcacagaccccagcagtattgcggcacgtgggtacatctccacccgggtgggaatgggcgaggccgctgccatatttatgactgcaacacctccgggtagcgtcgaagccttcccccaatctaatgctgtaattcaggatgaggaaagagacatcccagagaggtcatggaactccgggtatgagtggattaccgattttcctggaaagacggtgtggttcgttcccagtatcaagagcggcaatgacatagcgaactgtttgcgcaaaaatggcaagcgagtgattcagctgtcgagaaaaactttcgatacagaataccagaagaccaaaaacaacgactgggactacgtcgtgaccactgatatctctgagatgggggccaattttcgggcagacagggttatcgatccacgccgttgcctcaagcctgtgattctgaaggacggacccgaaagagtcatccttgctggtccaatgccggtgacagtagcctccgcagcccaacggaggggccgcattgggcgaaaccacaataaagagggagatcagtatatatacatgggccagcctctaaacaatgacgaggatcatgctcactggaccgaagccaagatgctgttggacaacatcaatacacccgagggtattatcccagcgttattcgaacccgagagagaaaagagcgcagccatcgatggggagtatcggctgaggggcgaggctcgcaagacttttgtggaactcatgagaaggggagacctgcctgtttggctttcatacaaagtcgccagtgagggcttccagtattctgatcggcgttggtgctttgacggggaacgcaacaatcaagtgctggaggaaaacatggatgtggagatttggacgaaggagggagaacgaaagaaactcagaccaaggtggttggacgctcggacctactccgaccccctggcactacgcgagttcaaggaatttgccgctggtagaaggagcgtctcaggcgatctgatactcgagatcgggaaacttcctcagcacctgacacagcgggcccagaatgcattagacaacttggttatgctgcataatagtgaacaaggaggccgagcgtatagacacgccatggaggagctcccggatactattgaaaccctgatgcttctggctctcatcgccgtgttgacaggtggggtaaccctgttctttttaagcggccgcggactaggcaagacttccattgggctgctctgtgtgatggcatctagcgtccttctgtggatggcttccgtggagccacattggatcgccgcatcaataatcttggagttctttctgatggttctcctgattcccgagcctgacaggcagcggacgccccaggataaccagcttgcctacgtggtcatcggactcctgttcatgattttgaccgtagctgcgaatgagatgggtctgttagaaacaactaaaaaggacctaggcatcgggcacgtggccgttgagaaccaccatcacgcagctatgctggatgtggacctccatccagcctctgcctggaccctttacgcagtcgctacaaccataattactcctatgatgcgtcacacaatcgaaaacacgaccgccaatattagtctgactgcgatcgctaaccaagccgcaatattgatgggactggataaaggctggcccatctcgaagatggacattggtgtgccactcctggcccttgggtgctatagccaggtcaatcctttaacactgaccgctgcagtgctcatgttggttgcccattacgcgatcattggcccgggactgcaggctaaggccaccagagaggcacagaaaaggacagccgctggcatcatgaagaaccccactgtggatgggatagtagccattgacctagatccagtggtctatgacgcaaaatttgaaaagcagctgggacagatcatgctccttatcctgtgtacgtcccagattttgctgatgcgcaccacatgggctctctgcgagtctatcactctggccaccggccctttaacaaccctttgggagggttcacccgggaaattctggaatactacgatagcggttagcatggccaacattttccggggatcctacctggcaggcgctggtctcgcctttagtctaatgaagtctctgggcgggggacgaagaggcacaggggcacaaggagaaaccttgggcgagaagtggaaaaggcagctgaatcagctcagcaagtcagagttcaacacttataaacgctccggtatcatggaggtggaccggagtgaagctaaggaggggcttaaaagaggagagaccacaaagcacgccgtcagccgtggcactgccaagctgaggtggtttgtggaacggaatttggtaaaaccagagggtaaggtgattgatctgggctgtgggcgcggaggctggtcttactattgcgcggggctcaaaaaggttaccgaagtgaaaggatacacaaagggcggtcctgggcacgaggaacccatcccgatggctacgtacggatggaacttagtcaaactgcattccggcaaggacgtgttctttataccacctgagaagtgtgatacccttctgtgcgacatcggcgagtcaagccccaatccaactattgaagaggggcgaacactaagagtcctcaaaatggtggaaccctggctgaggggaaaccagttctgtatcaagattttgaatccttatatgccgtcggttgtagagaccctggagcaaatgcagcggaaacacggtggcatgctcgtgcgcaaccccctttctagaaatagtactcatgaaatgtactgggtctcctgcgggacaggaaacatcgtgagcgcagttaatatgacctcaaggatgctgttaaaccgatttacgatggcccaccggaagccaacctatgagcgtgatgtggacctgggcgctggtacaagacacgtcgccgtggaacctgaggtagcaaacttggatattatcgggcagcgcatagaaaatattaaacatgagcacaagtccacttggcattacgacgaggataacccctataagacctgggcctaccacggatcttatgaagtgaaacctagcggcagtgcttccagcatggttaatggcgtcgtgaagctcctgacaaaaccatgggacgtgatccccatggtcactcagatcgcgatgaccgatacaacccctttcgggcaacagagggtttttaaggagaaagtggacactcggacgccaaaggccaagagaggaacagcacagattatggaagtaaccgctaaatggctatggggtttcctttctcgcaacaagaaacccaggatatgtactcgagaggaatttacccggaaggtgagatcaaatgccgcaatcggcgccgtcttcgtggacgagaaccaatggaatagtgctaaagaggccgttgaagatgagaggttttgggacctggtgcatcgcgaacgtgagctccacaagcaggggaagtgcgcgacatgcgtctacaacatgatgggaaaacgggaaaagaaactgggcgagttcggtaaggcaaaagggtccagagccatttggtacatgtggttgggagctaggttcctggagtttgaagccctcggcttcatgaatgaggatcactggtttagccgcgaaaactctctttcgggcgtggagggggagggactgcataagttaggttatatcctgcgagacatttcaaaaatcccgggcgggaatatgtacgcagatgacacggctggatgggatacccggataactgaagacgatttgcagaacgaggccaagatcacagacattatggaacctgagcacgctctcctggccaagagcatcttcaaactaacctatcagaataaggtagttagagtgcaaaggccagccaaaaacggcactgtcatggatgtgatttcccgcagagaccagcggggtagtggacaggtgggaacatacggccttaatacctttacaaacatggaagcgcagctgatcaggcaaatggagtctgagggcatattcagcccctccgaactcgagactcctaacctggccgggcgtgtcttggattggttagaaaagcatggagttgagcgactgaaacgcatggctatttcaggtgacgactgtgtggtaaagccaatcgatgacagatttgccaccgcactcacggctcttaatgatatgggcaaggtgcggaaagacatcccccagtgggaaccgagtaaggggtggaacgattggcagcaggtccctttctgctctcaccactttcatcaactgattatgaaagacggaagggagatagtggttccctgtcgcaatcaggatgagctagtgggcagagcccgggtcagccagggtgcagggtggtccctgagggaaaccgcctgcctcggaaagtcatatgcgcagatgtggcaattgatgtacttccaccgacgtgacctgagacttgctgccaacgcaatctgtagcgccgtgccagtagattgggttcctacatctcgcactacctggtccattcatgctcaccatcagtggatgacaactgaggacatgctgagtgtgtggaatcgggtctggatcgaagagaacccctggatggaagataaaacccacattagctcgtggggcgacgtgccatatctcggcaagagggaggaccagtggtgcgggtccttaatcggactgacggccagagcaacatgggctaccaatatacaagttgccatcaaccaggtgcgccggttgattggtaatgagaactacctggattacatgacttctatgaagaggtttaaaaatgaatcagaccccgagggcgcgctctggtga

SEQ ID NO: 13806 - RNA, 9879 nt, synthetic construct
  misc_feature 1..9879: note = derived and/or modified CDS sequence (opt3) from DENV-1__FJ882559__SS-prME
  source 1..9879: mol_type = other RNA
agcgtgaccatgctgctcatgcttatgcccacagcactggctttccacttgactacgcggggaggggaacctcatatgatcgtctccaagcaggaaagagggaaatctttactgtttaagacctcagccggtgttaatatgtgcacactaattgccatggacctcggcgagttctgtgaagatactatgacctacaaatgcccacggataacagaagcggaaccggacgatgtggactgttggtgcaatgctaccgatacttgggtaacatatgggacctgtagtcaaacgggagaacaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggttgacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaagacgcaaactttgtttgccgccgaacattcgtggatagaggctggggtaatgggtgtggactgtttggcaaaggctccttgataacttgcgctaagttcaagtgcgtaaccaaactcgaggggaagattgtgcagtacgaaaacctgaaatattcagtcatcgtgacagttcacaccggagaccagcatcaagtgggtaatgagagtactgaacacggcacgacagccaccattactccccaggcgcctagcaccgagatccagttaacagactacggggccctgaccctcgattgttctccaaggactggacttgactttaacgaaatggtcctgttgacaatgaaggagaaatcctggctagtgcataagcagtggttcctggatctcccgctgccctggacgtcaggcgcaagcaccagtcaagagacttggaatcggcaggaccttctggtaacatttaaaaccgctcacgccaagaagcaggaagttgtggtcttgggttctcaagagggggctatgcacacagccctcactggcgcaaccgaaatccagacgtccggaaccacaactattttcgccggccatctgaaatgccgtttaaagatggataaactgaccctaaaggggatgagctatgtgatgtgtacaggatcgttcaaactcgagaaggaagtcgctgagactcagcacggtaccgtgctggttcagataaagtacgagggcacggacgcgccttgcaaaatcccattttctacacaagatgaaaagggggtgacccagaacggacgccttattactgcaaatcccatcgtaacagacaaagagaagcctgtcaacatagaagccgagccacccttcggcgagtcctatattgtgatcggtgctggggaaaaagccttgaagctgtcatggtttaagaaaggcagtagcatcggaaagatgttcgaggcaaccgccagaggcgctaggcggatggccattctcggggatactgcatgggactttggatccatcggtggcgttttcacctctgtggggaaactggtccatcagatttttggaacagcgtacggcgtgcttttcagcggtgtatcatggacgatgaagatagggatcggcgtgctgttgacctggctcggactgaatagtcgatccactagcttatctatgacatgtattgctgttggcctggtcaccctatacctcggggtgatggtgcaggccgattcaggatgcgtcatcaactggaaaggccgcgaactgaagtgtggtagtgggatctttgttacaaatgaggtgcacacttggaccgaacaatataagttccaggcagacagcccgaaaagactttccgccgctattggaaaggcctgggaggagggcgtgtgcggtataaggtctgcaacgcggttggaaaacatcatgtggaaacagatttcgaacgagctgaatcatatcctcctggaaaacgacatgaagtttacagtagtcgtgggcgatgttgctgggattttagcccagggcaagaagatgatccgccctcaacccatggagtacaaatatagctggaagtcctggggcaaggcgagaataatcggggccgacgtgcagaataccactttcattatcgatggaccaaacacccctgaatgtcccgacgatcagagggcttggaatatttgggaggtcgaggactacggctttggtatcttcacaactaacatatggctgcgtcttcgggattcatatacccaggtgtgcgaccaccgattgatgagtgcagccattaaagattctaaggctgttcacgccgacatggggtactggatcgaaagcgagaaaaatgaaacatggaagctcgcaagagcgtccttcattgaggtgaaaacgtgtatctggccaaagtcacataccctgtggagcaacggagtactagaatctgagatgataatccccaagatttatggcggtcctatctcccaacacaattacaggccaggctactttactcagacagccgggccgtggcatctgggaaaactcgagctggatttcgacctttgcgaaggcaccactgtcgtggtggatgagcactgcgggaaccgcggacccagtttgcggacaaccacggtcactggcaagattgttcacgaatggtgttgcagaagctgtaccctgcctccattaaggtttaaaggtgaggacgggtgctggtatggaatggagatccgccccgtgaaggaaaaagaggaaaatctcgtaaagtctatggtgtccgctggctcaggtgaggtcgacagtttcagcctgggccttctgtgtatatcgattatgatcgaagaggtgatgcgatcccggtggtctcgtaagatgttgatgacagggaccctcgccgtatttttcctgctaatcatgggacagctgacttggaacgatctcattagactgtgcatcatggtgggcgcaaatgctagcgacaggatggggatgggaatgacataccttgccttgatggcaacctttaaaatgcgccctatgttcgccgtcggcctgttatttcggagactcacatcaagggaggtgctgcttctgactattggtctaagtctcgttgcttccgcggaactgccaaactctttggaggaactgggggatggattagccatgggcataatgatcctcaagctgcttaccgacttccaaagccatcagctgtgggcaacgttgctctccctgacatttattaaaaccactttctcactacactatgcttggaagaccatggccatggtgctgagcatcgtcagtctttttcccctctgtctgtctacaacttcccagaaaaccacgtggttgccggtactgttaggcagcctcgggtgcaagcctctgacaatgttccttattgccgagaataagatctggggacgaaaatcgtggccactgaacgaaggtataatggctgtgggcatcgtttcaattttgctctctagtctgctaaagaacgatgtgcccctggcagggcctcttatcgccggaggcatgctcattgcgtgttacgtcatctccggtagctctgctgacctgagcttggagaaagccgcagaggtgtcctgggaagaggaagccgagcattcaggggctagtcacaatatattagtagaagtgcaggatgacggaaccatgaagattaaagatgaggagcgcgacgatactctgacaatcctcctgaaggcaacccttctggccgtcagcggcgtttatcccttgtctatcccagcgactctattcgtgtggtacttttggcagaaaaagaagcagcggtccggcgtgctgtgggacacaccttcacccccagaagtcgagagagctgtgctcgatgacgggatttataggataatgcagcgtggactgcttggtcgcagtcaggttggcgtaggggtgttccaagaaaacgtctttcataccatgtggcacgtgacgcggggagccgttttaatgtaccagggcaaaagactggagccgagctgggcatccgtgaagaaagacctcatctcttacggtgggggatggaggttgcagggctcgtggaatactggcgaggaagtccaggtgattgccgtagagcctgggaagaaccccaaaaatgtccaaaccgctccaggaacattcaagaccagcgaaggtgaggtgggcgccatcgcactggattttaagcccgggacatcaggatcccctattgttaaccgagaaggcaaaatcgtgggtctctatgggaatggagtcgtgactaccagtggcacgtacgtttctgctatagcccaggcgaaggccagccaggagggcccactgcccgagatcgaagacgaggtgttccggaaacgcaaccttacaattatggatctgcaccctgggtccggaaagactagaaggtatttgccggcaatcgtccgggaagctattaaacgaaagctaagaaccctgatcctcgccccaacacgcgtggtagcttcagagatggcagaagccttaaagggtatgcccataaggtaccaaaccactgccgtgaaatctgagcataccggcaaggagattgttgacctgatgtgccacgctacatttacgatgcgtcttctgagccctgtccgggtgccaaattataacatgatcatcatggatgaagcgcatttcactgaccccagttccattgcagccagagggtacatcagcaccagggtgggaatgggcgaggctgccgcaatatttatgacagccacccctccgggttctgtcgaggctttcccccagtcaaatgcggtaattcaggatgaggaacgcgacatcccagagcgatcctggaacagtgggtatgagtggattactgattttcctggaaaaacagtgtggttcgttcccagcatcaagtcgggcaatgacatagccaactgtctcaggaaaaatggcaagcgggtgattcagttgtctaggaagaccttcgatacggaataccagaaaactaagaacaacgactgggactacgtcgtgacaaccgatatctccgagatgggggcaaattttcgcgctgaccgtgttatcgatccaagacggtgcctgaaacctgtgattctcaaggacggacccgaaagggtcatcctggccggtccaatgccggtgaccgtagcaagcgccgctcagcgccgaggcagaattgggcggaaccacaataaagagggagatcagtatatatacatgggccagcctcttaacaatgacgaggatcatgcccactggactgaagcgaagatgctactggacaacatcaatacacccgagggtattatcccagcattgttcgaacccgagagggaaaagtcagccgctatcgatggggagtatcgcttaagaggcgaggccaggaaaacctttgtggaactgatgcggcgtggagacctccctgtttggctgagttacaaggtcgcttctgagggcttccaatattccgatcgccgatggtgctttgacggggaaagaaacaatcaggtgcttgaggaaaacatggatgtggagatttggacaaaagagggagaaaggaagaaactgcggccacgctggctcgacgcaagaacttacagcgaccccttggccctgagggagttcaaggaatttgctgccggtcggcgatcagtcagtggcgatctaatactggagatcgggaaactccctcagcaccttacgcagagagcacaaaatgcgctggacaacttagttatgttgcataatagcgaacagggaggccgcgcctataggcacgctatggaggagctgccggataccattgaaacactcatgctgcttgccctgatcgcagtgctcactggtggggtaaccttgttctttctgtccggccggggattaggcaagacatctattgggctactgtgtgtgatggctagctccgtcctcctttggatggcctcagtggagccacattggatcgcagcctctataatcctggagttctttttgatggttctgctcattcccgagcctgaccgtcagagaactccccaagataaccaactggcttacgtggtcatcggacttctcttcatgattctgaccgtagcggccaatgagatgggtttgctggaaacgaccaagaaagacttaggcatcgggcacgtggcagttgagaaccaccatcacgctgccatgctagatgtggacctgcatccagccagtgcatggacactctacgctgtcgccactaccataattacacctatgatgaggcacaccatcgaaaacactacagcgaatatttcgcttacggctatcgccaaccaggcagccatactgatgggattggataagggctggcccatcagcaaaatggacattggtgtgccactgctcgctctggggtgctattcccaggtcaatcctcttaccttaactgcagccgtgctgatgctcgttgcgcattacgctatcattggcccgggattgcaagccaaggcaacacgcgaggcccagaaacggaccgctgccggcatcatgaagaaccccaccgtggatgggatagtagcaattgacctggatccagtggtctatgacgctaagtttgaaaaacagctaggacagatcatgctgctcatcctttgtacatctcaaattctgttgatgcgaactacgtgggccctgtgcgagtcaatcaccctcgcgacaggccctctgactaccttatgggagggtagccccgggaagttctggaatacaaccatagccgtttccatggcaaacattttcagaggaagttaccttgctggcgccggtctggcattttctctcatgaaaagcctaggcgggggaaggcgcggcactggggctcagggagaaacgctgggcgagaagtggaaacggcagttgaatcagctgtcaaagtccgagttcaacacatataagagaagtggtatcatggaggtggaccgtagcgaagccaaagaggggctcaagaggggagagaccactaaacacgccgtctctcggggcaccgcgaaacttcgctggtttgtggaacgaaatctggtaaaaccagagggtaaggtgattgatttgggctgtgggagaggaggctggtcctactattgcgctgggctgaagaaagttacagaagtgaagggatacactaaaggcggtcctgggcacgaggaacccatcccgatggcaacctacggatggaacctcgtcaggttacattcaggcaaggacgtgttctttacaccacctgagaaatgtgatacgctgctttgcgacataggcgagagctcgcccaatccaaccatcgaagaggggcggactctgcgcgtcctaaagatggtggaaccctggctcagaggaaaccaattctgtattaaaatcctgaatccttatatgccgtctgttgtagagacattggagcagatgcagaggaagcacggtggcatgctggtgcgaaaccccctcagtagaaattccacccatgaaatgtactgggtcagctgcgggactggaaacattgtgtcagccgttaatatgacatcccgtatgcttctgaacagatttaccatggctcaccgcaagccaacgtatgagagggatgtggacttaggcgccggtacccggcacgtcgcagtggaacctgaggtagccaacctggatatcattgggcagagaatcgaaaatataaaacatgagcacaagtctacatggcattacgacgaggataacccctataaaacttgggcttaccacggaagctatgaagtgaagcctagtggctccgcgagctctatggttaatggcgtcgtgaaattgctcaccaagccatgggacgtgattcccatggtcacacaaatcgccatgactgataccacacctttcgggcagcagcgcgtttttaaggagaaagtggacaccaggactccaaaggcaaaacgaggaacggtacaaatcatggaagtgacagctaagtggctgtggggtttcctatcacggaacaaaaagcccagaatttgtaccagggaggaatttactcgcaaggtccgtagtaatgccgcaataggcgccgtgttcgttgacgagaaccagtggaactccgctaaagaggccgtggaagatgagcggttttgggaccttgtccatagagaaagggagctgcacaagcaggggaaatgcgcgacctgcgtgtacaacatgatgggaaagcgcgagaaaaagctcggcgagttcggtaaggcaaaagggagccgagccatctggtacatgtggctgggagctcggttcttggagtttgaagccctgggcttcatgaatgaggatcactggttttctagagaaaactcgctctcaggcgtagagggggagggacttcataagctgggttatattttaagggacatcagcaaaattccgggcgggaatatgtacgcagatgacacagctggatgggatacgcgcatcaccgaagacgatctgcagaacgaggccaagataactgacatcatggaacctgagcacgctttgctcgccaaatccattttcaagctgacatatcaaaataaagttgtgagagtccagcggccagcaaagaacggcaccgtgatggatgtgatcagtaggcgtgaccagcgaggttctgggcaggtcggaacttacggcctaaatacatttaccaacatggaagcgcaacttattcgccagatggagagcgagggcatcttctccccctcagaactggagacacctaacctcgccgaaagagctctggattggttggagaagcatggggttgaacggttaaaaaggatggccataagtggagacgactgtgtggtaaagccaattgatgaccgctttgcaactgctctgaccgccctcaatgatatgggtaaagtgagaaaggacatcccccagtgggagccgtctaaaggctggaacgattggcagcaagtccctttctgcagccaccactttcatcagcttatcatgaaggacgggcgggagattgtggttccctgtaggaatcaggatgaactggtgggacgagcacgtgtctcccagggcgccggttggtcactaagagagacggcgtgcctgggaaagagctatgctcaaatgtggcagctcatgtacttccaccgccgggacttgaggctggccgcaaacgccatatgttctgctgtgccagtagattgggttcctacctccagaacaacttggagtatccatgcccaccatcagtggatgaccacagaagacatgcttagcgtgtggaatcgcgtctggattgaggaaaacccctggatggaggataaaactcacatctcgtcctggggagacgtgccatatctgggcaagcgggaggaccaatggtgcggctctctcattgggttaaccgcaagggctacgtgggccacaaatatccaggttgcgataaaccaggtgcgaagactgatcggaaatgaaaactacttggattacatgacctcaatgaaacggtttaagaatgagagcgaccccgaaggtgctctgtggtga

SEQ ID NO: 13807 - RNA, 9879 nt, synthetic construct
  misc_feature 1..9879: note = derived and/or modified CDS sequence (opt3) from DENV-1__GQ199828__SS-prME
  source 1..9879: mol_type = other RNA
agcgtgacaatgctgctcatgcttatgcccacagcactggctttccacttgactacgaggggaggggagcctcatatgatcgtctccaagcaggaaaggggaaaatctttactgtttaagacatcagccggtgttaacatgtgcacactgattgccatggacctcggcgagctgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccgtgctgaggaaactttgcattgaagctaagatctctaatacgaccacagatagccggtgtccaactcaaggagaggccaccctggtcgaagaacaggacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatgtgtactggttcgttcaaactggagaaggaagtcgctgagacccagcacggtacggtgcttgttcagataaagtacgagggcacagacgcgccttgcaaaatcccattctcgacccaagatgaaaagggggtgactcagaacggacgcttgattacagcaaatcccatcgtaaccgacaaagagaagcctgtcaacatagaagccgagccaccctttggcgagtcttatattgtgatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtttttacatccgtggggaaacttgtccatcagattttcggaacggcgtacggcgtgctgttttctggtgtaagctggaccatgaagatagggatcggcgtgttgctcacttggctgggattaaattcacgaagtacatccctgagcatgacctgtattgctgttggcctagtcacactctacctgggggtgatggtgcaggccgattctggatgcgtcatcaactggaaaggccgcgaacttaagtgtggttcagggatcttcgttactaatgaggtgcacacctggacggaacaatataagtttcaggcagacagtccgaaaagattgagcgccgctattggaaaggcctgggaggagggcgtgtgcggtataaggtccgcaacacggctggaaaacatcatgtggaaacagatttctaacgagctcaatcatatcctgttagaaaacgacatgaagctgaccgtagtcgtgggcgatgttgctgggattcttggacagggcaaaaagatgatccgccctcaacccatggagtacaaatattcgtggaaaagctgggggaaggccaagataatcggagcggacgcccagaatactaccttcattatcgatggcccaaacacacctgaatgtcccgacgatcagagagcttggaatatttgggaggtggaggactacggttttgggatcttcactaccaacatatggttgaagctcagggattcctatacacaggtctgcgaccaccgtctgatgtcagcagccattaaagatagtaaggctgtgcacgccgacatgggatactggatcgaatctgagaaaaatgaaacgtggaagctagcacgggcgagctttattgaggttaagacctgtgtgtggccaaaatcccatactctgtggtcaaacggcgtacgagaaagcgagatgatcatacccaagatctatggtggccctatttctcaacacaattacagaccagggtacttcacacagaccgccggaccgtggcatctcggcaaactggagcttgatttcgacttgtgcgaagggactacagtcgtggtggatgagcactgcggaaacaggggcccctccctgcgcaccacgactgtcaccggtaagatcattcacgaatggtgttgccggagttgtacattacctccactcagatttagaggggaagacggatgctggtatggcatggagatccgccccgttaaagaaaaggaggaaaatctggtgaagtccatggtatctgctggttccggcgaggtggactcattcagtcttgggctgttgtgtataagcattatgatcgaagaggtcatgcgatcgcggtggtcccgtaaaatgctcatgatcggaaccctggccgtgtttttcctactgattatgggccagctcacttggaacgatctgatcagactttgcattatggttggggcaaatgcttctgacaggatgggaatgggcacaacctacttggccctgatggcaacatttaagatgcgccctatgttcgccgtgggtttactctttcggagactgactagcagggaggtccttctgctaaccatagggctctcactggtggctagtgttgaattgccaaactccctggaggaattaggagatggcctcgcgatgggcatcatgattctgaaacttctgacggacttccaatctcatcagttgtgggccacactcctgagcctaacctttatcaagactaccttctccctgcactatgcatggaaaacaatggctatggtgctttcaattgtcagcctctttcccctgtgtttgagtactacctctcagaagacgacatggctgccggtattactcgggtccctgggatgcaagcctcttaccatgttcctgatcgccgagaataaaatatggggtcgaaagagctggccattgaacgaaggcatcatggccgtggggattgtttcgatcctcctgtcatctctactgaaaaacgatgtgccccttgctggacctctcattgcaggcggtatgctgatcgcctgttacgtcataagtgggtccagcgcggacttgtctttagagaaggctgccgaggtgagctgggaagaggaagcagagcattccggagcctcacacaatattctggtagaagtgcaggatgacggcactatgaaaatcaagaacgaggagcgcgatgacacactcaccatcctgcttaaagctactctgttggcagtcagtggcgtttatcccctaagcattccagccacactgtttgtgtggtacttctggcaaaagaagaaacagcggtctggggtgctctgggataccccttcacccccagaagtcgagagagcggtgctggacgatggaatatataggatcatgcagcgtggtcttttaggccgcagccaggttggggtaggagtgttccaagaaaatgtctttcatacgatgtggcacgtgactcggggcgctgttctgatgtaccagggtaagagactcgagccgagttgggccagcgtgaaaaaggacttgatttcctacgggggaggctggaggctgcgaggctcttggaacaccggggaggaagtccaggtgatcgcagtagagcctggcaagaatcccaagaacgtccagacagccccaggtaccttcaagacacccgaaggcgaggtgggggctattgccctcgactttaaacctggaacttcgggcagcccaatcgttaatcgggaaggtaagatagtggggctgtatggaaacggcgtcgtgaccacgtcaggcacatacgtttccgcaatcgctcaagccaaagcgagtcaggaggggccccttcctgagattgaagatgaggtgttccgcaagagaaatctgactatcatggacttgcacccgggatctggtaaaaccaggcggtatctaccagccattgtccgagaagcaatcaagagaaagctgcgcacactcatattagctcccaccagggtggtagccagcgagatggctgaagcactgaaaggcatgcctattcgttaccagactaccgccgtgaagtccgagcatacagggaaagagatcgttgatcttatgtgccacgccacgtttactatgcggctgctctcaccagtcagagtgcccaactataatatgatcattatggacgaagctcatttcaccgatccttctagcatcgcggcaaggggatacataagtacacgcgtgggcatgggtgaggccgctgccatttttatgaccgcaactccgcccgggtccgtcgaagccttcccacaaagcaacgctgtaatccaggacgaggaacgagatattcctgagagatcttggaactcaggatatgagtggatcacagactttcccggcaagaccgtgtggttcgttccatccataaaaagtggcaacgatattgcgaattgtttgcggaagaacgggaagagggtgatccagctgagccgcaaaacgtttgacactgaataccagaagaccaaaaataatgattgggactacgtcgtgaccaccgacatctcggagatgggagccaacttccgtgcagatagagttattgaccctcggaggtgcctcaagcccgtgatcctgaaagatggtccagaacgcgtcattcttgctggcccgatgcctgtgactgtagcctctgcagcccaacgaagagggcggataggaaggaatcacaacaaggagggcgaccagtatatctacatgggtcagcccctaaataacgatgaggaccatgctcactggacagaagccaagatgctgttggataatattaacaccccagaggggatcatccccgcgttattcgaacctgagcgcgaaaaatccgcagccgtggacggcgagtatagactgaggggagaggctcggaagacatttgttgaactcatgcgtcgcggcgatctgccagtctggcttagctacaaagtggcctcagaggggttccagtatagtgaccgaagatggtgctttgatggagaaaggaataaccaagtgctggaggaaaatatggacgtcgagatttggactaaggagggtgaacggaaaaagctccgccccagatggttggatgctaggacgtactctgaccctctggcactacgggagttcaaagaatttgccgctggccgaagatccgttagcggggacctgatactcgagatcggaaaacttccgcagcacctgacccagcgcgcccagaacgcattagataatttggtgatgctgcataactcagaacaaggcggtagggcgtatcggcacgccatggaggagctcccagacacaattgaaactctgatgcttctggctctcatcgccgtattgaccgggggcgtgacactgttctttttaagtggacgtggcctagggaagaccagcattggactgctctgtgtcatggcatcctctgtgcttctgtggatggctagcgttgagccccattggatcgccgcatccataatcttggagttctttctgatggtgctcctgattcctgagcccgatagacagaggactccacaggacaatcagcttgcctacgtcgtaatcggtctcctgttcatgattttgacggtggctgcgaacgagatgggcctgttagaaaccaccaaaaaggatctagggatcggacacgttgccgtggagaaccaccatcacgcagctatgctggacgtcgatctccatcctgcctcagcctggactctttacgcagtggctaccacaataattacccccatgatgcgccacactatcgaaaatacaacggccaacatttctctgaccgcgatcgctaatcaagccgcaatattgatgggcctggacaaaggttggccaatcagtaagatggatattggggtccctctcctggcccttggctgctatagccaggtgaacccgttaactctgacagctgcagttctcatgttggtggcccattacgcgatcattggacccggcctgcaggctaaagccacccgggaggcacaaaagcgaaccgccgctgggatcatgaagaatccaacagtagacggaatagtggccattgatctagaccctgtcgtttatgatgcaaaatttgaaaagcagctgggccagatcatgctccttatcctgtgtactagccagattttgctgatgagaacgacctgggctctctgcgagtccatcacactggccactggtcccttaaccacactttgggaggggtctccaggaaaattctggaacaccactatagcggtgtcaatggccaatatttttaggggcagctacctggcaggagctggcctcgccttctccctaatgaagagtctagggggaggccgccgggggacgggagcacaaggcgaaacattgggtgagaaatggaagagacagctgaaccagctctctaagagcgagttcaatacctataaacgttcagggatcatggaggtcgacaggtccgaagctaaggagggacttaaacggggcgagactaccaagcacgccgtgagtcgcggtacagccaaactgcgatggtttgtagaaagaaacttggtgaagcctgagggcaaggttattgacctggggtgtggaaggggcgggtggagctactattgcgcgggactcaaaaaggtgactgaagtcaaaggctacaccaagggtgggcccggacacgaggaaccgatcccaatggctacatacggctggaatttagtgaaactgcattctggcaaggatgtcttctttatacctcccgagaaatgtgacacgcttctgtgcgatatcggggagtcctcaccaaaccccaccattgaagagggacggactctacgcgtgctcaagatggttgaaccttggctgagaggtaatcagttctgtatcaagattttgaacccgtatatgcccagcgtagtggagacactggagcaaatgcagaggaaacacggcgggatgctcgtccgaaatccactttcgcggaactctacccatgaaatgtactgggtgagttgcggaactggcaatatcgtttccgcagtgaacatgacaagccgtatgctgttaaacagatttaccatggcccaccgcaagcctacgtatgagagggacgtcgatctgggtaccgggacacggcacgtggctgtagaacccgaggtggccaatttggacattatcggacagagaatagaaaacattaaacatgagcacaagtcaacttggcattacgatgaggacaatccttataaaacctgggcataccacggctcctatgaagttaagccatctggcagcgccagttccatggtcaacggggtggtgaagctcctgacaaaaccctgggatgtcatccctatggttactcagatcgctatgaccgacacaaccccattcggacaacagcgcgtgtttaaggagaaagtagatactaggacgcccaaggcgaaacgaggtacagcccagattatggaagtgaccgcacggtggctatggggcttccttagcagaaataagaagccgaggatatgtactcgcgaggaatttacccgtaaagtccggtctaacgctgccatcggggcagtgttcgttgacgagaatcaatggaactcagccaaggaggctgtggaagacgagagattttgggatctggtccatagggaacgcgagctccacaaacagggaaagtgcgccacatgcgtgtacaatatgatgggcaaacgagaaaagaagctgggtgagttcgggaaagcgaagggaagtcgggcaatttggtacatgtggttgggcgccagatttctggagttcgaagctctcggcttcatgaacgaggaccactggttttccagggaaaatagcctttctggggtagagggagagggtctgcataaattaggctatatcctgcgcgatatttcgaagatccctgggggaaacatgtacgccgacgatacggcaggctgggacaccagaataactgaagatgacttgcagaatgaggctaaaatcacagatattatggaaccagagcacgccctcctggctaaggccatcttcaaactaacctatcagaacaaggttgtgcgggtccaaaggcccgcaaagaatggtactgtgatggacgtgatttcacgtcgagatcagcgcgggagcggacaggtcggcacatacggccttaacacctttacaaacatggaagcgcagctgatcagacaaatggagtccgaggaaatattcagtccttctgagctcgaaactccaaatctggccgagcgggctttggactggttagaaaaatatggggttgagaggctgaagcgcatggccattagcggagatgactgtgtggtaaaacccatcgacgatagatttgcaaccgctctcacggcccttaacgacatgggtaaggtgcggaaagatatcccgcagtgggagccttccaagggctggaatgactggcagcaggtccccttctgctcacatcactttcaccaactgattatgaaggatgggagggaaatagtggttccatgtcgaaaccaggacgagctagtgggacgtgcaagagtcagtcagggcgccggttggtctctgcgcgaaaccgcgtgcctcgggaaaagctacgctcagatgtggcaattgatgtatttccatcggagggatctgagacttgccgacaaggcaatcggatccgccgtgcctgtagattgggttcccacatcacgcactacctggagcattcacgctcatcaccagtggatgacaactgaggacatgctgtctgtgtggaatcgggtctggatcgaagagaacccatggatggaggataaaacccatatttccagttgggaagacgtgccctacctcggcaagagggaggaccagtggtgtggcagcttaatcgggctgacggcccgagcaacatgggctaccaatatacaagttgccatcaaccaggtgagacggttgattggaaatgaaaactacctggattatatgacttcgatgaaaaggtttaagaatgagtccgaccctgagggtgcgctctggtga

SEQ ID NO: 13808 - RNA, 9879 nt, synthetic construct
  misc_feature 1..9879: note = derived and/or modified CDS sequence (opt3) from DENV-1__GQ199829__SS-prME
  source 1..9879: mol_type = other RNA
agcgtgaccatgctgctcatgcttatgcccacggccctggctttccacttgactacgagaggaggggaacctcatatgatcgtctccaagcaggaaaggggaaaatctttactgtttaagacctcagccggtgttaatatgtgcacattaattgccatggacctcggagagctgtgtgaagatactatgacctacaaatgcccacggataacagagaccgaaccggacgatgtggactgttggtgcaatgcgactgatacatgggtgacctatgggacgtgtagtcaaactggagagcaccgccgagacaagcgtagcgtggctcttgcaccccatgtcggcctgggtttggagaccagaacagaaacttggatgtcctctgagggggcatggaaacagatccagagggtggaaacctgggccctccggcaccctggattcacagttattgctctgtttctggcacatgccatcggcacctcgattacgcagaagggcatcatattcatcctcttaatgctggtgactccatcaatggctatgcgctgcgtcgggattggaagcagagattttgtggagggtcttagtggcgccacatgggtagacgttgtgttggagcacgggtcctgtgtcaccactatggcgaaggataaacccacactggacatcgaactgctcaagaccgaggtgacgaaccctgcagtgctgaggaaactttgcattgaagccaagatctctaataccacaactgatagccggtgtccaacccaaggagaggctacactggtcgaagaacaggacgccaacttcgtttgccgccgaactttggtggatagaggctggggtaatgggtgtggactctttggcaaaggctccctgataacctgcgcaaagttcaagtgcgtaacaaaattagaggggaagattgtgcagtacgaaaacctgaaatattcagtcatcgtgaccgttcacactggagaccagcatcaagtgggtaatgagagtacggaacacggcacaaccgctactattacaccccaagcccctaccaccgagatccagctcactgactacggggcgcttacactggattgtagcccaaggacgggattggactttaacgaaatggtcctactgaccatgaaggagaaatcttggctcgtgcataagcagtggttcctggatcttccgctgccctggacttccggcgcctcaacaagccaagagacctggaatcggcaggacttgctcgtaacatttaaaactgcacacgctaagaagcaggaagttgtggtcctgggtagtcaagagggggccatgcacaccgctttaacgggcgccaccgaaatccagacatctggaactaccacaattttcgcaggccatctgaaatgccgtctaaagatggataaactcactctgaaggggatgtcctatgtgatgtgtaccgggagctttaaacttgagaaggaagtcgccgagacgcagcacggtacagtgttggttcagataaagtacgagggcaccgacgctccttgcaaaatcccattctcgactcaagatgaaaagggggtgacacagaacggacgcctgattaccgcgaatcccatcgtaactgacaaagagaagcctgtcaacatagaagcagagccacccttcggcgagtcttatattgtgatcggtgccggggaaaaagctctcaagctgtcctggtttaagaaaggctcaagtatcggaaagatgttcgaggccaccgcaagaggcgccaggcggatggctattcttggggatacagcctgggactttggaagcatcggtggcgttttcacgtccgtggggaaactggtccatcagatttttggaaccgcatacggcgtgttgttctctggtgtaagctggactatgaagatagggatcggcgtgctcctgacatggttaggactaaattcacgaagtacctccctaagcatgacatgtattgcggttggcctcgtcactctgtaccttggggtgatggtgcaggctgattctggatgcgtcatcaactggaaaggccgcgaattgaagtgtggttcagggatctttgttaccaatgaggtgcacacgtggacagaacaatataagttccaggccgacagtccgaaaagactgagcgcagccattggaaaggcttgggaggagggcgtgtgcggtataaggtccgccacccggctcgaaaacatcatgtggaaacagatttctaacgagctgaatcatatcttactggaaaacgacatgaagtttactgtagtcgtgggcgatgttgcagggattcttgctcagggcaagaagatgatccgccctcaacccatggagtacaaatattcgtggaaaagctggggcaaggccaagataatcggggcggacgtgcagaataccacattcattatcgatggaccaaacactcctgaatgtcccgacgatcagagagcctggaatatttgggaggtcgaggactacggctttggtatcttcaccacaaacatatggttgaagctcagggattcctatacacaggtgtgcgaccaccgtctgatgtcagctgcaattaaagatagtaaggccgttcacgctgacatggggtactggatcgaatctgagaaaaatgaaacctggaagctagcccgggcatcctttattgaggtgaagacttgtatctggccacgatcccatacactgtggtcaaacggagtactcgaaagcgagatgataatccccaaaatttatggcggtcctatctctcaacacaattacagaccaggctacttcacccaggcggccgggccgtggcatctgggaaaacttgagttggatttcgacctgtgcgaaggcactacagtcgtggtggatgagcactgcgggaacaggggaccctccttacgcaccacgactgtcaccggcaaaattatccacgaatggtgttgccggagttgtacactccctccactgagatttaggggtgaggacgggtgctggtatggaatggagatacgccccgttaaggaaaaagaggaaaatcttgtaaagagcatggtatctgctggctccggtgaggtggactcattcagtctgggcttgctctgtattagcatcatgatcgaagaggtcatgcgatcgcggtggtcccgtagaatgctgatgaccgggactctagccgtgtttttcctgctcattatgggacagctgacatggaacgatcttatcaggttgtgcattatggttggcgcaaatgcttctgaccgcatggggatgggaaccacatacctggccttaatggcaacttttaagatgcggcctatgttcgccgtgggcctcctgtttagaaggcttaccagccgagaggtcctgctactcacgataggtctgtcattggtggctagtgttgaactgccaaactccttagaggaactcggggatggactggcgatgggcatcatgattcttaaactgttgacagacttccaatctcatcagctctgggccaccctgctaagcctgacttttatcaagaccacattctcccttcactatgcatggaaaactatggctatggtgctctcaattgtcagcctgtttcccttgtgtctgagtaccacgtctcagaagacaacctggttaccggtactcctgggctcccttgggtgcaaacctctgactatgttcttgatcgccgagaataagatatggggacgccggagctggccactcaacgaaggtatcatggccgtgggcattgtttcgatcctgctatcatctctgcttaagaacgatgtgcccctcgctgggcctctgattgcaggaggcatgttgatcgcctgttacgtcataagtggttccagcgcggacttatctctggagaaagctgccgaggtgagctgggaagaggaagcagagcattccggggcctcacacaatattctcgtagaagtgcaggatgacggaacaatgaagatcaaagatgaggagagagacgataccctgactatccttctgaaggctacattgctagcagtcagtggcgtttatcccctgagcattccagccaccctctttgtgtggtacttctggcagaagaagaaacagaggtctggcgtgctgtgggacacgccttcacccccagaagtcgagcgtgcggtgcttgatgacgggatatatcgcatcatgcagcggggattactgggtagaagccaggttggcgtaggggtgttccaagaaaacgtctttcatactatgtggcacgtgaccaggggagctgttctcatgtaccagggcaagcgattggagccgagttgggccagcgtgaagaaagacctgatttcctacggtgggggatggcggctccagggctcttggaatacaggcgaggaagtccaggtgatcgcagtagagcctgggaagaaccccaaaaatgtccaaaccgccccaggaacattcaagactcccgaaggtgaggtgggcgctattgccctggattttaaacctgggacctcgggaagcccaatcgttaaccgcgaaggcaagatagtgggtctttatgggaatggagtcgtgacgacatcaggcacttacgtttccgcaatcgctcaggccaaggcgagtcaggagggccccctgcctgagattgaagacgaggtgttcagaaaaaggaacttgaccatcatggatctacacccggggtctggaaagacacggcgatatctgccagccattgtcagagaagcaatcaaacgcaagctcaggaccttaatactggctcccactcgtgtggtagccagcgagatggctgaagcacttaaaggtatgcctattcggtaccaaaccacagccgtgaagtccgagcatacgggcaaggagatcgttgacctgatgtgccacgccacttttaccatgagactcttgtcaccagtcagggtgcccaattataacatgatcattatggatgaagctcatttcacagacccttctagcatcgcggcacgcgggtacataagtacccgagtgggaatgggcgaggccgctgccatttttatgactgcaacaccgcccggttccgtcgaagccttcccacagagcaatgctgtaatccaggatgaggaaagagacattcctgagcggtcttggaactcagggtatgagtggatcaccgattttcccggaaaaacggtgtggttcgttccatccataaagagtggcaatgacattgcgaactgtctgaggaaaaatggcaagcgcgtgatccagctcagccgtaaaacttttgatacagaataccaaaagaccaagaacaacgactgggactacgtcgtgaccactgatatctcggagatgggggccaatttcagagcagaccgggttattgatcctaggcgctgcctgaaacccgtgatccttaaggacggaccagaacgagtcattctagctggtccgatgcctgtgacagtagcctctgcagcccagagacggggcaggatagggcgcaaccacaataaagagggagatcagtatatctacatgggccagcccctgaacaatgacgaggatcatgctcactggaccgaagccaagatgttgttagacaacattaatacaccagagggtatcatccccgcgctgttcgaacctgagagagaaaaatccgcagccattgatggggagtataggctccggggcgaggctcgtaagacttttgtggaactgatgcgccgaggagaccttccagtttggctgagctacaaggtcgcctcagagggcttccaatatagtgatagaaggtggtgctttgacggggaacggaacaatcaggtgctcgaggaaaacatggatgtggagatatggacgaaagagggagaacgcaagaaattgagacccaggtggctggacgctcggacctactctgaccctctagcactgcgagagttcaaggaatttgccgctggtagacgctccgtcagcggcgatctcatccttgagattgggaaactgccgcagcacttaacacagagggcccaaaatgcattggacaacctggttatgctccataattcagaacagggaggccgggcgtatcgtcacgccatggaggagctgccagatactatcgaaacccttatgctgctcgctttgattgccgtgctgacaggtggggtaaccttattctttctaagtggcagaggactgggcaagactagcatcgggctcctttgtgtgatggcatcctctgtcctgttgtggatggctagcgtggagccccattggatagccgcatccatcattctggagttctttctcatggttctgcttatccctgagcccgacaggcagcgcacgccacaggataaccaactcgcctacgtggtcattggactgttgttcatgatcctgaccgtagctgcgaatgagatgggtttactagaaacaactaaaaaggacctgggcatagggcacgtggccgttgagaaccaccatcacgcagctatgctcgatgtggaccttcatcctgcctcagcctggaccctgtacgcagtcgctacaaccattatcactcccatgatgcggcacacaattgaaaacacgaccgccaatatctctttgactgcgatagctaaccaggccgcaatcctgatgggactcgataagggctggccaattagtaaaatggacatcggtgtgcctctgcttgccttagggtgctattcgcaggtcaatccgctgacactcaccgctgcagtgttgatgctggttgcccattacgcgattatcggccccggactacaagctaaggccacccgagaggcacagaaaagaacagccgctggcataatgaagaacccaactgtggatgggattgtagccatcgacctggatcctgtggtctatgacgcaaaatttgaaaagcagctcggacagatcatgcttctgattttgtgtacgagccaaatcctgctcatgaggaccacatgggctctgtgcgagtccataactttagccaccggcccccttacaaccctgtgggagggttctccagggaagttctggaatactacgattgcggtttcaatggccaacatctttcgcggaagctacctcgcaggcgctggtctagccttctccctgatgaaaagtttgggcgggggacggagaggcacaggggcacagggagaaaccctgggcgagaagtggaaacgtcagctcaatcagctttctaagagcgagttcaacacttataaaaggtcaggtattatggaggtggaccggtccgaagctaaggaggggctgaagcgcggagagaccacaaaacacgccgtcagtcgaggcactgccaagttgagatggtttgtggaaaggaatctggtaaaacctgagggtaaggtgatcgatctcggctgtgggcggggaggctggagctactattgcgcggggctaaagaaggttaccgaagtgaagggatacacaaaaggcggtcccgggcacgaggaaccgataccaatggctacgtacggatggaacctggtcaaacttcattctggcaaagacgtgttctttatccctcccgagaagtgtgataccctgctatgcgacattggcgagtcctcaccaaatcccactatcgaagaggggcgcacactcagagtcctgaaaatggtggaaccttggttgaggggaaaccaattctgtattaagatcctgaatccgtatatgcccagcgttgtagagaccctcgagcagatgcagcgaaaacacggtggcatgcttgtgcggaacccactgtcgcgtaattctactcatgaaatgtactgggtcagttgcgggacaggaaacattgtgtccgcagttaatatgaccagcagaatgttactgaaccgctttacgatggcccacaggaagcctacctatgagcgggatgtggacttgggcgctggtacaagacacgtcgccgtggaacccgaggtagcaaacctcgatatcatagggcagcgcattgaaaatatcaagcatgagcacaaatcaacttggcattacgacgaggataacccttataagacctgggcctaccacggatcctatgaagtgaaaccatctggcagcgctagttccatggttaatggcgtcgtgaagctgctaacaaaaccctgggacgtgatccctatggtcactcaaattgcgatgaccgatacaaccccattcgggcagcagagggtttttaaggagaaggtggacactcgaacgcccaaagccaagcggggaacagcacaaataatggaagtaaccgctaaatggctttggggtttcctgagcagaaacaagaaaccgaggatctgtactcgcgaggaatttacccgtaaggtgcggtctaatgccgcaattggcgccgtcttcgtggacgagaaccagtggaactcagctaaggaggccgttgaagatgagagattttgggacctcgtgcatagggaacgcgagctgcacaaacaggggaagtgcgcgacatgcgtctacaacatgatgggaaaacgagaaaagaaattgggcgagttcggtaaggcaaaggggagtcgggccatctggtacatgtggctgggagctagatttctcgagttcgaagcccttggcttcatgaatgaggatcactggttttccagggaaaacagcctgtctggcgtggagggggagggattacataaactgggttatattttgcgcgacatctcgaagatacctggcgggaatatgtacgcagatgacacggctggatgggataccagaatcactgaagacgatctccagaacgaggcccggattacagacatcatggaaccagagcacgctctgctagccaaatcaattttcaaacttacctatcaaaataaagtagttagggtgcagcgtcccgcaaagaacggcactgtcatggatgtgatcagccgacgcgaccagagaggttccggacaggtgggaacatacggcctgaatacctttacaaacatggaagcgcaactcatacggcagatggagagtgagggcattttctctcctagcgaactggagactccaaacttggccgaaagggtcttagattggctggagaaatatggggttgaacgcctcaagagaatggctatctccggagacgactgtgtggtaaagcccatcgatgaccggtttgccaccgcacttacggctctgaatgatatgggtaaagtgaggaaggacattccgcagtgggagccttcaaaaggctggaacgattggcagcaagtccccttctgcagtcatcactttcaccagctaataatgaaggacgggcgagagatcgtggttccatgtcgtaatcaggatgaactggtgggcagagcccgcgtctctcagggcgcaggttggagcctccgggagaccgcctgcttggggaaatcctacgcgcaaatgtggcagctgatgtatttccataggagagaccttcgcctggctgccaacgcaatttgttcagccgtgcctgtagattggatccccacaagccggactacctggtctattcacgctcatcaccagtggatgacaactgaagacatgctctccgtttggaatagggtgtggatcgaggaaaacccatggatggaggataagacccatataagtagctggggagacgtcccctacttaggcaagcgagaggaccaatggtgcggctcgctgatcgggttgacggccagagcaacatgggctaccaatattcaggtggccatcaaccaggttcggaggctgattggaaatgaaaactacctcgattatatgacttccatgaaacgctttaagaatgagtctgaccctgaaggtgcgctttggtga

SEQ ID NO: 13809 - RNA, 9879 nt, synthetic construct
  misc_feature 1..9879: note = derived and/or modified CDS sequence (opt3) from DENV-1__FJ882562__SS-prME
  source 1..9879: mol_type = other RNA
agcgtgaccatgctgctcatgcttatgcccacagccctggctttccacttgactacgaggggaggggaacctcatatgatcgtctccaagcaggaaaggggaaaatctttactgtttaagacctcagccggtgttaatatgtgcacactgattgccatggacctcggcgaactgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccgtgctgaggaaactttgcattgaagctaagatctctaatacgaccacagatagccggtgtccaactcaaggagaggccaccctggtcgaagaacaggacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatgtgtactggtagcttcaaactggagaaggaagtcgctgagacccagcacggaacggtgcttgttcagataaagtacgagggcacagacgcgccttgcaaaatcccattctcgacccaagatgaaaagggggtgactcagaacggacgcttgattacagcaaatcccatcgtaaccgacaaagagaagcctgtcaacatagaagccgagccaccctttggcgagtcttatattgtgatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcctttttacatccgttgggaaactggtgcatcagattttcggaacggcgtacggcgtcttgttttctggtgtgagctggaccatgaagatagggatcggcgtactcctgacttggttaggactaaattcacgaagtacatccctaagcatgacctgtattgctgtgggcctcgttacactgtaccttggggtcatggtgcaggccgattctggatgcgtgatcaactggaaaggccgcgaattgaagtgtggttcagggatcttcgtcactaatgaggttcacacctggacggaacaatataagtttcaggcagacagtccgaaaagactgagcgccgctattggaaaggcctgggaggagggcgtgtgcggtataaggtccgcaacacggctcgaaaacatcatgtggaaacagatttctaacgagctgaatcatatcttactggaaaacgacatgaaacttaccgtggtagtcggcgatgtggctgggattttggcccagggcaagaagatgatccgccctcaacccatggagtacaaatattcgtggaaaagctggggcaaggcgaagataatcggggccgacgctcagaatactaccttcattatcgatggaccaaacacacctgaatgtcccgacgatcagagagcatggaatatttgggaggttgaggactacggctttggtatcttcactaccaacatatggctcaagctgagggattcctatacacaggtgtgcgaccaccgtctaatgtcagccgctattaaagatagtaaggccgtccacgcagacatggggtactggatcgaatctgagaaaaatgaaacgtggaagctggcgcgggccagctttattgaggtgaagacctgtatctggccaaaatcccatactctctggtcaaacggagttctggaaagcgagatgataatccccaagatttatggcggtcctatctctcaacacaattaccgaccaggctacttcacacagaccgctgggccgtggcatcttggaaaattggagctggatttcgacttatgcgaaggcactacagtggtagtcgatgagcactgcgggaacagaggaccctccctcaggaccacgactgtgaccggcaagattatccacgaatggtgttgccgcagttgtacactgcctccacttcggtttagaggtgaggacgggtgctggtatggaatggagataaggcccgtgaaagaaaaggaggaaaatctggtcaagagcatggtttctgccggctccggtgaggtggactcattcagtttgggcctcctgtgtattagcatcatgatcgaagaggtaatgcgctcgcgatggtcccggaaaatgctaatgaccgggactctggcagtgtttttcctcctgattatgggacagcttacatggaacgatttgatccgtctgtgcattatggtcggcgctaatgcctctgacagaatggggatgggaaccacatacttagcactcatggccacttttaagatgaggcctatgttcgctgtgggcctgctttttcgccggctgaccagcagagaggttctactcctgacgataggtttgtcactggtggcgagtgtcgaattaccaaactccctcgaggaactgggggatggacttgccatgggcatcatgattctgaaattgctcacagacttccaatctcatcagctgtgggcaaccctactgagccttacttttatcaagaccacattctccctccactatgcttggaaaactatggccatggtgctgtcaattgttagcttgtttcccctgtgtttaagtaccacgtctcagaagacaacctggctcccggtgctgcttggctccctggggtgcaagcctttgactatgttcctcatcgccgagaataaaatatggggaagaaagtcctggccactgaacgaaggtatcatggctgtcggcattgtatcgatcctactgtcatctcttctcaaaaacgatgtgcccctggcagggcctttgattgccggaggcatgttaatcgcgtgttacgttataagtggttccagcgctgacctgtctctcgagaaggccgcagaggtgagctgggaagaggaagccgagcattccggggcttcacacaatattctggtcgaagtgcaggatgacggaacaatgaaaatcaaggatgaggagcgagacgatacccttactatcctgttgaaagcaacactactggccgtaagtggcgtgtatcccctcagcattccagcgaccctgtttgtctggtacttctggcaaaagaagaaacagcgctctggcgttctttgggacacgccttcacccccagaagtggagcgggctgtgttagatgacgggatatatagaatcatgcagaggggactgctcggtcgtagccaggtcggcgtgggggttttccaagaaaacgtatttcatactatgtggcacgtgacccgcggagccgtcttgatgtaccagggcaagcggctggagccgagttgggcaagcgtgaaaaaggacctcatttcctacggtgggggatggagactgcagggctcttggaatacaggcgaggaagttcaggtgatcgccgtcgagcctgggaaaaaccccaagaatgtgcaaaccgctccaggaacattcaagactcccgaaggtgaggtaggcgccattgcacttgattttaaacctgggacctcgggaagcccaatcgtcaacagggaaggcaagatagtgggtctgtatgggaatggagttgtgacgacatcaggcacttacgtctccgctatcgcccaggcgaaagccagtcaggagggccccttgcctgagattgaagacgaggtgttccgaaagcggaacctaaccatcatggatctgcacccggggtctggaaaaacacgcagatatctcccagcaattgttagggaagctatcaagcggaagttacgaaccctgatacttgcccccactagagtggtcgctagcgagatggcagaagccctgaaaggtatgcctattcgctaccaaaccacagccgtgaagtccgagcatacgggcaaagagatcgtagacctcatgtgccacgctacttttaccatgaggttgctgtcaccagtgcgtgttcccaattataacatgatcattatggatgaagcgcatttcacagacccttctagcatcgcagcccgggggtacataagtaccagagtcggaatgggcgaggctgccgcaatttttatgactgccacaccgcccggttccgtggaggctttcccacagagcaatgcggtgatccaggatgaggaaagggacattcctgagcgctcttggaactcagggtatgagtggatcaccgattttcccggaaagacggtctggttcgtaccatccataaaaagtggcaatgacattgccaactgtctccgaaagaatggcaagagagtgatccagctgagccggaaaacttttgatacagaataccaaaagaccaaaaacaacgactgggactacgttgtgaccactgatatctcggagatgggggcaaatttcagggctgaccgcgtcattgatcctcgtagatgccttaagcccgtgatcctaaaagacggaccagaacgggttattctggccggtccgatgcctgtgacagtcgcatctgccgctcagaggcgcggccgaatagggagaaaccacaataaggagggagatcagtatatctacatgggccagcccttgaacaatgacgaggatcatgcccactggaccgaagcgaagatgttactggacaacattaatacaccagagggtatcatccccgcactcttcgaacctgagcgggaaaaatccgccgctattgatggggagtataggctgcgcggcgaggccagaaagacttttgtggaacttatgaggcggggagacctgccagtatggctcagctacaaagtggcttcagagggcttccaatatagtgatcgtcgctggtgctttgacggggaacgaaacaatcaggttttggaggaaaacatggatgtcgagatatggacgaaggagggagaaaggaaaaagctgaggccccggtggctagacgcacgcacctactctgaccctctggccctcagagagttcaaagaatttgctgccggtaggcggtccgtgagcggcgatcttatcctggagattgggaagttaccgcagcacttgacacagcgagcacaaaatgcgctggacaacctcgtgatgctgcataattcagaacagggaggcagagcctatcgccacgctatggaggagcttccagatactatcgaaaccctgatgctcttggccctgattgcagtcttaacaggtggggttaccctattctttctgagtggcaggggactcggcaagactagcatcgggcttctgtgtgtgatgacgtcctctgtattgctgtggatggctagcgtggagccccattggatagccgcatccatcattctcgagttctttctgatggtccttctcatccctgagcccgaccggcagcgtaccccacaggataaccaactggcctacgtggttattggattgctgttcatgatcttaacagtggctgcgaatgagatgggtctactggaaactaccaaaaaggacctcggcatagggcacgtcgccgtagagaaccaccatcacgcagctatgcttgatgtggacctgcatcctgcctcagcctggacattgtacgcagttgctaccactattatcacacccatgatgagacacacgattgaaaacaccactgccaatatctctctgacagcgatagctaaccaggccgcaatcctcatgggactggataaaggctggccaattagtaagatggacatcggtgtgcctcttttagccctggggtgctattcgcaggtcaatccgctcaccttgaccgctgcagtgctgatgctagtcgcccattacgcgattatcggccccggactgcaagctaaagccacaagggaggcacagaagcgcactgccgctggcataatgaagaacccaacggtggatgggattgttgccatcgacctcgatcctgtggtatatgacgcaaaatttgaaaagcagcttggacagatcatgctgttgattctgtgtaccagccaaatcctcctgatgcggacaacttgggctttatgcgagtccataacccttgccacaggccccctgaccactctctgggagggttctccagggaaattctggaatacgacaattgcggtgtcaatggccaacatctttcgaggaagctacctagcaggcgctggtctggccttctccttgatgaagagtctgggcgggggaagaaggggcaccggggcacagggagaaactctcggcgagaaatggaagcgccagcttaatcagctgtctaagagcgagttcaacacctataaacggtcaggtattatggaggtcgacagatccgaagctaaggaggggttgaaacgtggagagacaactaagcacgccgttagtaggggcaccgccaaactgcggtggtttgtggaacgcaatctcgtcaagcctgagggtaaggtgatcgatttaggctgtgggcgaggaggctggagctactattgcgcggggctgaaaaaggtaacagaagtgaaaggatacacgaagggcggtcccgggcacgaggaaccgataccaatggctacctacggatggaaccttgttaaactgcattctggcaaggacgtgttctttatccctcccgagaaatgtgatactctactctgcgacattggcgagtcctcaccaaatcccacaatcgaagaggggagaaccctgagggtcttgaagatggtggaaccttggctgcggggaaaccaattctgtattaagatcctcaatccgtatatgcccagcgtcgtggagactcttgagcagatgcagcgcaaacacggtggcatgctggttagaaacccattatcgagaaattctacacatgaaatgtactgggtaagttgcgggaccggaaacattgtgtccgcagtcaatatgacgagccgaatgctgttgaaccggtttaccatggcccaccgtaagcctacatatgagagagatgtggacctcggcactggtacccgccacgttgctgtggaacccgaggtcgccaacctggatatcatagggcagaggattgaaaatatcaaacatgagcacaagtcaacatggcattacgacgaggataacccttataaaacttgggcataccacggatcctatgaagtgaagccatctggcagcgccagttccatggtaaatggcgtggttaagctacttaccaaaccctgggacgtcatccctatggtgacacaaattgctatgaccgatactacgccattcgggcagcagcgggtgtttaaggagaaagtcgacacaagaacccccaaggcgaaacgcggaactgcccaaataatggaagttaccgcaaggtggctgtggggtttcctcagccgaaacaagaagccgcggatctgtacaagagaggaatttacgaggaaagtgcgctctaatgctgccattggcgcagtattcgtggacgagaaccagtggaactcagccaaggaggctgtcgaagatgagcgtttttgggacctggtgcatcgggaaagagagttgcacaaacaggggaagtgcgcaacctgcgtttacaacatgatgggaaaaagggaaaagaagctgggcgagttcggtaaagcgaaggggagtcgcgcaatctggtacatgtggctcggagcccgatttcttgagttcgaagctctgggcttcatgaatgaggatcactggttttcccgggaaaacagcttatctggcgtggagggggagggactgcataaattgggttatattctcagagacatctcgaagatacctggcgggaatatgtacgccgatgacactgcaggatgggatacaaggatcaccgaagacgatctgcagaacgaggctaaaattactgacatcatggaaccagagcacgccctacttgctaaggccattttcaaactgacatatcaaaataaggtcgtgcgcgtacagagacccgcaaagaacggcaccgttatggatgtgatctcacggagggaccagcgtggtagcgggcaggtcggaacatacggcctcaatacttttaccaacatggaagcgcaactgatacgacagatggagtccgagggcattttcagtccttctgaattggagacgccaaacttagccgaacgcgctctggattggctcgagaaatatggggtggaaagacttaagcggatggccatcagcggagacgactgtgtggtcaaacccatcgatgacaggtttgcaaccgctctgacagccctaaatgatatgggtaaggttcgcaaagacattccgcagtgggagccttccaagggctggaacgattggcagcaagtgcccttctgctcacatcactttcaccagctgataatgaaggacgggagagagatcgtagtgccatgtcggaatcaggatgaactcgtcggaagggcacgagtgagtcagggcgccggttggtctttgcgtgagactgcgtgcctggggaaaagctacgctcaaatgtggcagcttatgtatttccatagacgcgacctgcggctcgccgcaaacgccatttgttccgctgttcctgtggattgggtccccacctcaaggacaacttggagcatccacgcccatcaccagtggatgaccacggaagacatgttatctgtgtggaatagagtatggattgaggaaaacccatggatggaggataagacacatatctccagttgggaggacgttccctacctgggaaaacgcgaagaccaatggtgcggcagcttgataggcctgaccgcacgggctacttgggccacaaatatccaggtggcgattaaccaggtcaggcgactcatcgggaatgagaactaccttgattatatgacctcgatgaagagatttaaaaatgaatccgaccctgagggagctctgtggtga

SEQ ID NO: 13810 - RNA, 9879 nt, synthetic construct
  misc_feature 1..9879: note = derived and/or modified CDS sequence (opt3) from DENV-1__FJ882564__SS-prME
  source 1..9879: mol_type = other RNA
agcgtgaccatgctgctcatgcttatgcccaccgcactggctttccacttgactacgaggggaggggagcctcatatgatcgtaaccaagcaggaaaggggaaaatccttactgtttaagacatctgccggtgttaatatgtgcactctgattgccatggacctcggcgagctgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggtagcttcaaactggagaaggaagtggctgagacccagcacggaacggtccttgtgcagataaagtacgagggcacagacgcgccttgcaaaatcccattctcgacccaagatgaaaagggggttactcagaacggacgcttgattacagcaaatcccatcgtgaccgacaaagagaagcctgtaaacatagaagccgagccaccctttggcgagtcttatattgtcatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtgtttacatccgttgggaaacttgtgcatcagattttcggaacggcgtacggcgtcctgttttctggtgtgagctggaccatgaagatagggatcggcgtattgctcacttggctgggattaaattcacgaagtacatccctgagcatgacctgtattgctgtgggcctagttacactctacctgggggtcatggtgcaggccgattctggatgcgtgatcaactggaaaggccgcgaacttaagtgtggttcagggatcttcgtcactaatgaggttcacacctggacggaacaatataagtttcaggcagacagtccgaaaagattgagcgccgctattggaaaggcctgggaggagggcgtgtgcggtataaggtccgcaacacggctggaaaacatcatgtggaaacagatttctaacgagctcaatcatatcctgttagaaaacggcatgaagttcaccgtggtagtcggggacgtggttggcattctggctcagggcaaaaagatgatccgccctcaacccatggagcacaaatactcgtggaaaagctgggggaaggccaagataatcggagcggatgtgcagaatactacctttattatcgacggcccaaacacacctgaatgtcccgatgaccagagagcctggaatatttgggaggtcgaggattatggtttcgggatctttactaccaacatatggcttaagttgagggactcctacacacaggtgtgcgatcaccgtctcatgtcagctgcaattaaagacagtaaggccgttcatgctgatatgggatattggatcgaatctgagaaaaatgaaacgtggaagctggcccgggcatccttcattgaggtgaagacctgtatctggccaaaatcccacactctatggtcaaacggcgtactggaaagcgagatgataatccccaagatttacggtggccctatctctcaacataattatcgaccagggtacttcacacagaccgcgggaccgtggcacctcggcaaactggagcttgactttgatttgtgcgaagggactacagtcgtggtggacgagcactgcggaaacagaggcccctccctgaggaccacgactgtcaccggtaagattatccatgaatggtgttgccgcagttgtacattacctccactccggttcaaaggggaggatggatgctggtacggcatggagataagacccgttaaggaaaaggaggaaaatctggtgaaaagcatggtatctgccggttccggcgaggtggactcatttagtcttgggctgttgtgtaccagcattatgatcgaagaggtcatgaggtcgcgctggtcccgaaagatgctcatgactggaacactggctgtgttcctactgctcatcatgggccagctgacctggaacgaccttattcggttgtgcatcatggttggggccaatgcatctgatcgtatgggaatgggcacaacttatctggctttaatggccacctttaaaatgagacctatggtggcagtcggtctcctgttcaggcgccttacgagccgggaggtgctgctactcacaattgggctgtcattggttgccagtgtggaactgccaaactccttagaggaactcggagacggcctggctatgggcataatgatccttaagctgttgaccgattttcaatctcaccagctctgggcgactctgctaagcctgaccttcattaaaacaactctttccctccattacgcctggaagaccatggcaatggtcctgtcaatcgtcagcttgtttcccctgtgtttaagtacgacatctcagaagaccacttggctcccggtgctgcttgggtccctgggatgcaaacctttgacaatgttcctcattgctgagaataagatctggggtagaaaaagctggccactgaacgaaggcataatggccgttggggtggtctcgatcctactgtcatctcttctcaagaacgacgtgcccctggccggacctttgattgctggcggtatgttaatcgcatgttatgtaattagtgggtccagcgccgatctgtctctcgagaaagcggctgaggtgagctgggaagaggaagccgagcactccggagcatcacataatatcctggtcgaagttcaggacgatggcaccatgaagataaaagacgaggagagggatgacactcttacaattctgttgaaggccaccctactggctgtgagtggcgtgtaccccctcagcatcccagcaacgctgtttgtctggtatttctggcaaaagaaaaagcagcgatctggggtgctttgggatactccttcacccccagaagttgagcgcgccgtattagacgatggaatctaccggattatgcagagaggtctgctcggcaggagccaggtgggggtcggagtgtttcaagaaaacgttttccacaccatgtggcacgtgacacgtggcgcggtcttgatgtatcagggtaaacgcctggagccgagttgggctagcgtgaagaaagacctcatatcctacgggggaggctggcggctgcagggctcttggaataccggggaggaagtacaggtcatcgccgtggagcctggaaagaaccccaagaatgttcaaacagcaccaggtactttcaaaacccccgaaggcgaggtgggggccattgctcttgactttaagcctggaacgtcgggcagcccaatcgtcaacagagaaggtaaaattgtggggctgtacggaaatggcgttgtgacaacttcaggcacctatgtctccgccatcgcacaggctaaggccagtcaggaggggcccttgcctgagatagaagatgaggtgttcaggaaacgaaacctaacaatcatggacctgcatccgggatctggtaagacccggcgctacctcccagcgattgtaagagaagccatcaagaggaaattacggactctgattcttgcacccacccgagtggttgctagcgagatggccgaagctctgaagggcatgcctatcagatatcaaacaacggcagtcaaatccgagcacactgggaaggagatagtggatctcatgtgccatgccacctttacaatgcgcttgctgtcaccagtgagggtccccaattacaacatgattatcatggacgaagcccacttcaccgatccttctagcatcgctgcgcgtggatatattagtactcgggtaggcatgggtgaggcagccgctatctttatgacagccaccccgcccgggtccgtggaagcattcccacagagcaatgccgttatacaggacgaggaaagagatattcctgagaggtcttggaactcaggatacgagtggatcacggactttcccggcaaaactgtgtggttcgtcccatccattaagagtggcaatgatatcgctaactgtctccgcaagaatgggaaacgagtgatacagctgagcagaaagacatttgacaccgaatatcagaaaaccaagaacaacgattgggactacgttgtgactacagacatttcggagatgggagcgaatttccgggccgatagggtcatcgaccctcgccgttgccttaaacccgtgatcctaaaggatggtccagaaagagtaattctggcaggcccgatgcctgtgaccgttgcttctgccgcacagcggagggggcgcatcggacgaaaccataataaggagggcgaccagtacatttatatgggtcagcccttgaacaatgatgaggaccacgcccactggacagaagctaaaatgttactggataacataaatactccagaggggatcattcccgccctctttgaacctgagagagaaaagtccgcggcaatcgacggcgagtaccggctgaggggagaggcccgcaaaacgttcgtcgaacttatgagaaggggcgatctgccagtgtggctcagctataaggtggcttcagaggggttccaatacagtgaccggcgttggtgctttgatggagaacgcaacaatcaggtcttggaggaaaacatggacgttgagatctggaccaaagagggtgaacgaaagaaactgagacccaggtggctagatgcccggacatattctgaccctctggctctccgcgagttcaaggaatttgcagccggcagaaggtccgtgagcggggaccttattctggagataggaaagttaccgcagcatttgactcagcgggctcaaaatgccctggataacctcgtaatgctgcacaattcagaacagggcggtcgagcatacagacatgcgatggaggagcttccagacaccatcgaaacactgatgctcttggccctgattgctgtgttaaccgggggcgtcactctattctttctgagtggacgcggcctcgggaaaacgagcatcggacttctgtgtgtgatggcctcctctgttttgctgtggatggcaagcgtggagccccactggattgctgcctccatcatactcgagttctttctgatggtccttctcatccctgagcccgataggcagcggaccccacaggacaaccaactggcatatgtagtgattggtttgctgttcatgatcttaacagttgccgctaatgagatgggcctactggaaactaccaagaaagatctcgggattggacacgtggcggtcgagaaccatcaccatgccacaatgcttgacgtggatctgcaccctgcatcagcttggaccttgtacgccgtcgccactacaatcataacgcccatgatgcgtcataccattgaaaacactacagcaaatatctctctgaccgctattgccaaccaggcggctatcctcatgggcctggacaagggttggccaataagtaaaatggatatcggggtgcctcttttagccctgggctgctactcgcaggttaatccgctcaccttgacagcagccgtgctgatgctagtagctcactatgcaattatcggacccggcctgcaagccaaggcgactagagaggctcagaagaggacggccgcagggattatgaaaaacccaaccgtggacggaatcgtcgccatagatctcgaccctgttgtgtacgatgctaagtttgaaaaacagcttggccagattatgctgttgatcctgtgtacaagccaaatcctcctgatgcgcactacctgggccttatgcgagtccattacacttgcaaccggtcccctgactacgctctgggaggggtctccaggaaagttctggaatacaaccatcgctgtctcaatggccaacatatttcggggcagctatctagcgggtgccggcctggcattctccttgatgaaaagtctagggggaggccgaagagggactggagctcagggcgaaaccctcggtgagaagtggaagaggcagcttaatcagctgtctaaaagcgaatttaacatttacaagcgctcagggatcatggaggtggaccggtccgaagccaaagagggattgaagagaggcgagacaactcgtcacgcagtaagtaggggtaccgctaaactgcggtggttcgtggaacgcaatctcgttaagcctgagggcaaggtgattgacttagggtgtggacgaggcgggtggagctattactgcgccggactgaaaaaggtcacagaagtgaaaggctatacgaagggtgggcccggacatgaggaaccgatcccaatggccacctacggctggaaccttgtcaaactgcactctggcaaggatgtgttctttactcctcccgagaaatgtgacacactactctgcgatataggggagtcctcaccaaatcccaccatcgaagagggaagaactctgagggttttgaagatggtagaaccttggctgcggggtaaccaattctgtattaagatcctcaatccgtacatgcccagcgtggtcgagacacttgagcagatgcagcgcaaacatggcgggatgctggtgagaaacccattatcgagaaattctacccacgaaatgtattgggttagttgcggaacgggcaacattgtgtccgcggtcaatatgaccagccgaatgctgttgaaccggtttacaatggctcaccgtaagcctacttacgagagagacgtggatctcggtgcagggacccgccatgtagccgtggaacccgaggttgctaacctggacatcattggacagaggatcgaaaatataaaacacgagcataagtcaacatggcactatgatgaggacaacccttacaaaacttgggcctatcatggctcctacgaagtcaagccatctggcagcgcaagttccatggtgaatggggtggtcaagctacttaccaaaccctgggatgttattcctatggtgacacaaatcgccatgaccgacactacgccattcggacagcagcgggtatttaaggagaaagtggatacaagaacccccaaggctaaacgcggtactgcgcaaatcatggaagtcaccgccaggtggctgtggggcttcctcagccgaaacaagaagccgcggatttgtacaagagaggaatttacgaggaaagtgcgctctaatgcagctataggggccgttttcgtggacgagaaccagtggaactcagcaaaggaggccgtcgaagacgagcgtttttgggatctggtgcagaaagaacgggagttgcacaagcagggaaaatgcgctacctgcgtatataacatgatgggcaagagagaaaagaaactgggtgagttcgggaaggccaaaggaagtagggcgatctggtacatgtggctcggcgcacgctttcttgagttcgaagccctgggctttatgaatgaggaccactggttctcccgagaaaacagcttatctggggttgagggagagggtctgcataagttgggctacattctccgggatatctcgaaaattcctgggggaaatatgtatgctgacgatactgccggctgggacacaagaatcaccgaagatgacctgcaaaacgaggcaaagataactgatatcatggaaccagagcacgctctacttgccacatcaattttcaaactgacctaccagaataaggtggtcagggtgcagcgccccgctaagaacggtacagtgatggacgtcatcagcagacgggatcagagggggtccggacaagttggcacttatggcctcaatacctttacgaacatggaagcccagctgattcgtcagatggagagtgaggggatcttcttgccttctgaattagagaccccaaacctggcagaacgagtgctcgactggcttgagaaatacggagtagaacgcctgaagagaatggcgataagcggtgatgactgtgtggtcaaacccattgacgatcggtttgccacagctctaactgccctgaatgacatgggcaaggtgaggaaagatatcccgcagtgggagccttccaaggggtggaacgactggcaacaggttcccttctgctcacatcactttcaccagctcatcatgaaggatggacgcgagattgtggtcccatgtagaaatcaggacgaattggtgggccgggcaagggtaagtcaaggtgctgggtggtctctgcgagagaccgcctgccttggaaaaagctatgcacagatgtggcagctgatgtacttccatcgtagagatctccgcttagccgcgaacgctatatgttccgccgttcctgtggactgggtccccacatcacggactacctggagcatccacgcacatcaccaatggatgacgacagaagatatgctgtctgtgtggaatagggtttggattgaggaaaacccatggatggaggacaagacccatgtgtccagttggggcgatgtcccctatttgggcaaaagagaggaccagtggtgcgggagcctgatcggactcactgcccgcgctacatgggcctcgaatattcaggtggcaatcaaccaggtacggaggcttataggtaatgaaaactacctggactacatgacctccatgaagcgatttaaaaatgagggcgatcctgaaggggctctatggtga

SEQ ID NO: 13811 - RNA, 9879 nt, synthetic construct
  misc_feature 1..9879: note = derived and/or modified CDS sequence (opt3) from DENV-1__FJ882565__SS-prME
  source 1..9879: mol_type = other RNA
agcgtgaccatgctgctcatgcttatgcccaccgcactggctttccacttgactacgaggggaggggaacctcatatgatcgtcaccaagcaggaaaggggaaaatccttactgtttaagacatctgccggtgttaatatgtgcactctgattgccatggacctcggcgaactgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggatcgttcaaactggagaaggaagtggctgagacccagcacggtacggtccttgtgcagataaagtacgagggcacagacgcgccttgcaaaatcccattctcgacccaagatgaaaagggggttactcagaacggacgcttgattacagcaaatcccatcgtgaccgacaaagagaagcctgtaaacatagaagccgagccaccctttggcgagtcttatattgtcatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtgtttacatccgttgggaaacttgtgcatcagattttcggaacggcgtacggcgtcctgttttctggtgtgagctggaccatgaagatagggatcggcgtattgctcacttggctgggattaaattcacgaagtacatccctgagcatgacctgtattgctgtgggcctagttacactctacctgggggtcatggtgcaggccgattctggatgcgtgatcaactggaaaggccgcgaacttaagtgtggttcagggatcttcgtcactaatgaggttcacacctggacggaacaatataagtttcaggcagacagtccgaaaagattgagcgccgctattggaaaggcctgggaggagggcgtgtgcggtataaggtccgcaacacggctggaaaacatcatgtggaaacagatttctaacgagctcaatcatatcctgttagaaaacgacatgaagttcaccgtggtagtcggcgatgtggttgggattctggctcagggcaaaaagatgatccgccctcaacccatggagcacaaatactcgtggaaaagctggggcaaggccaagataatcggggcggacgtgcagaatactacctttattatcgatggaccaaacacacctgaatgtcccgacgatcagagagcctggaatatttgggaggtcgaggactatggcttcggtatctttactaccaacatatggcttaagttgagggggtcctacacacaggtgtgcgatcaccgtctcatgtcagctgcaattaaagacagtaaggccgttcatgctgatatgggatattggatcgaatctgagaaaaatgaaacgtggaagctggcccgggcatccttcattgaggtgaagacctgtatctggccaaaatcccacactctatggtcaaacggcgtactggaaagcgagatgataatccccaagatttacggtggccctatctctcaacataattatcgaccagggtacttcacacagaccgcgggaccgtggcacctcggcaaactggagcttgactttgatttgtgcgaagggactacagtcgtggtggacgagcactgcggaaacagaggcccctccctgaggaccacgactgtcaccggtaagattatccatgaatggtgttgccgcagttgtacattacctccactccggttcaaaggggaggatggatgctggtacggcatggagataagacccgttaaggaaaaggaggaaaatctggtgaaaagcatggtatctgccggttccggcgaggtggactcatttagtcttgggctgttgtgtattagcatcatgatcgaagaggtcatgaggtcgcgctggtcccgaaagatgctcatgaccggaactctggctgtgttcctactgctcattatgggccagctgacatggaacgaccttatccggttgtgcattatggttggggccaatgcatctgatcgtatgggaatgggcaccacatatctggctttaatggccacttttaaaatgagacctatgttcgcagtgggtctcctgtttaggcgccttaccagccgggaggtcctgctactcacgatagggctgtcattggtggccagtgttgaactgccaaactccttagaggaactcggagacggcctggctatgggcatcatgattcttaagctgttgacagatttccaatctcaccagctctgggcgaccctgctaagcctgacttttatcaaaaccacactttccctccattacgcctggaagactatggcaatggtgctgtcaattgtcagcttgttccccctgtgtttaagtaccacgtctcagaagacaacctggctcccggtactgcttgggtccctgggatgcaaacctttgactatgtttctcatcgctgagaataagatatggggtagaaaaagctggccactgaacgaaggcatcatggccgtgggggttgtgtcgattctactgtcatctcttctcaagaacgacgtccccctggccggacctttgatcgctggcggtatgttaattgcatgttatgtgatcagtgggtccagcgccgatctgtctctcgagaaagcggctgaggtaagctgggaagaggaagccgagcactccggagcatcacataatatactggtggaagtccaggacgatggcacaatgaagattaaagacgaggagagggatgacacccttactatcctgttgaaggccacactactggctgttagtggcgtgtaccccctcagcatcccagcaaccctgttcgtgtggtatttttggcaaaagaaaaagcagcgatctggggtcctttgggatacgccttcacccccagaagtggagcgcgccgttttagacgatggaatttaccggataatgcagagaggtctgctcggcaggagccaggtaggggtgggagtcttccaagaaaacgtgttccacactatgtggcacgttacccgtggcgcggtgttgatgtatcagggtaaacgcctggagccgagttgggctagcgtcaagaaagacctcatctcctacgggggaggctggcggctgcagggctcttggaatacaggggaggaagtgcaggtaattgccgtcgagcctggaaagaaccccaagaatgtgcaaaccgcaccaggtacatttaaaactcccgaaggcgaggttggggccatcgctcttgacttcaagcctggaacctcgggcagcccaattgtgaacagagaaggtaaaatcgtcgggctgtacggaaatggcgtggttacgacatcaggcacttatgtgtccgccatagcacaggctaaggccagtcaggaggggcccttgcctgagatcgaagatgaggtctttaggaaacgaaacctaaccattatggacctgcatccgggatctggtaagacacggcgctacctcccagcgatcgtgagagaagccattaagaggaaattacggaccctgatccttgcacccactcgagtagtggctagcgagatggccgaagctctgaagggcatgcctataagatatcaaaccacagcagttaaatccgagcacacggggaaggagattgtcgatctcatgtgccatgccactttcaccatgcgcttgctgtcaccagtgagggtgcccaattacaacatgatcatcatggacgaagcccactttacagatccttctagcattgctgcgcgtggatatatcagtacccgggtcggcatgggtgaggcagccgctatattcatgactgccacaccgcccgggtccgtagaagcatttccacagagcaatgccgtgattcaggacgaggaaagagatatccctgagaggtcttggaactcaggatacgagtggattaccgacttccccggcaaaacggtttggtttgtgccatccatcaagagtggcaatgatatagctaactgtctccgcaagaatgggaaacgagtcattcagctgagcagaaagactttcgacacagaatatcagaaaaccaagaacaacgattgggactacgtggttaccactgacatctcggagatgggagcgaattttcgggccgatagggtgatcgaccctcgccgttgccttaaacccgtcattctaaaggatggtccagaaagagtgatcctggcaggcccgatgcctgtaacagtggcttctgccgcacagcggagggggcgcattggacgaaaccataataaggagggcgaccagtacatatatatgggtcagcccttgaacaatgatgaggaccacgcccactggaccgaagctaaaatgttactggataacatcaatacaccagaggggattatccccgccctcttcgaacctgagagagaaaagtccgcggcaatcgacggcgagtaccggctgaggggagaggcccgcaaaactttcgttgaacttatgagaaggggcgatctgccagtctggctcagctataaggtggcttcagaggggtttcaatacagtgaccggcgttggtgcttcgatggagaacgcaacaatcaggtgttggaggaaaacatggacgtcgagatttggacgaaagagggtgaacgaaagaaactgagacccaggtggctagatgcccggacctattctgaccctctggctctccgcgagtttaaggagttcgcagccggcagaaggtccgttagcggggaccttatactggagatcggaaagttaccgcagcatttgacacagcgggctcaaaatgccctggataacctcgtgatgctgcacaattcagaacagggcggtcgagcatacagacatgcgatggaggagcttccagacactattgaaaccctgatgctcttggccctgatcgctgtattaacagggggcgtgaccctatttttcctgagtggacgcggcctcgggaaaactagcattggacttctgtgtgtcatggcctcctctgtgttgctgtggatggcaagcgttgagccccactggatcgctgcctccataatcctcgaatttttcctgatggtgcttctcattcctgagcccgataggcagcggacgccacaggacaaccaactggcatatgtcgtaatcggtttgctgtttatgattttaaccgtggccgctaatgagatgggcctactggaaacaactaagaaagatctcgggatcggacacgttgcggtggagaaccatcaccatgccaccatgcttgacgtcgatctgcaccctgcatcagcttggacattgtacgccgtggccaccactataattacacccatgatgcgtcatacgatcgaaaacaccactgcaaatatttctctgacagctatcgccaaccaggcggctatactcatgggcctggacaagggttggccaatcagtaaaatggatattggggtccctcttttagccctgggctgctacagccaggtgaatccgctcaccttgaccgcagccgttctgatgctagtggctcactatgcaatcattggacccggcctgcaagccaaggcgacaagagaggctcagaagaggactgccgcagggatcatgaaaaacccaacggtagacggaatagtggccattgatctcgaccctgtcgtttacgatgctaagttcgaaaaacagcttggccagatcatgctgttgatcctgtgtaccagccaaattctcctgatgcgcacaacttgggccttatgcgagtccatcacccttgcaacaggtcccctgaccactctctgggaggggtctccaggaaagttttggaatacgacaatagctgtgtcaatggccaacattttccggggcagctatctagcgggtgccggcctggcattttccttgatgaaaagtctagggggaggccgaagagggaccggagctcagggcgaaactctcggtgagaagtggaagaggcagcttaatcagctgtctaaaagcgagttcaacatctacaagcgctcagggattatggaggtcgaccggtccgaagccaaagagggattgaagagaggcgagaccacacgtcacgcagtgagtaggggtactgctaaactgcggtggttcgtagaacgcaatctcgtgaagcctgagggcaaggttatcgacttagggtgtggacgaggcgggtggagctattactgcgccggactgaaaaaggtgaccgaagtcaaaggctatacaaagggtgggcccggacatgaggaaccgataccaatggccacgtacggctggaaccttgtgaaactgcactctggcaaggatgtctttttcacccctcccgagaaatgtgacactctactctgcgatatcggggagtcctcaccaaatcccacaattgaagagggaagaaccctgagggtgttgaagatggttgaaccttggctgcggggtaaccaattttgtatcaagattctcaatccgtacatgcccagcgtagtggagactcttgagcagatgcagcgcaaacatggcgggatgctggtcagaaacccattatcgagaaattctacacacgaaatgtattgggtgagttgcggaaccggcaacatcgtttccgcggtgaatatgacgagccgaatgctgttgaaccggttcaccatggctcaccgtaagcctacatacgagagagacgtcgatctcggtgcagggactcgccatgtggccgtagaacccgaggtggctaacctggacattatcggacagaggatagaaaatattaaacacgagcataagtcaacctggcactatgatgaggacaacccttacaaaacatgggcctatcatggctcctacgaagttaagccatctggcagcgcaagttccatggtcaatggggtggtgaagctacttactaaaccctgggatgtcatccctatggttacccaaatcgccatgacagacaccactccatttggacagcagcgggtgttcaaggagaaagtagatacgagaacacccaaggctaaacgcggtaccgcgcaaattatggaagtgactgccaggtggctgtggggctttctcagccgaaacaagaagccgcggatatgtaccagagaggagttcacaaggaaagtccgctctaatgcagctatcggggccgtgtttgttgacgagaaccagtggaactcagcaaaggaggccgtggaagacgagcgtttctgggatctggtccagaaagaacgggagttgcacaagcagggaaaatgcgctacgtgcgtgtataacatgatgggcaagagagaaaagaaactgggtgagtttgggaaggccaaaggaagtagggcgatttggtacatgtggctcggcgcacgcttccttgagtttgaagccctgggcttcatgaatgaggaccactggttctcccgagaaaacagcttatctggggtagagggagagggtctgcataagttgggctacatcctccgggatatttcgaaaatccctgggggaaatatgtatgctgacgataccgccggctgggacactagaataacagaagatgacctgcaaaacgaggcaaagatcaccgatattatggaaccagagcacgctctacttgccacttcaatctttaaactgacataccagaataaggttgtgagggtccagcgccccgctaagaacggtaccgtgatggacgtgattagcagacgggatcagagggggtccggacaagtcggcacatatggcctcaatactttcaccaacatggaagcccagctgatccgtcagatggagagtgaggggatatttttgccttctgaattagagacgccaaacctggcagaacgagttctcgactggcttgagaaatacggagtggaacgcctgaagagaatggcgattagcggtgatgactgtgtagtgaaacccatcgacgatcggttcgccaccgctctaacagccctgaatgacatgggcaaggtcaggaaagatatcccgcagtgggagccttccaaggggtggaacgactggcaacaggtgcccttttgctcacatcacttccaccagctcattatgaaggatggacgcgagatagttgtgccatgtagaaatcaggacgaattggtcggccgggcaagggtgagtcaaggtgctgggtggtctctgcgagagactgcctgccttggaaaaagctatgcacagatgtggcagctgatgtactttcatcgtagagatctccgcttagccgcgaacgctatctgttccgccgtacctgttgactgggtgcccacctcacggacaacttggagcattcacgcacatcaccaatggatgaccacggaagatatgctgtctgtctggaatagggtgtggatcgaggaaaacccatggatggaggacaagacacatgtttccagttggggcgatgtgccctatttgggcaaaagagaggaccagtggtgcgggagcctgattggactcaccgcccgcgctacttgggcctcgaatatccaggtcgcaataaaccaggtgcggaggcttatcggtaatgaaaactacctggactacatgacatccatgaagcgattcaaaaatgagggcgatcctgaaggggctctatggtga

SEQ ID NO: 13812 - RNA, 9879 nt, synthetic construct
  misc_feature 1..9879: note = derived and/or modified CDS sequence (opt3) from DENV-1__FJ882567__SS-prME
  source 1..9879: mol_type = other RNA
agcgtgaccatgctgctcatgcttatgcccaccgcactggctttccacttgactacgaggggaggggaacctcatatgatcgtcaccaagcaggaaaggggaaaatccttactgtttaagacatctgccggtgttaatatgtgcactctgattgccatggacctcggcgaactgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggatcgttcaaactggagaaggaagtggctgagacccagcacggtacggtccttgtgcagataaagtacgagggcacagacgcgccttgcaaaatcccattctcgacccaagatgaaaagggggttactcagaacggacgcttgattacagcaaatcccatcgtgaccgacaaagagaagcctgtaaacatagaagccgagccaccctttggcgagtcttatattgtcatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtgtttacatccgttgggaaacttgtgcatcagattttcggaacggcgtacggcgtcctgttttctggtgtgagctggaccatgaagatagggatcggcgtattgctcacttggctgggattaaattcacgaagtacatccctgagcatgacctgtattgctgtgggcctagttacactctacctgggggtcatggtgcaggccgattctggatgcgtgatcaactggaaaggccgcgaacttaagtgtggttcagggatcttcgtcactaatgaggttcacacctggacggaacaatataagtttcaggcagacagtccgaaaagattgagcgccgctattggaaaggcctgggaggagggcgtgtgcggtataaggtccgcaacacggctggaaaacatcatgtggaaacagatttctaacgagctcaatcatatcctgttagaaaacggcatgaagttcaccgtggtagtcggggacgtggttggcattctggctcagggcaaaaagatgatccgccctcaacccatggagcacaaatactcgtggaaaagctgggggaaggccaagataatcggagcggatgtgcagaatactacctttattatcgacggcccaaacacacctgaatgtcccgatgaccagagagcctggaatatttgggaggtcgaggattatggtttcgggatctttactaccaacatatggcttaagttgagggactcctacacacaggtgtgcgatcaccgtctcatgtcagctgcaattaaagacagtaaggccgttcatgctgatatgggatattggatcgaatctgagaaaaatgaaacgtggaagctggcccgggcatccttcattgaggtgaagacctgtatctggccaaaatcccacactctatggtcaaacggcgtactggaaagcgagatgataatccccaagatttacggtggccctatctctcaacataattatcgaccagggtacttcacacagaccgcgggaccgtggcacctcggcaaactggagcttgactttgatttgtgcgaagggactacagtcgtggtggacgagcactgcggaaacagaggcccctccctgaggaccacgactgtcaccggtaagattatccatgaatggtgttgccgcagttgtacattacctccactccggttcaaaggggaggatggatgctggtacggcatggagataagacccgttaaggaaaaggaggaaaatctggtgaaaagcatggtatctgccggttccggcgaggtggactcatttagtcttgggctgttgtgtaccagcattatgatcgaagaggtcatgaggtcgcgctggtcccgaaagatgctcatgactggaacactggctgtgttcctactgctcatcatgggccagctgacctggaacgaccttattcggttgtgcatcatggttggggccaatgcatctgatcgtatgggaatgggcacaacttatctggctttaatggccacctttaaaatgagacctatgttcgcagtgggtctcctgtttaggcgccttacgagccgggaggtcctgctactcacaattgggctgtcattggtggccagtgttgaactgccaaactccttagaggaactcggagacggcctggctatgggcataatgatccttaagctgttgaccgatttccaatctcaccagctctgggcgactctgctaagcctgacctttattaaaacaactctttccctccattacgcctggaagaccatggcaatggtgctgtcaatcgtcagcttgttccccctgtgtttaagtacgacatctcagaagaccacttggctcccggtactgcttgggtccctgggatgcaaacctttgacaatgtttctcattgctgagaataagatctggggtagaaaaagctggccactgaacgaaggcataatggccgtgggggttgtgtcgatcctactgtcatctcttctcaagaacgacgtccccctggccggacctttgattgctggcggtatgttaatcgcatgttatgtgattagtgggtccagcgccgatctgtctctcgagaaagcggctgaggtaagctgggaagaggaagccgagcactccggagcatcacataatatcctggtggaagtccaggacgatggcaccatgaagataaaagacgaggagagggatgacactcttacaattctgttgaaggccaccctactggctgttagtggcgtgtaccccctcagcatcccagcaacgctgttcgtgtggtatttttggcaaaagaaaaagcagcgatctggggtcctttgggatactccttcacccccagaagtggagcgcgccgttttagacgatggaatctaccggattatgcagagaggtctgctcggcaggagccaggtaggggtgggagtcttccaagaaaacgtgttccacaccatgtggcacgttacacgtggcgcggtgttgatgtatcagggtaaacgcctggagccgagttgggctagcgtcaagaaagacctcatatcctacgggggaggctggcggctgcagggctcttggaataccggggaggaagtgcaggtaatcgccgtcgagcctggaaagaaccccaagaatgtgcaaacagcaccaggtacttttaaaacccccgaaggcgaggttggggccattgctcttgacttcaagcctggaacgtcgggcagcccaatcgtgaacagagaaggtaaaattgtcgggctgtacggaaatggcgtggttacaacttcaggcacctatgtgtccgccatcgcacaggctaaggccagtcaggaggggcccttgcctgagatagaagatgaggtctttaggaaacgaaacctaacaatcatggacctgcatccgggatctggtaagacccggcgctacctcccagcgattgtgagagaagccatcaagaggaaattacggactctgattcttgcacccacccgagtagtggctagcgagatggccgaagctctgaagggcatgcctatcagatatcaaacaacggcagttaaatccgagcacactgggaaggagatagtcgatctcatgtgccatgccaccttcacaatgcgcttgctgtcaccagtgagggtgcccaattacaacatgattatcatggacgaagcccactttaccgatccttctagcatcgctgcgcgtggatatattagtactcgggtcggcatgggtgaggcagccgctatcttcatgacagccaccccgcccgggtccgtagaagcatttccacagagcaatgccgtgatacaggacgaggaaagagatattcctgagaggtcttggaactcaggatacgagtggatcacggacttccccggcaaaactgtttggtttgtgccatccattaagagtggcaatgatatcgctaactgtctccgcaagaatgggaaacgagtcatacagctgagcagaaagacattcgacaccgaatatcagaaaaccaagaacaacgattgggactacgtggttactacagacatttcggagatgggagcgaattttcgggccgatagggtgatcgaccctcgccgttgccttaaacccgtcatcctaaaggatggtccagaaagagtgattctggcaggcccgatgcctgtaaccgtggcttctgccgcacagcggagggggcgcatcggacgaaaccataataaggagggcgaccagtacatttatatgggtcagcccttgaacaatgatgaggaccacgcccactggacagaagctaaaatgttactggataacataaatactccagaggggatcattcccgccctcttcgaacctgagagagaaaagtccgcggcaatcgacggcgagtaccggctgaggggagaggcccgcaaaacgttcgttgaacttatgagaaggggcgatctgccagtctggctcagctataaggtggcttcagaggggtttcaatacagtgaccggcgttggtgcttcgatggagaacgcaacaatcaggtgttggaggaaaacatggacgtcgagatctggaccaaagagggtgaacgaaagaaactgagacccaggtggctagatgcccggacatattctgaccctctggctctccgcgagtttaaggagttcgcagccggcagaaggtccgttagcggggaccttattctggagataggaaagttaccgcagcatttgactcagcgggctcaaaatgccctggataacctcgtgatgctgcacaattcagaacagggcggtcgagcatacagacatgcgatggaggagcttccagacaccatcgaaacactgatgctcttggccctgattgctgtattaaccgggggcgtgactctatttttcctgagtggacgcggcctcgggaaaacgagcatcggacttctgtgtgtcatggcctcctctgtgttgctgtggatggcaagcgttgagccccactggattgctgcctccatcatactcgaatttttcctgatggtgcttctcatccctgagcccgataggcagcggaccccacaggacaaccaactggcatatgtcgtaattggtttgctgtttatgatcttaacagtggccgctaatgagatgggcctactggaaactaccaagaaagatctcgggattggacacgttgcggtggagaaccatcaccatgccacaatgcttgacgtcgatctgcaccctgcatcagcttggaccttgtacgccgtggccactacaatcataacgcccatgatgcgtcataccattgaaaacactacagcaaatatctctctgaccgctattgccaaccaggcggctatcctcatgggcctggacaagggttggccaataagtaaaatggatatcggggtccctcttttagccctgggctgctacagccaggtgaatccgctcaccttgacagcagccgttctgatgctagtggctcactatgcaattatcggacccggcctgcaagccaaggcgactagagaggctcagaagaggacggccgcagggattatgaaaaacccaaccgtagacggaatcgtggccatagatctcgaccctgtcgtttacgatgctaagttcgaaaaacagcttggccagattatgctgttgatcctgtgtacaagccaaatcctcctgatgcgcactacctgggccttatgcgagtccattacacttgcaaccggtcccctgactacgctctgggaggggtctccaggaaagttttggaatacaaccatcgctgtgtcaatggccaacatattccggggcagctatctagcgggtgccggcctggcattttccttgatgaaaagtctagggggaggccgaagagggactggagctcagggcgaaaccctcggtgagaagtggaagaggcagcttaatcagctgtctaaaagcgagttcaacatttacaagcgctcagggatcatggaggtcgaccggtccgaagccaaagagggattgaagagaggcgagacaactcgtcacgcagtgagtaggggtaccgctaaactgcggtggttcgtagaacgcaatctcgtgaagcctgagggcaaggttattgacttagggtgtggacgaggcgggtggagctattactgcgccggactgaaaaaggtgacagaagtcaaaggctatacgaagggtgggcccggacatgaggaaccgatcccaatggccacctacggctggaaccttgtgaaactgcactctggcaaggatgtctttttcactcctcccgagaaatgtgacacactactctgcgatataggggagtcctcaccaaatcccaccatcgaagagggaagaactctgagggtgttgaagatggttgaaccttggctgcggggtaaccaattttgtattaagatcctcaatccgtacatgcccagcgtagtggagacacttgagcagatgcagcgcaaacatggcgggatgctggtcagaaacccattatcgagaaattctacccacgaaatgtattgggtgagttgcggaacgggcaacattgtttccgcggtgaatatgaccagccgaatgctgttgaaccggttcacaatggctcaccgtaagcctacttacgagagagacgtcgatctcggtgcagggacccgccatgtggccgtagaacccgaggtggctaacctggacatcattggacagaggatcgaaaatataaaacacgagcataagtcaacatggcactatgatgaggacaacccttacaaaacttgggcctatcatggctcctacgaagttaagccatctggcagcgcaagttccatggtcaatggggtggtgaagctacttaccaaaccctgggatgtcattcctatggttacacaaatcgccatgaccgacactacgccatttggacagcagcgggtgttcaaggagaaagtagatacaagaacccccaaggctaaacgcggtactgcgcaaatcatggaagtgaccgccaggtggctgtggggctttctcagccgaaacaagaagccgcggatttgtacaagagaggagttcacgaggaaagtccgctctaatgcagctataggggccgtgtttgttgacgagaaccagtggaactcagcaaaggaggccgtggaagacgagcgtttctgggatctggtccagaaagaacgggagttgcacaagcagggaaaatgcgctacctgcgtgtataacatgatgggcaagagagaaaagaaactgggtgagtttgggaaggccaaaggaagtagggcgatctggtacatgtggctcggcgcacgcttccttgagtttgaagccctgggcttcatgaatgaggaccactggttctcccgagaaaacagcttatctggggtagagggagagggtctgcataagttgggctacattctccgggatatctcgaaaattcctgggggaaatatgtatgctgacgatactgccggctgggacacaagaatcaccgaagatgacctgcaaaacgaggcaaagataactgatatcatggaaccagagcacgctctacttgccacatcaatttttaaactgacctaccagaataaggttgtgagggtccagcgccccgctaagaacggtacagtgatggacgtgatcagcagacgggatcagagggggtccggacaagtcggcacttatggcctcaataccttcacgaacatggaagcccagctgattcgtcagatggagagtgaggggatctttttgccttctgaattagagaccccaaacctggcagaacgagttctcgactggcttgagaaacatggagtggaacgcctgaagagaatggcgataagcggtgatgactgtgtagtgaaacccattgacgatcggttcgccacagctctaactgccctgaatgacatgggcaaggtcaggaaagatatcccgcagtgggagccttccaaggggtggaacgactggcaacaggtgcccttttgctcacaccacttccatcagctcatcatgaaggatggacgcgagattgttgtgccatgtagaaatcaggacgaattggtcggccgggcaagggtgagtcaaggtgctgggtggtctctgcgagagaccgcctgccttggaaaaagctacgcacagatgtggcagctgatgtattttcaccgtagagatctccgcttagccgcgaacgctatatgttccgccgtacctgttgactgggtgcccacatcacggactacctggagcatccatgcacaccatcaatggatgacgacagaagatatgctgtctgtctggaatagggtgtggattgaggaaaacccatggatggaggacaagacccacgtttccagttggggcgatgtgccctacttgggcaaaagagaggaccagtggtgcgggagcctgatcggactcactgcccgcgctacatgggcctcgaatattcaggtcgcaatcaaccaggtgcggaggcttataggtaatgaaaactatctggactacatgacctccatgaagcgattcaaaaatgagggcgatcctgaaggggctctatggtga

SEQ ID NO: 13813 - RNA, 9879 nt, synthetic construct
  misc_feature 1..9879: note = derived and/or modified CDS sequence (opt3) from DENV-1__GQ199831__SS-prME
  source 1..9879: mol_type = other RNA
tccgtgaccatgctgctcatgcttatgcccacggccctggctttccacttgactacgaggggaggggaacctcatatgatcgtcaccaagcaggaaaggggaaaatccttactgtttaagacatctgccggtgttaatatgtgcactctaattgccatggacctcggcgaactgtgtgaagataccatgacatacaaatgcccacggataaccgagactgaaccggacgatgtggactgttggtgcaatgcgacagatacctgggtaacgtatgggacttgttcacaaaccggagagcaccgccgagacaagcgtagtgtggctcttgcaccccatgtcggcctgggtttggagacaagaactgaaacctggatgagctccgagggggcatggaaacagatccagagggtggaaacatgggccctccggcaccctggattcaccgttattgctctgtttctggcccatgccatcggcacgtctattactcagaagggcatcatattcatcctcttaatgctggtgacaccatcgatggctatgcgctgcgtcgggattggatcaagagattttgtggagggtcttagcggcgccacctgggtagacgttgtgttggagcacgggagttgtgtcactacaatggcgaaggataaacccaccctggacatcgaactactcaagacggaggtgaccaaccctgcagtgctgaggaaactttgcattgaagccaagatctccaatacaactaccgattctcggtgtccaacacaaggagaggctactctgatggaagaacaagacgccaacttcgtctgccgccgaacctttgttgatagaggctggggtaatgggtgtggattgttcggcaaaggcagcctcataacatgcgcaaagtttaagtgcgtgaccaaactggaggggaagattgtacagtacgaaaacttaaaatattccgtgatcgtcactgtgcacacgggagaccagcatcaagttggtaatgagtcaacagaacacggcaccactgctaccattacaccccaggcccctaccagtgagatccagctgactgactacggggcgctcacacttgattgtagcccaaggacgggactggacttcaacgaaatggtgttgctaaccatgaaggagaaatcttggctggtccataagcagtggtttctcgatctgccgcttccctggacttccggcgcctcaacaagccaagagacctggaatcggcaggacctgttggtgacattcaaaactgcacacgctaagaagcaggaagtagttgtgctcggtagtcaagagggggccatgcacaccgctctgacgggcgccaccgaaatccagacatctggaactaccacaatttttgcaggccatttaaaatgccgtctgaagatggataaactaactctcaaggggatgtcctatgtcatgtgtaccggatcgttcaaactggagaaggaagtggccgagacgcagcacggtacagtccttgtgcagataaagtacgagggcaccgacgctccttgcaaaatcccattctcgactcaagatgaaaagggggttacacagaacggacgcttgattaccgcgaatcccatcgtgactgacaaagagaagcctgtaaacatagaagcagagccaccctttggcgagtcttatattgtcatcggtgccggggaaaaagctctgaagctctcctggttcaagaaaggctcaagtatcggaaagatgtttgaggccaccgcaagaggcgccaggcggatggctattctgggggatacagcctgggacttcggaagcatcggtggcgtgtttacgtccgttgggaaacttgtgcatcagattttcggaaccgcatacggcgtcctgttttctggtgtgagctggactatgaagatagggatcggcgtattgctcacatggctgggattaaattcacgaagtacctccctgagcatgacatgtattgcggtgggcctagttactctctacctgggggtcatggtgcaggctgattctggatgcgtgatcaactggaaaggccgcgaacttaagtgtggttcagggatcttcgtcaccaatgaggttcacacgtggacagaacaatataagtttcaggccgacagtccgaaaagattgagcgcagccattggaaaggcttgggaggagggcgtgtgcggtataaggtccgccacccggctggaaaacatcatgtggaaacagatttctaacgagctcaatcatatcctgttagaaaacgacatgaagttcactgtggtagtcggcgatgtggttgggattctggcacagggcaaaaagatgatccgccctcaacccatggagcacaaatactcgtggaaaagctggggcaaggctaagataatcggggccgacgtgcagaataccacatttattatcgatggaccaaacactcctgaatgtcccgacgatcagagagcgtggaatatttgggaggtcgaggactatggcttcggtatctttaccacaaacatatggcttaagttgagggattcctacacacaggtgtgcgaccaccgtctcatgtcagccgctattaaagatagtaaggcagttcatgccgacatggggtattggatcgaatctgagaaaaatgaaacctggaagctggctcgggccagcttcattgaggtgaagacttgtatctggccaaaatcccacacactatggtcaaacggagtactggaaagcgagatgataatccccaagatttacggcggtcctatctctcaacataattatcgaccaggctacttcacccagactgcagggccgtggcacctcggaaaactggagcttgattttgacttgtgcgaaggcacaaccgtcgtggtggatgagcactgcgggaacagaggaccctccctgaggacgactaccgtcacaggcaagattatccatgaatggtgttgccgcagttgtaccttacctccactccggttcaaaggtgaggacgggtgctggtacggaatggagataagacccgttaaggaaaaggaggaaaatctggtgaaaagcatggtatctgcgggctccggtgaggtggactcatttagtcttggcctgttgtgtattagcatcatgatcgaagaggtcatgaggtcgcgctggtcccgaaagatgctcatgactgggacactggccgtgttcctactgctcattatgggacagctgacctggaacgatcttatccggttgtgcattatggttggcgctaatgcctctgaccgtatggggatgggaacaacttatctggcattaatggctacctttaaaatgagacctatgttcgccgtgggcctcctgtttaggcgccttacgagccgggaggtcctgctactcacaataggtctgtcattggtggcaagtgttgaactgccaaactccttagaggaactcggggatggactggccatgggcatcatgattcttaagctgttgaccgacttccaatctcaccagctctgggctactctgctaagcctgacctttatcaaaacaactctttccctccattacgcgtggaagaccatggccatggtgctgtcaattgtcagcttgttccccctgtgtttaagtacgacatctcagaagaccacttggctcccggtactgcttggctccctggggtgcaaacctttgacaatgtttctcatcgcagagaataagatatggggaagaaaaagctggccactgaacgaaggtatcatggctgtgggcgttgtgtcgattctactgtcatctcttctcaagaacgatgtccccctggccgggcctttgatcgccggaggcatgttaattgcttgttatgtgatcagtggttccagcgcagacctgtctctcgagaaagccgcggaggtaagctgggaagaggaagctgagcactccggggcctcacataatatactggtggaagtccaggatgacggaaccatgaagattaaagatgaggagagggacgatactcttacaatcctgttgaaggcaaccctactggccgttagtggcgtgtaccccctcagcatcccagctacgctgttcgtgtggtatttttggcaaaagaaaaagcagcgatctggcgtcctttgggacactccttcacccccagaagtggagcgcgcagttttagatgacgggatttaccggataatgcagagaggactgctcggtaggagccaggtaggcgtgggggtcttccaagaaaacgtgttccacaccatgtggcacgttacacgtggagccgtgttgatgtatcagggcaaacgcctggagccgagttgggcgagcgtcaagaaagacctcatctcctacggtgggggatggcggctgcagggctcttggaataccggcgaggaagtgcaggtaattgctgtcgagcctgggaagaaccccaagaatgtgcaaacagccccaggaacttttaaaacccccgaaggtgaggttggcgcaatcgcccttgatttcaagcctgggacgtcgggaagcccaattgtgaacagagaaggcaaaatcgtcggtctgtacgggaatggagtggttacaacttcaggcacctatgtgtccgctatagcccaggcaaaggctagtcaggagggccccttgcctgagatcgaagacgaggtctttaggaaacgaaacctaacaattatggatctgcatccggggtctggaaagacccggcgctacctcccagccatcgtgagagaagcgattaagaggaaattacggactctgatccttgcccccacccgagtagtggcaagcgagatggctgaagccctgaagggtatgcctataagatatcaaacaacggctgttaaatccgagcacactggcaaggagattgtcgacctcatgtgccatgcaaccttcacaatgcgcttgctgtcaccagtgagggtgcccaattacaacatgatcatcatggatgaagcccactttaccgacccttctagcattgccgctcgtgggtatatcagtactcgggtcggaatgggcgaggcggcagccatattcatgacagctaccccgcccggttccgtagaagcctttccacagagcaatgcagtgattcaggatgaggaaagagacatccctgagaggtcttggaactcagggtacgagtggattacggatttccccggaaaaactgtttggtttgtgccatccatcaagagtggcaatgacatagccaactgtctccgcaagaatggcaaacgagtcattcagctgagcagaaagacattcgataccgaatatcagaaaaccaagaacaacgactgggactacgtggttactacagatatctcggagatgggggctaattttcgggcggacagggtgatcgatcctcgccgttgccttaaacccgtcattctaaaggacggaccagaaagagtgatcctggccggtccgatgcctgtaaccgtggcatctgctgcccagcggaggggccgcattgggcgaaaccataataaggagggagatcagtacatatatatgggccagcccttgaacaatgacgaggatcacgcacactggacagaagccaaaatgttactggacaacatcaatactccagagggtattatccccgctctcttcgaacctgagagagaaaagtccgccgcgatcgatggggagtaccggctgaggggcgaggcacgcaaaacgttcgttgaacttatgagaaggggagacctgccagtctggctcagctataaggtggcctcagagggctttcaatacagtgatcggcgttggtgcttcgacggggaacgcaacaatcaggtgttggaggaaaacatggatgtcgagatttggaccaaagagggagaacgaaagaaactgagacccaggtggctagacgctcggacatattctgaccctctggccctccgcgagtttaaggagttcgctgcaggtagaaggtccgttagcggcgatcttatactggagatcgggaagttaccgcagcatttgactcagcgggcccaaaatgctctggacaacctcgtgatgctgcacaattcagaacagggaggccgagcctacagacatgcaatggaggagcttccagataccattgaaacactgatgctcttggcgctgatcgccgtattaaccggtggggtgactctatttttcctgagtggccgcggactcggcaaaacgagcattgggcttctgtgtgtcatggcttcctctgtgttgctgtggatggccagcgttgagccccactggatcgcagcttccataatcctcgaatttttcctgatggtgcttctcattcctgagcccgacaggcagcggaccccacaggataaccaactggcctatgtcgtaatcggattgctgtttatgattttaacagtggcagccaatgagatgggtctactggaaactaccaagaaagacctcggcatcgggcacgttgctgtggagaaccatcaccatgcgacaatgcttgatgtcgacctgcaccctgcctcagcatggaccttgtacgctgtggccactacaataattacgcccatgatgcgtcataccatcgaaaacactacagccaatatttctctgaccgcaatcgctaaccaggccgcgatactcatgggactggataagggctggccaatcagtaaaatggacattggtgtccctcttttagctctggggtgctacagccaggtgaatccgctcaccttgacagccgcagttctgatgctagtggcccactatgctatcattggccccggactgcaagcaaaggccactagagaggcgcagaagaggacggctgccggcatcatgaaaaacccaaccgtagatgggatagtggcaattgacctcgatcctgtcgtttacgacgccaagttcgaaaaacagcttggacagatcatgctgttgatcctgtgtacaagccaaattctcctgatgcgcactacctgggctttatgcgagtccatcacacttgccaccggccccctgactacgctctgggagggttctccagggaagttttggaatacaaccatagcagtgtcaatggctaacattttccggggaagctatctagccggcgcgggtctggccttttccttgatgaaaagtctgggcgggggacgaagaggcactggggcacagggagaaaccctcggcgagaagtggaagaggcagcttaatcagctgtctaaaagcgagttcaacatctacaagcgctcaggtattatggaggtcgaccggtccgaagctaaagaggggttgaagagaggagagacaactcgtcacgccgtgagtaggggcaccgcaaaactgcggtggttcgtagaacgcaatctcgtgaagcctgagggtaaggttatcgatttaggctgtgggcgaggaggctggagctattactgcgctgggctgaaaaaggtgacagaagtcaaaggatatacgaagggcggtcccgggcatgaggaaccgataccaatggccacctacggatggaaccttgtgaaactgcactctggcaaggacgtctttttcactcctcccgagaaatgtgatacactactctgcgacatcggcgagtcctcaccaaatcccaccattgaagaggggagaactctgagggtgttgaagatggttgaaccttggctgcggggaaaccaattttgtatcaagattctcaatccgtacatgcccagcgtagtggagacacttgagcagatgcagcgcaaatatggtggcatgctggtcagaaacccattatcgagaaattctacccatgaaatgtactgggtgagttgcgggacgggaaacatcgtttccgccgtgaatatgaccagccgaatgctgttgaaccggttcacaatggcgcaccgtaagcctacttatgagagagatgtcgacctcggcgctggtacccgccacgtggcagtagaacccgaggtggccaacctggatattatcgggcagaggatagaaaatattaaacatgagcacaagtcaacatggcattacgacgaggataacccttataaaacttgggcttaccacggatcctatgaagttaagccatctggcagcgccagttccatggtcaatggcgtggtgaagctacttaccaaaccctgggacgtcatccctatggttacacaaatcgcaatgaccgatactacgccatttgggcagcagcgggtgttcaaggagaaagtagacacaagaacccccaaggccaaacgcggaactgctcaaattatggaagtgaccgcgaggtggctgtggggttttctcagccgaaacaagaagccgcggatatgtacaagagaggagttcacgaggaaagtccgctctaatgccgcaatcggcgctgtgtttgttgacgagaaccagtggaactcagccaaggaggcagtggaagatgagcgtttctgggacctggtccagaaagaacgggagttgcataagcaggggaaatgcgcaacctgcgtgtacaacatgatgggaaagagagaaaagaaactgggcgagtttggtaaggctaaagggagtagggccatttggtacatgtggctcggagcgcgcttccttgagtttgaagcactgggcttcatgaatgaggatcactggttctcccgagaaaacagcttatctggcgtagagggggagggactgcacaagttgggttatatcctccgggacatttcgaaaatccctggcgggaatatgtacgccgatgacactgctggatgggatacaagaataaccgaagacgatctgcaaaacgaggccaagatcactgacattatggaaccagagcatgcactacttgctacatcaatctttaaactgacctatcagaataaggttgtgagggtccagcgccccgccaagaacggcacagtgatggatgtgattagcagacgggaccagaggggttccgggcaagtcggaacttacggcctcaataccttcacgaacatggaagctcagctgatccgtcagatggagagtgagggcatatttttgccttctgaattagagaccccaaacctggccgaacgagttctcgattggcttgagaaatatggggtggaacgcctgaagagaatggcaattagcggagacgactgtgtagtgaaacccatcgatgaccggttcgcgacagccctaactgctctgaatgatatgggtaaggtcaggaaagacatcccgcagtgggagccttccaagggctggaacgattggcaacaggtgcccttttgctcacaccatttccaccagctcattatgaaggacgggcgcgagatagttgtgccatgtagaaatcaggatgaattggtcggacgggccagggtgagtcaaggcgcaggttggtctctgcgagagaccgcttgccttgggaaaagctacgcccagatgtggcagctgatgtattttcaccgtagagacctccgcttagcagccaacgcgatctgttccgctgatcctgtagactgggttcccacatcacggactacctggagcattcatgcccaccatcaatggatgacgacagaagatatgctgtctgtgtggaatagggtctggatcgaggaaaacccatggatggaggacaagacccacgtgtccagttggggagacgttccctacttgggcaaaagagaggatcagtggtgcggcagcctgattgggctcactgcacgcgccacatgggcttcgaatatccaggtggccataaaccaggtccggaggcttatcggaaatgaaaactacctggactatatgacctccatgaagcgattcaaaaatgagggtgatcctgaaggcgcactatggtga

SEQ ID NO: 13814 - RNA, 9879 nt, synthetic construct
  misc_feature 1..9879: note = derived and/or modified CDS sequence (opt3) from DENV-1__GQ199832__SS-prME
  source 1..9879: mol_type = other RNA
agcgtgaccatgctgctcatgcttatgcccaccgcactggctttccacttgactacgagaggaggggaacctcatatgatcgtcaccaagcaggaaaggggaaaatccttactgtttaagacatctgccggtgttaatatgtgcactctgattgccatggacctcggcgaactgtgtgaagataccatgacatacaaatgcccacggataaccgaagcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcattttcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggatcgttcaaactggagaaggaagtggctgagacccagcacggtacggtccttgtgcagataaagtacgagggcacagacgcgccttgcaaaatcccattctcgacccaagatgaaaagggggttactcagaacggacgcttgattacagcaaatcccatcgtgaccgacaaagagaagcctgtaaacatagaagccgagccaccctttggcgagtcttatattgtcatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtgtttacatccgttgggaaacttgtgcatcagattttcggaacggcgtacggcgtcctgttttctggtgtgagctggaccatgaagatagggatcggcgtattgctcacttggctgggattaaattcacgaagtacatccctgagcatgacctgtattgctgtgggcctagttacactctacctgggggtcatggtgcaggccgattctggatgcgtgatcaactggaaaggccgcgaacttaagtgtggttcagggatcttcgtcactaatgaggttcacacctggacggaacaatataagtttcaggcagacagtccgaaaagattgagcgccgctattggaaaggcctgggaggagggcgtgtgcggtataaggtccgcaacacggctggaaaacatcatgtggaaacagatttctaacgagctcaatcatatcctgttagaaaacggcatgaagttcaccgtggtagtcggggacgtggttggcattctggctcagggcaaaaagatgatccgccctcaacccatggagcacaaatactcgtggaaaagctgggggaaggccaagataatcggagcggatgtgcagaatactacctttattatcgacggcccaaacacacctgaatgtcccgatgaccagagagcctggaatatttgggaggtcgaggattatggtttcgggatctttactaccaacatatggcttaagttgagggactcctacacacaggtgtgcgatcaccgtctcatgtcagctgcaattaaagacagtaaggccgttcatgctgatatgggatattggatcgaatctgagaaaaatgaaacgtggaagctggcccgggcatccttcattgaggtgaagacctgtatctggccaaaatcccacactctatggtcaaacggcgtactggaaagcgagatgataatccccaagatttacggtggccctatctctcaacataattatcgaccagggtacttcacacagaccgcgggaccgtggcacctcggcaaactggagcttgactttgatttgtgcgaagggactacagtcgtggtggacgagcactgcggaaacagaggcccctccctgaggaccacgactgtcaccggtaagattatccatgaatggtgttgccgcagttgtacattacctccactccggttcaaaggggaggatggatgctggtacggcatggagataagacccgttaaggaaaaggaggaaaatctggtgaaaagcatggtatctgccggttccggcgaggtggactcatttagtcttgggctgttgtgtaccagcattatgatcgaagaggtcatgaggtcgcgctggtcccgaaagatgctcatgactggaacactggctgtgttcctactgctcatcatgggccagctgacctggaacgaccttattcggttgtgcatcatggttggggccaatgcatctgatcgtatgggaatgggcacaacttatctggctttaatggccacctttaaaatgagacctatgttcgcagtgggtctcctgtttaggcgccttacgagccgggaggtcctgctactcacaattgggctgtcattggtggccagtgttgaactgccaaactccttagaggaactcggagacggcctggctatgggcataatgatccttaagctgttgaccgatttccaatctcaccagctctgggcgactctgctaagcctgacctttattaaaacaactctttccctccattacgcctggaagaccatggcaatggtgctgtcaatcgtcagcttgttccccctgtgtttaagtacgacatctcagaagaccacttggctcccggtactgcttgggtccctgggatgcaaacctttgacaatgtttctcattgctgagaataagatctggggtagaaaaagctggccactgaacgaaggcataatggccgtgggggttgtgtcgatcctactgtcatctcttctcaagaacgacgtccccctggccggacctttgattgctggcggtatgttaatcgcatgttatgtgattagtgggtccagcgccgatctgtctctcgagaaagcggctgaggtaagctgggaagaggaagccgagcactccggagcatcacataatatcctggtggaagtccaggacgatggcaccatgaagataaaagacgaggagagggatgacactcttacaattctgttgaaggccaccctactggctgttagtggcgtgtaccccctcagcatcccagcaacgctgttcgtgtggtatttttggcaaaagaaaaagcagcgatctggggtcctttgggatactccttcacccccagaagtggagcgcgccgttttagacgatggaatctaccggattatgcagagaggtctgctcggcaggagccaggtaggggtgggagtcttccaagaaaacgtgttccacaccatgtggcacgttacacgtggcgcggtgttgatgtatcagggtaaacgcctggagccgagttgggctagcgtcaagaaagacctcatatcctacgggggaggctggcggctgcagggctcttggaataccggggaggaagtgcaggtaatcgccgtcgagcctggaaagaaccccaagaatgtgcaaacagcaccaggtacttttaaaacccccgaaggcgaggttggggccattgctcttgacttcaagcctggaacgtcgggcagcccaatcgtgaacagagaaggtaaaattgtcgggctgtacggaaatggcgtggttacaacttcaggcacctatgtgtccgccatcgcacaggctaaggccagtcaggaggggcccttgcctgagatagaagatgaggtctttaggaaacgaaacctaacaatcatggacctgcatccgggatctggtaagacccggcgctacctcccagcgattgtgagagaagccatcaagaggaaattacggactctgattcttgcacccacccgagtagtggctagcgagatggccgaagctctgaagggcatgcctatcagatatcaaacaacggcagttaaatccgagcacactgggaaggagatagtcgatctcatgtgccatgccaccttcacaatgcgcttgctgtcaccagtgagggtgcccaattacaacatgattatcatggacgaagcccactttaccgatccttctagcatcgctgcgcgtggatatattagtactcgggtcggcatgggtgaggcagccgctatcttcatgacagccaccccgcccgggtccgtagaagcatttccacagagcaatgccgtgatacaggacgaggaaagagatattcctgagaggtcttggaactcaggatacgagtggatcacggacttccccggcaaaactgtttggtttgtgccatccattaagagtggcaatgatatcgctaactgtctccgcaagaatgggaaacgagtcatacagctgagcagaaagacattcgacaccgaatatcagaaaaccaagaacaacgattgggactacgtggttactacagacatttcggagatgggagcgaattttcgggccgatagggtgatcgaccctcgccgttgccttaaacccgtcatcctaaaggatggtccagaaagagtgattctggcaggcccgatgcctgtaaccgtggcttctgccgcacagcggagggggcgcatcggacgaaaccataataaggagggcgaccagtacatttatatgggtcagcccttgaacaatgatgaggaccacgcccactggacagaagctaaaatgttactggataacataaatactccagaggggatcattcccgccctcttcgaacctgagagagaaaagtccgcggcaatcgacggcgagtaccggctgaggggagaggcccgcaaaacgttcgttgaacttatgagaaggggcgatctgccagtctggctcagctataaggtggcttcagaggggtttcaatacagtgaccggcgttggtgcttcgatggagaacgcaacaatcaggtgttggaggaaaacatggacgtcgagatctggaccaaagagggtgaacgaaagaaactgagacccaggtggctagatgcccggacatattctgaccctctggctctccgcgagtttaaggagttcgcagccggcagaaggtccgttagcggggaccttattctggagataggaaagttaccgcagcatttgactcagcgggctcaaaatgccctggataacctcgtgatgctgcacaattcagaacagggcggtcgagcatacaaacatgcgatggaggagcttccagacaccatcgaaacactgatgctcttggccctgattgctgtattaaccgggggcgtgactctatttttcctgagtggaagaggcctcgggaagacgagcatcggacttctgtgtgtcatggcctcctctgtgttgctgtggatggcaagcgttgagccccactggattgctgcctccatcatactcgaatttttcctgatggtgcttctcatccctgagcccgatcgccagaggaccccacaggacaaccaactggcatatgtcgtaattggtttgctgtttatcattttaacagtggccgctaatgagatgggcctactggaaactaccaaaaaggatctcgggatcggacacgttgcggtggagaaccatcaccatgccacaatgcttgacgtcgatctgcaccctgcatcagcttggaccttgtacgccgtggccactacaataattacgcccatgatgcggcataccatcgaaaacactacagcaaatatttctctgaccgctatcgccaaccaggcggctatactcatgggcctggacaaaggttggccaatcagtaagatggatattggggtccctcttttagccctgggctgctacagccaggtgaatccgctcaccttgacagcagccgttctgatgctagtggctcactatgcaatcattggacccggcctgcaagccaaggcgactcgtgaggctcagaaaagaacggccgcagggatcatgaagaacccaaccgtagacggaatagtggccattgatctcgaccctgtcgtttacgatgctaaattcgaaaagcagcttggccagatcatgctgttgatcctgtgtacaagccaaattctcctgatgaggactacctgggccttatgcgagtccatcacacttgcaaccggtcccctgactacgctctgggaggggtctccaggaaaattttggaatacaaccatagctgtgtcaatggccaacattttccgcggcagctatctagcgggtgccggcctggcattttccttgatgaagagtctagggggaggccggcgagggactggagctcagggcgaaaccctcggtgagaagtggaaaagacagcttaatcagctgtctaagagcgagttcaacatctacaaaaggtcagggattatggaggtcgaccgctccgaagccaaggagggattgaaacggggcgagacaactagacacgcagtgagtcgtggtaccgctaagctgaggtggttcgtagaacggaatctcgtgaagcctgagggcaaagttatcgacttagggtgtggacgcggcgggtggagctattactgcgccggactgaagaaagtgacagaagtcaagggctatacgaaaggtgggcccggacatgaggaaccgataccaatggccacctacggctggaaccttgtgaagctgcactctggcaaagatgtctttttcatccctcccgagaagtgtgacactctactctgcgatattggggagtcctcaccaaatcccacaatcgaagagggacgaaccctgagagtgttgaagatggttgaaccttggctgaggggtaaccaattttgtattaaaatcctcaatccgtacatgcccagcgtagtggagactcttgagcagatgcagcggaagcatggcgggatgctggtccgcaacccattatcgagaaattctacacacgaaatgtattgggtgagttgcggaaccggcaacattgtttccgcggtgaatatgacgagcaggatgctgttgaaccgattcaccatggctcaccggaaacctacatacgagcgtgacgtcgatctcggtgcagggactagacatgtggccgtagaacccgaggtggctaacctggacatcataggacagcgcattgaaaatatcaagcacgagcataaatcaacctggcactatgatgaggacaacccttacaagacatgggcctatcatggctcctacgaagttaagccatctggcagcgcaagttccatggtcaatggggtggtgaaactacttactaagccctgggatgtcatccctatggttacccaaattgccatgacagacaccactccatttggacagcagagggtgttcaaagagaaggtagatacgcggacacccaaagctaagagaggtaccgcgcaaataatggaagtgactgcccgctggctgtggggctttctcagcaggaacaagaaaccgcgaatctgtacccgggaggagttcacaagaaaggtcaggtctaatgcagctattggggccgtgtttgttgacgagaaccagtggaactcagcaaaagaggccgtggaagacgagcgcttctgggatctggtccagaaggaacgtgagttgcacaaacagggaaagtgcgctacgtgcgtgtataacatgatgggcaagcgggagaaaaagctgggtgagtttgggaaagccaagggaagtagagcgatctggtacatgtggctcggcgcaaggttccttgagtttgaagccctgggcttcatgaatgaggaccactggttctcccgcgaaaacagcttatctggggtagagggagagggtctgcataaattgggctacattctccgagatatctcgaagatacctgggggaaatatgtatgctgacgataccgccggctgggacactcggatcacagaagatgacctgcaaaacgaggcaaaaattaccgatatcatggaaccagagcacgctctacttgccacttcaatttttaagctgacataccagaataaggttgtgagagtccagaggcccgctaaaaacggtaccgtgatggacgtgatcagccgcagagatcagcgggggtccggacaagtcggcacatatggcctcaatactttcaccaacatggaagcccagctgataaggcagatggagagtgaggggatatttttgccttctgaattagagacgccaaacctggcagaacgtgttctcgactggcttgagaagtacggagtggaacgactgaaacgcatggcgatcagcggtgatgactgtgtagtgaagcccatcgacgatagattcgccaccgctctaacagccctgaatgacatgggcaaagtccggaaggatattccgcagtgggagccttccaaggggtggaacgactggcaacaggtgcccttttgctcacatcacttccaccagctcataatgaaagatggaagggagatcgttgtgccatgtcgcaatcaggacgaattggtcggcagagcacgggtgagtcaaggtgctgggtggtctctgagggagactgcctgccttggaaagagctatgcacagatgtggcagctgatgtactttcatcgacgtgatctcagattagccgcgaacgctatttgttccgccgtacctgttgactgggtgcccacctcacgcacaacttggagcatccacgcacatcaccaatggatgaccacggaagatatgctgtctgtctggaatcgggtgtggattgaggaaaacccatggatggaggacaaaacacatgtttccagttggggcgatgtgccctatttgggcaagagggaggaccagtggtgcgggagcctgatcggactcaccgccagagctacttgggcctcgaatatacaggtcgcaatcaaccaggtgcgccggcttattggtaatgaaaactacctggactacatgacatccatgaaaaggttcaagaatgagggcgatcctgaaggggctctatggtga

SEQ ID NO: 13815 - RNA, 9879 nt, synthetic construct
  misc_feature 1..9879: note = derived and/or modified CDS sequence (opt3) from DENV-1__FJ882568__SS-prME
  source 1..9879: mol_type = other RNA
agcgtgaccatgctgctcatgcttatgcccacagccctggctttccacttgactacgagaggcggggagcctcatatgatcgtcaccaagcaggaaaggggaaaatccttactgtttaagacatctgcaggtgttaacatgtgcactctaattgccatggacctcggcgagctgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagagcaggacgcaaacttcgtctgccgccgaactgttgtggatagaggctggggtaatgggtgtggattgtttggcaaaggcagcctcataacctgcgctaagttcaagtgcgtaacaaaactggaggggaagattgtgcagtacgaaaacttaaaatattccgtcatcgtgaccgttcacactggagaccagcatcaagtgggtaatgagtcaacggaacacggcacaaccgccactattaccccccaggcgcctacaagtgagatccagctgaccgactacggggccctcactcttgattgtagcccaaggacaggactggactttaacgaaatggtcttgctaacgatgaaggagaaatcttggctggtgcataagcagtggttcctcgatctgccgcttccctggacctccggcgcatcaactagccaagagacatggaatcggcaggacctgttggtaacctttaaaacagctcacgccaagaagcaggaagttgtggtcctcggtagtcaagagggggctatgcacactgccctgaccggcgcaacggaaatccagacctctggaacaactaccattttcgccggccatttaaaatgccgtctgaagatggataaactaacactcaaggggatgtcctatgtgatgtgtactggaagctttaaactggagaaggaagtcgctgagacccagcacggtacggtgcttgttcagataaagtacgagggcacagacgcgccttgcaaaatcccattcttgacccaagatgaaaagggggtgactcagaacggacgcctgattacagcaaatcccatcgtaaccgacaaagagaagcctgtcaacatagaagccgagccacccttcggcgagtcgtatattgtgatcggtgctggggaaaaagccctcaagctgtcttggtttaagaaaggctcctcaatcggaaagatgttcgaggcaactgccagaggcgctaggcggatggccattcttggggataccgcatgggactttggaagtatcggtggcgttttcacaagcgtggggaaactggtccatcagatttttggaacggcgtacggcgtgttgttctccggtgtatcttggaccatgaagatagggatcggcgtgctcctgacttggttaggactgaatagccgatcaacaagtctatccatgacctgtattgctgttggcctcgtcacactgtaccttggggtgatggtgcaggccgatagcggatgcgtcatcaactggaaaggccgcgaattgaagtgtggttctgggatctttgttactaatgaggtgcacacctggacggaacaatataagttccaggcagactcaccgaaaagactgagtgccgctattggaaaggcctgggaggagggcgtgtgcggtataaggagcgcaacacggctcgaaaacatcatgtggaaacagatttccaacgagctgaatcatatcttactggaaaacggcatgaagtttaccgtagtcgtgggggacgttgtgggaattcttgctcagggcaaaaagatgatccgccctcaacccatggagcacaaatactcttggaagtcgtgggggaaggccaaaataatcggagcggatgtccagaatactaccttcattatcgacggcccaaacacacctgaatgtcccgatgaccagagagcctggaatatttgggaggtggaggattatggttttgggatcttcactaccaacatatggttgaagctcagggacagctacacacaggtttgcgatcaccgtctgatgtccgctgcaattaaagactcaaaggccgtgcatgctgatatgggatattggatcgaaagtgagaaaaatgaaacgtggaagctagcccgggcatcttttattgaggtaaagacctgtatctggccaaaaagccacactctgtggtccaacggcgtcctcgaatcagagatgataatccccaagatttacggtggccctatcagccaacataattatcgaccagggtacttcacacagaccgcgggaccgtggcacctgggcaaacttgagttggacttcgatctgtgcgaagggactacagtggtggtcgacgagcactgcggaaacagaggcccctctttaaggaccacgactgttaccggtaagattatccatgaatggtgttgccgctcctgtacactccctccactgcggtttaaaggggaggatggatgctggtacggcatggagataagacccgtgaaggaaaaggaggaaaatcttgtaaaaagtatggtgagcgccggttctggcgaggtcgactccttctcactggggttgctctgtaccagtattatgatcgaagaggtgatgaggagccgctggtcgcgaaagatgctgatgactggaacactagctgtttttctgctcctgatcatgggccagcttacctggaacgacttgattcggctgtgcatcatggtgggggccaatgcatccgatcgtatgggaatgggcacaacttatttagctctcatggccaccttcaaaatgagacctatgtttgcagtcggtctgcttttcaggcgcctgacgtctcgggaggtgctactcctgacaattgggttgagcctggttgcctcagtggaattaccaaacagtctcgaggaactgggagacggccttgctatgggcataatgatcctgaagttgctcaccgattttcaatcccaccagctgtgggcgactctactgtctcttaccttcattaaaacaactctcagcctgcattacgcctggaagaccatggcaatggtcttgtccatcgtatcactgtttcccttatgtctcagcacgacaagtcagaagaccacttggctgccggtgcttctggggtctttgggatgcaaacctctcacaatgttcctgattgctgagaataagatctggggtagaaaatcctggccactaaacgaaggcataatggccgttggggtggtcagcatcctgctttcgtcactcctgaagaacgacgtgcccttggccggacctttaattgctggcggtatgctgatcgcatgttatgtaatttctgggagttccgccgatctcagcctggagaaagcggctgaggtgtcttgggaagaggaagccgagcacagcggagcatcccataatatccttgtcgaagttcaggacgatggcaccatgaagataaaagacgaggagagggatgacactctgacaattttgctaaaggccaccctgctcgctgtgtcaggcgtgtaccccctgagtatcccagcaacgctttttgtctggtatttctggcaaaagaaaaagcagcgaagcggggtgttatgggatactccttctcccccagaagttgagcgcgccgtactggacgatggaatctaccggattatgcagagaggtctcttgggcaggtcccaggtgggggtcggagtgtttcaagaaaacgttttccacaccatgtggcacgtgacacgtggcgcggtcctgatgtatcagggtaaacgcctcgagccgtcatgggctagtgtgaagaaagacctgataagctacgggggaggctggcggcttcagggctcctggaataccggggaggaagtacaggtcatcgccgtggagcctggaaagaaccccaagaatgttcaaacagcaccaggtactttcaaaacccccgaaggcgaggtgggggccattgctctggactttaagcctggaacgtctggctcgccaatcgtcaacagagaaggtaaaattgtggggttgtacggaaatggcgttgtgacaactagcggcacctatgtctcagccatcgcacaggctaaggcctcccaggaggggcccctacctgagatagaagatgaggtgttcaggaaacgaaacctgacaatcatggacctccatccgggaagtggtaagacccggcgctacttaccagcgattgtaagagaagccatcaagaggaaactgcggactcttattctggcacccacccgagtggttgcttctgagatggccgaagctctcaagggcatgcctatcagatatcaaacaacggcagtcaaaagcgagcacactgggaaggagatagtggatttgatgtgccatgccacctttacaatgcgcctgctctccccagtgagggtccccaattacaacatgattatcatggacgaagcccacttcaccgatccttcatctatcgctgcgcgtggatatattagcactcgggtaggcatgggtgaggcagccgctatctttatgacagccaccccgcccgggagtgtggaagcattcccacagtccaatgccgttatacaggacgaggaaagagatattcctgagaggagctggaactctggatacgagtggatcacggactttcccggcaaaactgtgtggttcgtcccatcaattaagtccggcaatgatatcgctaactgtctgcgcaagaatgggaaacgagtgatacagcttagtagaaagacatttgacaccgaatatcaaaaaaccaagaacaacgattgggactacgttgtgactacagacattagcgagatgggagcgaatttccgggccgatagggtcatcgaccctcgccgttgcctaaaacccgtgatcctgaaggatggtccagaaagagtaattttggcaggcccgatgcctgtgaccgttgcttcggccgcacagcggagggggcgcatcggacgaaaccataataaggagggcgaccagtacatttatatgggtcagcccttaaacaatgatgaggaccacgcccactggacagaagctaaaatgctgctcgataacataaatactccagaggggatcattcccgccctgtttgaacctgagagagaaaagtctgcggcaatcgacggcgagtaccggcttaggggagaggcccgcaaaacgttcgtcgaactgatgagaaggggcgatctcccagtgtggttgtcctataaggtggctagcgaggggttccaatactcagaccggcgttggtgctttgatggagaacgcaacaatcaggtcctggaggaaaacatggacgttgagatctggaccaaagagggtgaacgaaagaaactaagacccaggtggctggatgcccggacatatagtgaccctctcgctcttcgcgagttcaaggaatttgcagccggcagaaggtctgtgtccggggacctgattttagagataggaaagttgccgcagcatctgactcagcgggctcaaaatgccctcgataacctggtaatgcttcacaatagcgaacagggcggtcgagcatacagacatgcgatggaggagctgccagacaccatcgaaacactcatgttgctggccttaattgctgtgctaaccgggggcgtcactctgttctttctctcaggacgcggccttgggaaaacgagtatcggactgttgtgtgtgatggccagctccgttctgctctggatggcatctgtggagccccactggattgctgccagcatcatactggaattctttcttatggtcctcctgatccctgagcccgataggcagcggaccccacaggacaaccaattggcatatgtagtgattggtctgttattcatcattctaacagttgccgctaatgagatgggcctgctcgaaactaccaagaaagatcttgggatcggacacgtggcggtcgagaaccatcaccatgccacaatgctggacgtggatttgcaccctgcatccgcttggaccctgtacgccgtcgccactacaataattacgcccatgatgcgtcataccatcgaaaacactacagcaaatatttcactcaccgctatcgccaaccaggcggctatactgatgggccttgacaagggttggccaatctctaaaatggatattggggtgcctttactggccctcggctgctacagtcaggttaatccgttgaccctgacagcagccgtgctaatgctggtagctcactatgcaatcattggacccggcctccaagccaaggcgactagagaggctcagaagaggacggccgcagggatcatgaaaaacccaaccgtggacggaatagtcgccattgatcttgaccctgttgtgtacgatgctaagtttgaaaaacagctgggccagatcatgttgctgatcctctgtacatcgcaaattctgttaatgcgcactacctgggccctttgcgagagcatcacactggcaaccggtcccctcactacgctatgggaggggtccccaggaaagttctggaatacaaccatagctgtctctatggccaacatttttcggggctcatatctggcgggtgccggcttggcattcagcctgatgaaatccctcgggggaggccgaagagggactggagctcagggcgaaacccttggtgagaagtggaagaggcagctgaatcagttgagtaaatctgaatttaacatctacaagcgcagcgggattatggaggtggaccggtcagaagccaaagagggactgaagagaggcgagacaactcgtcacgcagtatccaggggtaccgctaaactccggtggttcgtggaacgcaatttagttaagcctgagggcaaggtgatcgacctggggtgtggacgaggcgggtggagttattactgcgccggacttaaaaaggtcacagaagtgaaaggctatacgaagggtgggcccggacatgaggaaccgataccaatggccacctacggctggaacctggtcaaactacacagcggcaaggatgtgttctttactcctcccgagaaatgtgacacactcctgtgcgatatcggggagtcttccccaaatcccaccattgaagagggaagaactttgagggttctgaagatggtagaaccttggctccggggtaaccaattctgtatcaagattcttaatccgtacatgccctcagtggtcgagacactggagcagatgcagcgcaaacatggcgggatgttagtgagaaacccactgagcaggaattcgacccacgaaatgtattgggtttcttgcggaacgggcaacatcgtgagtgcggtcaatatgacctcccgaatgttgctcaaccggtttacaatggctcaccgtaagcctacttacgagagagacgtggatctgggtgcagggacccgccatgtagccgtggaacccgaggttgctaacctagacattatcggacagaggatagaaaatattaaacacgagcataagagcacatggcactatgatgaggacaacccttacaaaacttgggcctatcatggctcatacgaagtcaagccatccggctctgcaagcagtatggtgaatggggtggtcaagcttctgaccaaaccctgggatgttatccctatggtgacacaaatcgccatgaccgacactacgccattcggacagcagcgggtatttaaggagaaagtggatacaagaacccccaaggctaaacgcggtactgcgcaaattatggaagtcaccgccaggtggctctggggcttcctgtcccgaaacaagaagccgcggatatgtacaagagaggaatttacgaggaaagtgcgcagcaatgcagctatcggggccgttttcgtggacgagaaccagtggaattctgcaaaggaggccgtcgaagacgagcgtttttgggatttggtgcagaaagaacgggagctgcacaagcagggaaaatgcgctacctgcgtatataacatgatgggcaagagagaaaagaaactcggtgagttcgggaaggccaaaggatcaagggcgatttggtacatgtggcttggcgcacgctttctggagttcgaagccttaggctttatgaatgaggaccactggttcagtcgagaaaactccctgagcggggttgagggagagggtttgcataagctcggctacatcctgcgggatatttctaaaatccctgggggaaatatgtatgctgacgatactgccggctgggacacaagaataaccgaagatgacctacaaaacgaggcaaagatcactgatattatggaaccagagcacgctcttctggccacatcgatcttcaaactcacctaccagaataaggtggtcagggtgcagcgccccgctaagaacggtacagtgatggacgtcatttcaagacgggatcagagggggagcggacaagttggcacttatggcctgaatacctttacgaacatggaagcccagttgatccgtcagatggagtccgaggggatattcttacctagtgaactggagaccccaaacctcgcagaacgagtgcttgactggctggagaaatacggagtagaacgcctaaagagaatggcgatttctggtgatgactgtgtggtcaaacccatcgacgatcggtttgccacagctctgactgccctcaatgacatgggcaaggtgaggaaagatatcccgcagtgggagcctagcaaggggtggaacgactggcaacaggttcccttctgctcccatcactttcaccagttgattatgaaggatggacgcgagatagtggtcccatgtagaaatcaggacgaactggtgggccgggcaagggtatcacaaggtgctgggtggagtcttcgagagaccgcctgcctgggaaaatcttatgcacagatgtggcagctcatgtacttccatcgtagagatttacgcctggccgcgaacgctatctgtagcgccgttcctgtggactgggtccccacatcccggactacctggtcaattcacgcacatcaccaatggatgacgacagaagatatgttgagcgtgtggaatagggtttggatcgaggaaaacccatggatggaggacaagacccatgtgtcttcctggggcgatgtcccctatctgggcaaaagagaggaccagtggtgcgggagtctcattggacttactgcccgcgctacatgggccagcaatatccaggtggcaataaaccaggtacggaggctgatcggtaatgaaaactacctagactacatgacctcgatgaagcgatttaaaaatgagggcgatcctgaaggggctctgtggtga

SEQ ID NO: 13816 - RNA, 9879 nt, synthetic construct
  misc_feature 1..9879: note = derived and/or modified CDS sequence (opt3) from DENV-1__FJ882569__SS-prME
  source 1..9879: mol_type = other RNA
agcgtgaccatgctgctcatgcttatgcccaccgcactggctttccacttgactacgagaggaggggaacctcatatgatcgtcaccaagcaggaaagaggaaaatccttactgtttaagacatctgccggtgttaacatgtgcactctgattgccatggacctcggagaactgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaggacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggatcgttcaaactggagaaggaagtggctgagacccagcacggtacggtccttgtgcagataaagtacgagggcacagacgcgccttgcaaaatcccattctcgacccaagatgaaaagggggttactcagaacggacgcttgattacagcaaatcccatcgtgaccgacaaagagaagcctgtaaacatagaagccgagccaccctttggcgagtcttatattgtcatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtgtttacatccgttgggaaacttgtgcatcagattttcggaacggcgtacggcgtcctgttttctggtgtgagctggaccatgaagatagggatcggcgtattgctcacttggctgggattaaattcacgaagtacatccctgagcatgacctgtattgctgtgggcctagttacactctacctgggggtcatggtgcaggccgattctggatgcgtgatcaactggaaaggccgcgaacttaagtgtggttcagggatcttcgtcactaatgaggttcacacctggacggaacaatataagtttcaggcagacagtccgaaaagattgagcgccgctattggaaaggcctgggaggagggcgtgtgcggtataaggtccgcaacacggctggaaaacatcatgtggaaacagatttctaacgagctcaatcatatcctgttagaaaacggcatgaagttcaccgtggtagtcggggacgtggttggcattctggctcagggcaaaaagatgatccgccctcaacccatggagcacaaatactcgtggaaaagctgggggaaggccaagataatcggagcggatgtgcagaatactacctttattatcgacggcccaaacacacctgaatgtcccgatgaccagagagcctggaatatttgggaggtcgaggattatggtttcgggatctttactaccaacatatggcttaagttgagggactcctacacacaggtgtgcgatcaccgtctcatgtcagctgcaattaaagacagtaaggccgttcatgctgatatgggatattggatcgaatctgagaaaaatgaaacgtggaagctggcccgggcatccttcattgaggtgaagacctgtatctggccaaaatcccacactctatggtcaaacggcgtactggaaagcgagatgataatccccaagatttacggtggccctatctctcaacataattatcgaccagggtacttcacacagaccgcgggaccgtggcacctcggcaaactggagcttgactttgatttgtgcgaagggactacagtcgtggtggacgagcactgcggaaacagaggcccctccctgaggaccacgactgtcaccggtaagattatccatgaatggtgttgccgcagttgtacattacctccactccggttcaaaggggaggatggatgctggtacggcatggagataagacccgttaaggaaaaggaggaaaatctggtgaaaagcatggtatctgccggttccggcgaggtggactcatttagtcttgggctgttgtgtaccagcattatgatcgaagaggtcatgaggtcgcgctggtcccgaaagatgctcatgactggaacactggctgtgttcctactgctcatcatgggccagctgacctggaacgaccttattcggttgtgcatcatggttggggccaatgcatctgatcgtatgggaatgggcacaacttatctggctttaatggccacctttaaaatgagacctatgttcgcagtgggtctcctgtttaggcgccttacgagccgggaggtcctgctactcacaattgggctgtcattggtggccagtgttgaactgccaaactccttagaggaactcggagacggcctggctatgggcataatgatccttaagctgttgaccgatttccaatctcaccagctctgggcgactctgctaagcctgacctttattaaaacaactctttccctccattacgcctggaagaccatggcaatggtgctgtcaatcgtcagcttgttccccctgtgtttaagtacgacatctcagaagaccacttggctcccggtactgcttgggtccctgggatgcaaacctttgacaatgtttctcattgctgagaataagatctggggtagaaggagctggccactgaacgaaggcataatggccgtgggggttgtgtcgatcctactgtcatctcttctcaaaaacgacgtccccctggccggacctttgattgctggcggtatgttaatcgcatgttatgtgattagtgggtccagcgccgatctgtctctcgagaaggcggctgaggtaagctgggaagaggaagccgagcactccggagcatcacataatatcctggtggaagtccaggacgatggcaccatgaaaataaaggacgaggagcgagatgacactcttacaattctgttgaaagccaccctactggctgttagtggcgtgtaccccctcagcatcccagcaacgctgttcgtgtggtatttttggcaaaagaagaaacagcgctctggggtcctttgggatactccttcacccccagaagtggagcgggccgttttagacgatggaatctacagaattatgcagaggggtctgctcggccgtagccaggtaggggtgggagtcttccaagaaaacgtgttccacaccatgtggcacgttacacgcggcgcggtgttgatgtatcagggtaagcggctggagccgagttgggctagcgtcaaaaaggacctcatatcctacgggggaggctggagactgcagggctcttggaataccggggaggaagtgcaggtaatcgccgtcgagcctggcaaaaatcccaagaatgtgcaaacagcaccaggtacttttaagacccccgaaggcgaggttggggccattgctcttgacttcaaacctggaacgtcgggcagcccaatcgtgaacagggaaggtaagattgtcgggctgtacggaaatggcgtggttacaacttcaggcacctatgtgtccgccatcgcacaggctaaagccagtcaggaggggcccttgcctgagatagaagatgaggtctttcgaaagcggaacctaacaatcatggacctgcatccgggatctggtaaaacccgcagatacctcccagcgattgtgagggaagccatcaagcggaagttacgaactctgattcttgcacccaccagagtagtggctagcgagatggccgaagctctgaaaggcatgcctatccgctatcaaacaacggcagttaagtccgagcacactgggaaagagatagtcgatctcatgtgccatgccaccttcacaatgaggttgctgtcaccagtgcgtgtgcccaattacaacatgattatcatggacgaagcccactttaccgatccttctagcatcgctgcgcggggatatattagtactagagtcggcatgggtgaggcagccgctatcttcatgacagccaccccgcccgggtccgtagaagcatttccacagagcaatgccgtgatacaggacgaggaaagggatattcctgagcgctcttggaactcaggatacgagtggatcacggacttccccggcaagactgtttggtttgtgccatccattaaaagtggcaatgatatcgctaactgtctccgaaagaatgggaagagagtcatacagctgagccggaaaacattcgacaccgaatatcaaaagaccaaaaacaacgattgggactacgtggttactacagacatttcggagatgggagcgaattttagggccgatcgcgtgatcgaccctcgtagatgccttaagcccgtcatcctaaaagatggtccagaacgggtgattctggcaggcccgatgcctgtaaccgtggcttctgccgcacagaggcgcgggcgaatcggaagaaaccataataaggagggcgaccagtacatttatatgggtcagcccttgaacaatgatgaggaccacgcccactggacagaagctaagatgttactggataacataaatactccagaggggatcattcccgccctcttcgaacctgagcgggaaaaatccgcggcaatcgacggcgagtacaggctgcgcggagaggccagaaagacgttcgttgaacttatgaggcggggcgatctgccagtctggctcagctataaagtggcttcagaggggtttcaatacagtgaccgtcgctggtgcttcgatggagaacgaaacaatcaggtgttggaggaaaacatggacgtcgagatctggaccaaggagggtgaaaggaaaaagctgaggccccggtggctagatgcccgcacatattctgaccctctggctctcagagagtttaaagagttcgcagccggcaggcggtccgttagcggggaccttattctggagataggaaagttaccgcagcatttgactcagcgagctcaaaatgccctggataacctcgtgatgctgcacaattcagaacagggcggtagagcataccgccatgcgatggaggagcttccagacaccatcgaaacactgatgctcttggccctgattgctgtattaaccgggggcgtgactctatttttcctgagtggaaggggcctcgggaagacgagcatcggacttctgtgtgtcatggcctcctctgtgttgctgtggatggcaagcgttgagccccactggattgctgcctccatcatactcgaatttttcctgatggtgcttctcatccctgagcccgatcggcagcgtaccccacaggacaaccaactggcatatgtcgtaattggtttgctgtttatgatcttaacagtggccgctaatgagatgggcctactggaaactaccaaaaaggatctcgggattggacacgttgcggtggagaaccatcaccatgccacaatgcttgacgtcgatctgcaccctgcatcagcttggaccttgtacgccgtggccactacaatcataacgcccatgatgagacataccattgaaaacactacagcaaatatctctctgaccgctattgccaaccaggcggctatcctcatgggcctggacaaaggttggccaataagtaagatggatatcggggtccctcttttagccctgggctgctacagccaggtgaatccgctcaccttgacagcagccgttctgatgctagtggctcactatgcaattatcggacccggcctgcaagccaaagcgactagggaggctcagaagcgcacggccgcagggattatgaagaacccaaccgtagacggaatcgtggccatagatctcgaccctgtcgtttacgatgctaaattcgaaaagcagcttggccagattatgctgttgatcctgtgtacaagccaaatcctcctgatgcggactacctgggccttatgcgagtccattacacttgcaaccggtcccctgactacgctctgggaggggtctccaggaaaattttggaatacaaccatcgctgtgtcaatggccaacatattccgaggcagctatctagcgggtgccggcctggcattttccttgatgaagagtctagggggaggcagaagggggactggagctcagggcgaaaccctcggtgagaaatggaagcgccagcttaatcagctgtctaagagcgagttcaacatttacaaacggtcagggatcatggaggtcgacagatccgaagccaaggagggattgaaacgtggcgagacaactaggcacgcagtgagtcggggtaccgctaagctgcgctggttcgtagaacgaaatctcgtgaaacctgagggcaaggttattgacttagggtgtggaagaggcgggtggagctattactgcgccggactgaagaaagtgacagaagtcaagggctatacgaaaggtgggcccggacatgaggaaccgatcccaatggccacctacggctggaaccttgtgaagctgcactctggcaaagatgtctttttcactcctcccgagaagtgtgacacactactctgcgatataggggagtcctcaccaaatcccaccatcgaagagggaaggactctgcgggtgttgaaaatggttgaaccttggctgcgcggtaaccaattttgtattaagatcctcaatccgtacatgcccagcgtagtggagacacttgagcagatgcagagaaagcatggcgggatgctggtcaggaacccattatcgcgaaattctacccacgaaatgtattgggtgagttgcggaacgggcaacattgtttccgcggtgaatatgaccagccggatgctgttgaaccgtttcacaatggctcacagaaaacctacttacgagcgcgacgtcgatctcggtgcagggaccaggcatgtggccgtagaacccgaggtggctaacctggacatcattggacagcggatcgaaaatataaagcacgagcataaatcaacatggcactatgatgaggacaacccttacaagacttgggcctatcatggctcctacgaagttaaaccatctggcagcgcaagttccatggtcaatggggtggtgaagctacttaccaagccctgggatgtcattcctatggttacacaaatcgccatgaccgacactacgccatttggacagcagagagtgttcaaagagaaggtagatacacgcacccccaaagctaagaggggtactgcgcaaatcatggaagtgaccgcccgatggctgtggggctttctcagccggaacaaaaagccgagaatttgtacaagggaggagttcacgcgcaaggtccgttctaatgcagctataggggccgtgtttgttgacgagaaccagtggaactcagcaaaagaggccgtggaagacgagcggttctgggatctggtccagaaggaaagagagttgcacaaacagggaaagtgcgctacctgcgtgtataacatgatgggcaaaagggaaaagaagctgggtgagtttgggaaagccaagggaagtcgcgcgatctggtacatgtggctcggcgcacgattccttgagtttgaagccctgggcttcatgaatgaggaccactggttctcccgggaaaacagcttatctggggtagagggagagggtctgcataaattgggctacattctcagagatatctcgaagattcctgggggaaatatgtatgctgacgatactgccggctgggacacaaggatcaccgaagatgacctgcaaaacgaggcaaaaataactgatatcatggaaccagagcacgctctacttgccacatcaatttttaagctgacctaccagaataaagttgtgcgcgtccagagacccgctaagaacggtacagtgatggacgtgatcagccggagggatcagcgtgggtccggacaagtcggcacttatggcctcaataccttcacgaacatggaagcccagctgattcgacagatggagagtgaggggatctttttgccttctgaattagagaccccaaacctggcagaacgcgttctcgactggcttgagaagtacggagtggaaagactgaaacggatggcgataagcggtgatgactgtgtagtgaagcccattgacgataggttcgccacagctctaactgccctgaatgacatgggcaaagtccgcaaggatatcccgcagtgggagccttccaaagggtggaacgactggcaacaggtgcccttttgctcacatcacttccaccagctcatcatgaaggatggaagagagattgttgtgccatgtcggaatcaggacgaattggtcggcagggcacgagtgagtcaaggtgctgggtggtctctgcgtgagaccgcctgccttggaaagagctatgcacagatgtggcagctgatgtactttcatagacgcgatctccggttagccgcgaacgctatatgttccgccgtacctgttgactgggtgcccacatcaaggactacctggagcatccacgcacatcaccaatggatgacgacagaagatatgctgtctgtctggaatagagtgtggattgaggaaaacccatggatggaggacaaaacccatgtttccagttggggcgatgtgccctatttgggcaagcgcgaggaccagtggtgcgggagcctgatcggactcactgcccgggctacatgggcctcgaatattcaggtcgcaatcaaccaggtgaggcgacttataggtaatgaaaactacctggactacatgacctccatgaaaagattcaagaatgagggcgatcctgaaggggctctatggtga

SEQ ID NO: 13817 - RNA, 9879 nt, synthetic construct
  misc_feature 1..9879: note = derived and/or modified CDS sequence (opt3) from DENV-1__GQ199833__SS-prME
  source 1..9879: mol_type = other RNA
agcgtgaccatgctgctcatgcttatgcccaccgcactggctttccacttgactacgcggggcggggagcctcatatgatcgtcaccaagcaggaaaggggaaagtccttactgtttaagacatctgccggtgttaatatgtgcactctaattgccatggacctcggcgagctgtgtgaagataccatgacatacaaatgcccacggataaccgaggcggaaccggacgatgtggactgttggtgcaatgctactgatacatgggtaacctatgggacgtgttcacaaactggagagcaccgccgagaccgtaggagtgtggcccttgcaccccatgtcggcctgggtttggagaccaggacagaaacttggatgagctccgagggggcctggaagcagatccagcgggtggaaacctgggctctccgccaccctggattcacagttattgcactgtttctggcccatgctatcggcacctctattacgcagaaaggcatcatattcatcctcttaatgctggtgactccatcgatggccatgagatgcgtcgggattggatcaagggattttgtggagggtcttagcggcgcgacatgggtagacgttgtgttggagcacgggagttgtgtcaccactatggcaaaggataagcccacactggacatcgaactactcaaaaccgaggtgacgaaccctgccgtgctgcggaaactttgcattgaagctaaaatctccaataccacaactgattctcgctgtccaacccaaggagaggccacactgatggaggaacaggacgcaaacttcgtctgccgaagaacttttgttgataggggctggggtaatgggtgtggattgttcggcaagggcagcctcataacctgcgctaaatttaagtgcgtgacaaagctggaggggaaaattgtacagtacgaaaacttaaagtattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccacggacaggactggacttcaacgaaatggtgttgctaacgatgaaaggcaagtcttggctggtccataaacagtggtttctcgatctgccgcttccctggacctccggtgcatcaactagccaagagacatggaatcgtcaggacctgttggtgaccttcaagacagctcacgccaaaaagcaggaggtagttgtgctcgggagtcaagaaggcgctatgcacactgccctgaccggagcaacggagatccagacctctggcacaactaccatttttgccgggcatttaaagtgccgcctgaaaatggataagctaacactcaaaggaatgtcctatgtcatgtgtactggtagcttcaagctggaaaaagaggtggctgaaacccagcacggcacggtccttgtgcagataaagtacgaggggacagacgcgccttgcaagatcccattctcgacccaagatgagaaaggagttactcagaacggcagattgattacagcaaatcccatcgtgaccgacaaggaaaaacctgtaaacatagaggccgaaccaccctttggtgagtcttatattgtcatcggggctggcgagaaggccctgaaactctcctggttcaagaagggatcaagtatcggcaaaatgtttgaagcaactgccagaggggctcggcgaatggccattctgggagataccgcatgggacttcggtagcatcggcggggtgtttacatccgttggaaaacttgtgcatcagattttcggcacggcgtacggtgtcctgttttctggggtgagctggaccatgaaaataggcatcggagtattgctcacttggctgggcttaaattcacgcagtacatccctgagcatgacctgtattgctgtggggctagttacactctacctgggagtcatggtgcaggccgattctggctgcgtgatcaactggaagggtagagagcttaaatgtgggtcaggaatcttcgtcactaatgaagttcacacctggacggagcaatataagtttcaggcagacagtccgaagaggttgagcgccgctattggcaaagcctgggaagagggtgtgtgcggcatacggtccgcaacacgcctggagaacatcatgtggaagcagatttctaacgaactcaatcatatcctgttagagaacgggatgaaattcaccgtggtagtcggagacgtggttggcattctggctcaggggaagaaaatgatcagacctcaacccatggaacacaagtactcgtggaaaagctggggaaaggccaagataatcggcgcggatgtgcagaatactacctttattatcgacggtccaaacacacctgagtgtcccgatgaccagagggcctggaatatttgggaagtcgaggattatgggttcggaatctttactaccaacatatggcttaaattgcgtgactcctacacacaggtgtgcgatcaccggctcatgtcagctgcaattaaggacagtaaagccgttcatgctgatatgggctattggatcgagtctgaaaagaatgagacgtggaaactggcccgagcatcgttcattgaagtgaagacctgtatctggccaaagtcccacactctatggtcaaacggtgtactggagagcgaaatgataatccccaaaatttacggcgggcctatctctcaacataattatagaccaggatacttcacacagaccgcgggcccgtggcacctcgggaagctggagcttgactttgatttgtgcgagggaactacagtcgtggtggacgaacactgcggcaacaggggtccctccctgcgcaccacgactgtcaccgggaaaattatccatgagtggtgttgccggagttgtacattacctccactcagattcaagggagaagatggctgctggtacggtatggagataaggcccgttaaagagaaggaagagaatctggtgaagtccatggtatctgccggctccggggaagtggactcatttagtcttggactgttgtgtattagcatcatgatcgaggaagtcatgcgctcgcgatggtcccggaaaatgctcatgaccggcactctggctgtgttcctactgctcattatggggcagctgacatggaacgaccttatccgtttgtgcattatggttggagccaatgcatctgatagaatgggcatgggtaccacatatctggctttaatggccacttttaagatgaggcctatgttcgcagtggggctcctgtttcgccggcttaccagcagagaggtcctgctactcacgataggactgtcattggtggccagtgttgagctgccaaactccttagaggaactcggcgacggcctggctatggggatcatgattcttaaactgttgacagatttccaatctcaccagctctgggcgaccctgctaagcctgacttttatcaagaccacactttccctccattacgcctggaaaactatggcaatggtgctgtcaattgtcagcttgttccccctgtgtttaagtaccacgtctcagaagacaacctggctcccggtactgcttggatccctgggttgcaagcctttgactatgtttctcatcgctgaaaataaaatatggggcagaaagagctggccactgaacgaggggatcatggccgtgggagttgtgtcgattctactgtcatctcttctcaaaaacgacgtccccctggccggccctttgatcgctggtgggatgttaattgcatgttatgtgatcagtggatccagcgccgatctgtctctcgaaaaggcggctgaggtaagctgggaggaagaggccgaacactccggcgcatcacataatatactggtggaggtccaggacgatggcacaatgaaaattaaggacgaggaacgagatgacacccttactatcctgttgaaagccacactactggctgttagtggggtgtaccccctcagcatcccagcaaccctgttcgtgtggtatttttggcaaaagaagaaacagcgctctggagtcctttgggatacgccttcacccccagaggtggaacgggccgttttagacgatggtatttacagaataatgcagaggggcctgctcgggcgtagccaggtaggagtgggcgtcttccaagagaacgtgttccacactatgtggcacgttacccgcggtgcggtgttgatgtatcaggggaagcggctggaaccgagttgggctagcgtcaaaaaggacctcatctcctacggaggcggctggagactgcaggggtcttggaatacaggagaggaggtgcaggtaattgccgtcgaacctggtaaaaaccccaagaatgtgcaaaccgcaccaggcacatttaagactcccgagggggaagttggagccatcgctcttgacttcaaacctggcacctcgggtagcccaattgtgaacagggaggggaagatcgtcggactgtacggcaatggcgtggttacgacatcagggacttatgtgtccgccatagcacaggctaaagccagtcaggaaggacccttgcctgagatcgaggatgaagtctttcgaaagcggaacctaaccattatggacctgcatccgggttctggcaaaacacgcagatacctcccagcgatcgtgagggaggccattaagcggaagttacgaaccctgatccttgcacccactagagtagtggctagcgaaatggccgaggctctgaaagggatgcctatacgctatcaaaccacagcagttaagtccgaacacacgggaaaagagattgtcgatctcatgtgccatgccactttcaccatgaggttgctgtcaccagtgcgtgtgcccaattacaacatgatcatcatggacgaggcccactttacagatccttctagcattgctgcgcggggctatatcagtaccagagtcggtatgggggaagcagccgctatattcatgactgccacaccgcccggatccgtagaggcatttccacagagcaatgccgtgattcaggacgaagagagggatatccctgaacgctcttggaactcaggctacgagtggattaccgacttccccggcaagacggtttggtttgtgccatccatcaaaagtgggaatgatatagctaactgtctccgaaagaatggaaagagagtcattcagctgagccggaaaactttcgacacagagtatcaaaagaccaaaaacaacgattgggactacgtggttaccactgacatctcggaaatgggtgcgaattttagggccgatcgcgtgatcgaccctcgtagatgccttaagcccgtcattctaaaagatggcccagagcgggtgatcctggcagggccgatgcctgtaacagtggcttctgccgcacagaggcgcggacgaattggcagaaaccataataaggaaggtgaccagtacatatatatggggcagcccttgaacaatgatgaggaccacgcccactggaccgaggctaagatgttactggataacatcaatacaccagaaggcattatccccgccctcttcgagcctgaacgggagaaatccgcggcaatcgacggagaatacaggctgcgcggcgaggccagaaagactttcgttgagcttatgaggagaggggatctgccagtctggctcagctataaagtggcttcagaaggatttcaatacagtgaccgtcgctggtgcttcgatggtgagcgaaacaatcaggtgttggaagagaacatggacgtcgaaatttggacgaaggagggcgagaggaagaagctgaggccccggtggctagatgcccgcacctattctgaccctctggctctcagagaatttaaagagttcgcagccgggaggcggtccgttagcggagaccttatactggaaatcggcaagttaccgcagcatttgacacagcgagctcaaaatgccctggataacctcgtgatgctgcacaattcagagcagggtgggagagcataccgccatgcgatggaggaacttccagacactattgagaccctgatgctcttggccctgatcgctgtattaacaggcggagtgaccctatttttcctgagtggcagggggctcggaaagactagcattggtcttctgtgtgtcatggcctcctctgtgttgctgtggatggcaagcgttgaaccccactggatcgctgcctccataatcctcgagtttttcctgatggtgcttctcattcctgaacccgatcggcagcgtacgccacaggacaaccaactggcatatgtcgtaatcggcttgctgtttatgattttaaccgtggccgctaatgagatggggctactggagacaactaaaaaggatctcggaatcggccacgttgcggtggaaaaccatcaccatgccaccatgcttgacgtcgatctgcaccctgcatcagcttggacattgtacgccgtggccaccactataattacacccatgatgagacatacgatcgagaacaccactgcaaatatttctctgacagctatcgccaaccaggcggctatactcatgggtctggacaaagggtggccaatcagtaagatggatattggcgtccctcttttagccctgggatgctacagccaggtgaatccgctcaccttgaccgcagccgttctgatgctagtggctcactatgcaatcattggccccgggctgcaagccaaagcgacaagggaagctcagaagcgcactgccgcaggaatcatgaagaacccaacggtagacggcatagtggccattgatctcgaccctgtcgtttacgatgctaaattcgagaagcagcttggtcagatcatgctgttgatcctgtgtaccagccaaattctcctgatgcggacaacttgggccttatgcgaatccatcacccttgcaacagggcccctgaccactctctgggagggatctccaggcaaattttggaatacgacaatagctgtgtcaatggccaacattttccgaggtagctatctagcgggcgccgggctggcattttccttgatgaagagtctgggaggcgggagaaggggaaccggcgctcagggtgagactctcggggaaaaatggaagcgccagcttaatcagctgtctaagagcgagttcaacatctacaaacggtcaggaattatggaagtcgacagatccgaggccaaggaaggcttgaaacgtggtgagaccacaaggcacgcagtgagtcggggcactgctaagctgcgctggttcgtagagcgaaatctcgtgaaacctgaagggaaggttatcgacttaggatgtggcagagggggatggagctattactgcgccggcctgaagaaagtgaccgaggtcaagggttatacaaaagggggacccggccatgaggaaccgataccaatggccacgtacggctggaaccttgtgaagctgcactctgggaaagatgtctttttcacccctcccgaaaagtgtgacactctactctgcgatatcggagagtcctcaccaaatcccacaattgaggaaggtaggaccctgcgggtgttgaaaatggttgagccttggctgcgcggcaaccaattttgtatcaagattctcaatccgtacatgcccagcgtagtggaaactcttgagcagatgcagagaaagcatgggggaatgctggtcaggaacccattatcgcgaaattctacacacgagatgtattgggtgagttgcggcaccggtaacatcgtttccgcggtgaatatgacgagccggatgctgttgaaccgtttcaccatggctcacagaaaacctacatacgaacgcgacgtcgatctcggggcaggaactaggcatgtggccgtagagcccgaagtggctaacctggacattatcggccagcggatagagaatattaagcacgaacataaatcaacctggcactatgatgaggacaacccttacaagacatgggcctatcatggctcctacgaggttaaaccatctgggagcgcaagttccatggtcaatggagtggtgaagctacttactaagccctgggatgtcatccctatggttacccaaatcgccatgacagacaccactccatttggtcagcagagagtgttcaaagaaaaggtagatacgcgcacacccaaagctaagaggggcaccgcgcaaattatggaggtgactgcccgatggctgtgggggtttctcagccggaacaaaaagccgagaatatgtaccagggaagagttcacacgcaaggtccgttctaatgcagctatcggagccgtgtttgttgacgaaaaccagtggaactcagcaaaagaggccgtggaggacgaacggttctgggatctggtccagaaggagagagaattgcacaaacagggcaagtgcgctacgtgcgtgtataacatgatgggtaaaagggagaagaagctgggggaatttggaaaagccaagggcagtcgcgcgatttggtacatgtggctcggcgcacgattccttgagtttgaggccctggggttcatgaatgaagaccactggttctcccgggagaacagcttatctggagtagaaggtgagggcctgcataaattggggtacatcctcagagatatttcgaagatccctggaggcaatatgtatgctgacgataccgccggttgggacactaggataacagaggatgacctgcaaaacgaagcaaaaatcaccgatattatggagccagaacacgctctacttgccacttcaatctttaagctgacataccagaataaagttgtgcgcgtccagagacccgctaagaacgggaccgtgatggacgtgattagccggagggatcagcgtggatccggccaagtcggcacatatgggctcaatactttcaccaacatggaggcccagctgatccgacagatggaaagtgagggaatatttttgccttctgagttagaaacgccaaacctggcagagcgcgttctcgactggcttgaaaagtacggtgtggagagactgaaacggatggcgattagcggcgatgactgtgtagtgaagcccatcgacgataggttcgccaccgctctaacagccctgaatgacatggggaaagtccgcaaggatatcccgcagtgggaaccttccaaaggatggaacgactggcaacaggtgcccttttgctcacatcacttccaccagctcattatgaaggatggcagagagatagttgtgccatgtcggaatcaggacgagttggtcggtagggcacgagtgagtcaaggggctggatggtctctgcgtgaaactgcctgccttggcaagagctatgcacagatgtggcagctgatgtactttcatagacgcgatctccggttagccgcgaacgctatctgttccgccgtacctgttgactgggtgcccacctcaaggacaacttggagcattcacgcacatcaccaatggatgaccacggaggatatgctgtctgtctggaatagagtgtggatcgaagagaacccatggatggaagacaaaacacatgtttccagttggggcgatgtgccctatttggggaagcgcgaggaccagtggtgcggaagcctgattggtctcaccgcccgggctacttgggcctcgaatatccaggtcgcaataaaccaggtgaggcgacttatcggcaatgagaactacctggactacatgacatccatgaaaagattcaagaatgaaggggatcctgagggagctctatggtga

SEQ ID NO: 13818 - RNA, 9879 nt, synthetic construct
  misc_feature 1..9879: note = derived and/or modified CDS sequence (opt3) from DENV-1__FJ882570__SS-prME
  source 1..9879: mol_type = other RNA
agcgtgaccatgctgctcatgcttatgcccaccgccctggctttccacttgactacgaggggaggggagcctcatatgatcgtcaccaagcaggaaaggggaaaatccttactgtttaagacatctgccggtgttaatatgtgcactttaattgccatggacctcggcgagctgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagggattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggtagcttcaaactggagaaggaagtggctgagacccagcacggaacggtccttgtgcagataaagtacgagggcacagacgcgccttgcaaaatcccattctcgacccaagatgggaagggagttactcagaacggccgcttgattacagcaaatcccatcgtgaccgacaaagaaaagcctgtaaacatagaggccgaaccaccctttggtgagtcttatattgtcatcggggctggcgagaaagccctgaagctctcctggttcaagaaaggatcaagtatcggcaagatgtttgaagcaactgccagaggggctaggcggatggccattctgggagataccgcatgggacttcggtagcatcggcggggtgtttacatccgttggaaaacttgtgcatcagattttcggcacggcgtacggtgtcctgttttctggggtgagctggaccatgaagataggcatcggagtattgctcacttggctgggcttaaattcacgaagtacatccctgagcatgacctgtattgctgtggggctagttacactctacctgggagtcatggtgcaggccgattctggctgcgtgatcaactggaaaggtcgcgagcttaagtgtgggtcaggaatcttcgtcactaatgaagttcacacctggacggagcaatataagtttcaggcagacagtccgaaaagattgagcgccgctattggcaaggcctgggaagagggtgtgtgcggcataaggtccgcaacacggctggagaacatcatgtggaaacagatttctaacgaactcaatcatatcctgttagagaacgggatgaagttcaccgtggtagtcggagacgtggttggcattctggctcaggggaaaaagatgatccgccctcaacccatggaacacaaatactcgtggaaaagctggggaaaggccaaaataatcggcgcggatgtgcagaatactacctttattatcgacggtccaaacacacctgagtgtcccgatgaccagagagcctggaatatttgggaagtcgaggattatgggttcggaatctttactaccaacatatggcttaagttgagggactcctacacacaggtgtgcgatcaccgtctcatgtcagctgcaattaaagacagtaaggccgttcatgctgatatgggctattggatcgagtctgagaagaatgagacgtggaagctggcccgggcatccttcattgaagtgaagacctgtatctggccaaaatcccacactctatggtcaaacggtgtactggagagcgaaatgataatccccaagatttacggcgggcctatctctcaacataattatcgaccaggatacttcacacagaccgcgggcccgtggcacctcgggaaactggagcttgactttgatttgtgcgagggaactacagtcgtggtggacgaacactgcggcaacagaggtccctccctgaggaccacgactgtcaccgggaagattatccatgagtggtgttgccgcagttgtacattacctccactccggttcaaaggagaagatggctgctggtacggtatggagataagacccgttaaggagaaggaagagaatctggtgaaaagcatggtatctgccggctccggggaagtggactcatttagtcttggactgttgtgtaccagcattatgatcgaggaagtcatgaggtcgcgctggtcccgaaagatgctcatgactggcacactggctgtgttcctactgctcatcatggggcagctgacctggaacgaccttattcggttgtgcatcatggttggagccaatgcatctgatcgtatgggcatgggtacaacttatctggctttaatggccacctttaaaatgagacctatgttcgcagtggggctcctgtttaggcgccttacgagccgggaggtcctgctactcacaattggactgtcattggtggccagtgttgagctgccaaactccttagaagaactcggcgacggcctggctatggggataatgatccttaagctgttgaccgatttccaatctcaccagctctgggcgactctgctaagcctgacctttattaaaacaactctttccctccattacgcctggaagaccatggcaatggtgctgtcaatcgtcagcttgttccccctgtgtttaagtacgacatctcagaagaccacttggctcccggtactgcttggatccctgggttgcaaacctttgacaatgtttctcattgctgaaaataagatctggggcagaaaaagctggccactgaacgaggggataatggccgtgggagttgtgtcgatcctactgtcatctcttctcaagaacgacgtccccctggccggccctttgattgctggtgggatgttaatcgcatgttatgtgattagtggatccagcgccgatctgtctctcgaaaaagcggctgaggtaagctgggaggaagaggccgaacactccggcgcatcacataatatcttcgtggaggtccaggacgatggcaccatgaagataaaagacgaagagagggatgacactctgacaattcttctgaaggccaccttgctagctgttagtggggtgtaccccctgagcatcccagcaacgctctttgtgtggtatttctggcaaaagaaaaagcagcgatctggagtcctgtgggatactccttcacccccagaggtggaacgcgccgcgcttgacgatggtatctaccggattatgcagagaggcttactggggaggagccaggttggagtaggcgtgttccaagagaacgtctttcacaccatgtggcacgtgacacgtggtgctgttctcatgtatcaggggaaacgcttggaaccgagttgggccagcgtgaagaaagacctgatatcctacggaggcggctggcggctccaggggtcttggaataccggagaggaggtccaggtgatcgcagtagaacctggtaagaaccccaagaatgtccaaacagccccaggcactttcaaaacccccgagggggaagtgggagctattgccctggactttaagcctggcacgtcgggtagcccaatcgttaacagagaggggaaaattgtgggactttacggcaatggcgtcgtgacaacttcagggacctatgtttccgcaatcgctcaggccaaggcgagtcaggaaggacccctgcctgagatagaggatgaagtgttcaggaaacgaaacttgacaatcatggacctacatccgggttctggcaagacccggcgctacctgccagccattgtcagagaggcaatcaagaggaaactccggactttaattctggctcccacccgagtggtagccagcgaaatggctgaggcacttaaggggatgcctatcagatatcaaacaacggccgtgaaatccgaacacactggaaaggagatagttgatctgatgtgccatgccacctttacaatgcgcctcttgtcaccagtcagggtgcccaattacaacatgattatcatggacgaggctcacttcaccgatccttctagcatcgcggcacgtggctatattagtactcgggtgggtatgggggaagccgctgccatctttatgacagcaaccccgcccggatccgtcgaggccttcccacagagcaatgctgtaatacaggacgaagagagagatattcctgaaaggtcttggaactcaggctacgagtggatcacggactttcccggcaaaactgtgtggttcgttccatccattaagagtgggaatgatatcgcgaactgtctgcgcaagaatggaaaacgagtgatacagctcagcagaaagacatttgacaccgagtatcagaaaaccaagaacaacgattgggactacgtcgtgactacagacatttcggaaatgggtgccaatttccgggcagatagggttatcgaccctcgccgttgcctgaaacccgtgatccttaaggatggcccagagagagtcattctagctgggccgatgcctgtgaccgtagcctctgcagcccagcggaggggacgcatcggccgaaaccataataaggaaggtgaccagtacatttatatggggcagcccctgaacaatgatgaggaccacgctcactggacagaggccaaaatgttgttagataacataaatactccagaaggcatcattcccgcgctgttcgagcctgaaagagagaagtccgcagccatcgacggagaataccggctcaggggcgaggctcgcaaaacgtttgtggagctgatgagaagaggggatcttccagtttggctgagctataaggtcgcctcagaaggattccaatacagtgaccggcgttggtgctttgatggtgagcgcaacaatcaggtgctcgaagagaacatggacgtggaaatctggaccaaagagggcgagcgaaagaaattgagacccaggtggctggatgctcggacatattctgaccctctagcactgcgcgagttcaaggagtttgccgctgggagaaggtccgtcagcggagacctcattcttgaaataggcaagctgccgcagcatttaactcagcgggcccaaaatgcattggataacctggttatgctccacaattcagagcagggtgggcgagcgtacagacatgccatggaagaactgccagacaccatcgagacacttatgctgctcgctttgattgccgtgctgaccggcggagtaactttattctttctaagtggccgcgggctgggaaaaacgagcatcggtctcctttgtgtgatggcatcctctgtcctgttgtggatggctagcgtggaaccccactggattgccgcatccatcatactggagttctttctcatggttctgcttatccctgaacccgataggcagcggaccccacaggacaaccaactcgcctatgtggtcattggcctgttgttcatcattctgacagtagctgcgaatgagatggggttactagagactaccaagaaagatctgggaatcggccacgtggccgttgaaaaccatcaccatgcaacaatgctcgacgtggatcttcaccctgcttcagcctggaccctgtacgccgtcgcaactacaataattacgcccatgatgcgtcataccatcgagaacactacagctaatatttctttgaccgccatcgcgaaccaggctgccatactgatgggtctcgacaaggggtggccaatcagtaaaatggatattggcgtgcctctgcttgcattaggatgctactcgcaggtcaatccgctgaccctcacagccgctgtgttgatgctggttgcacactatgccatcattggccccgggctacaagcgaaggctactagagaagcccagaagaggacggcagccggaatcatgaaaaacccaaccgtggacggcatagtagctattgatctggaccctgtggtctacgatgccaagtttgagaaacagctcggtcagatcatgcttctgatcttgtgtacaagccaaattctgctcatgcgcactacctgggcactgtgcgaatccatcacattagctaccgggccccttactacgctgtgggagggatctccaggcaagttctggaatacaaccatagccgtttcaatggcgaacatttttcggggtagctatctcgccggcgcagggctagctttctccctgatgaaaagtttgggaggcgggcgaagaggaactggcgcccagggtgagaccctgggggaaaagtggaagaggcagctcaatcagctttctaaaagcgagttcaacatctacaagcgctcaggaattatggaagtggaccggtccgaggcaaaagaaggcctgaagagaggtgagacaactcgtcacgctgtcagtaggggcaccgccaaattgcggtggtttgtggagcgcaatctggtaaagcctgaagggaaggtgatcgacctcggatgtggccgagggggatggagctattactgcgccggcctaaagaaggttacagaggtgaaaggttatacgaaagggggacccggccatgaggaaccgataccaatggcgacctacggctggaacctggtcaaacttcactctgggaaggatgtgttctttactcctcccgaaaaatgtgacacactgctatgcgatatcggagagtcctcaccaaatcccaccattgaggaaggtagaactctcagggtcctgaagatggtggagccttggttgcggggcaaccaattctgtatcaagattctgaatccgtacatgcccagcgttgtagaaacactcgagcagatgcagcgcaaacatgggggaatgcttgtgagaaacccactgtcgagaaattctacccacgagatgtattgggtcagttgcggcacgggtaacatcgtgtccgctgttaatatgaccagccgaatgttactgaaccggtttacaatggcacaccgtaagcctacttacgaaagagacgtggatttgggggccggaacccgccatgtcgctgtggagcccgaagtagccaacctcgacattatcggccagaggatagagaatattaaacacgaacataagtcaacatggcactatgatgaggacaacccttacaaaacttgggcatatcatggctcctacgaggtgaagccatctgggagcgccagttccatggttaatggagtcgtgaagctgctaaccaaaccctgggatgtgatccctatggtcacacaaatcgctatgaccgacactacgccattcggtcagcagcgggtttttaaggaaaaagtggatacaagaacccccaaggcgaaacgcggcactgcccaaattatggaggtaaccgcaaggtggctttgggggttcctgagccgaaacaagaagccgcggatatgtacaagagaagagtttacgaggaaagtgcgctctaatgctgccatcggagcagtcttcgtggacgaaaaccagtggaactcagccaaggaggctgttgaggacgaacgtttttgggatctcgtgcagaaagagcgggaactgcacaagcagggcaaatgcgcaacctgcgtctataacatgatgggtaagagagagaagaaattgggggagttcggaaaggcgaaaggcagtagggcaatttggtacatgtggctgggcgcccgctttctcgagttcgaggctcttgggttcatgaatgaagaccactggttttcccgagagaacagcctgtctggagtggaaggtgagggcttacataagctggggtacatcttgcgggatatttcgaaaatccctggaggcaatatgtatgccgacgatactgcaggttgggacacaagaataaccgaggatgacctccaaaacgaagctaagatcactgatattatggagccagaacacgccctgctagctacatcaatcttcaaacttacctaccagaataaggtagttagggtgcagcgccccgccaagaacgggacagtcatggacgtgattagcagacgggatcagaggggatccggccaagtgggcacttatgggctgaatacctttacgaacatggaggcacagctcatccgtcagatggaaagtgagggaatattcctgccttctgagttggaaaccccaaacttagcggagcgagtcctggactggctcgaaaaatacggtgttgagcgccttaagagaatggccattagcggcgatgactgtgtggtaaaacccatcgacgatcggtttgctacagccctgactgcactaaatgacatggggaaggtgaggaaagatatcccgcagtgggaaccttccaagggatggaacgactggcaacaggtccccttctgctcacatcactttcaccagctgattatgaaggatggccgcgagatagtggttccatgtagaaatcaggacgagctcgtgggtcgggctagggtcagtcaaggggccggatggtctttgcgagaaaccgcatgcctgggcaaaagctatgcccagatgtggcagcttatgtacttccatcgtagagatctgcgcctcgcggctaacgccatctgttccgcagtgcctgtagactgggttcccacatcacggactacctggagcattcacgcccatcaccaatggatgacgacagaggatatgttatctgtgtggaatagggtctggatcgaagagaacccatggatggaagacaagacccatgtgtccagttggggcgatgttccctatctggggaaaagagaggaccagtggtgcggcagcttgattggtctgactgctcgcgccacatgggcatcgaatatccaggtggctataaaccaggtccggaggctcatcggcaatgagaactaccttgactacatgacctccatgaagcgatttaaaaatgaaggggatcctgagggagccctgtggtga

SEQ ID NO: 13819 - RNA, 9879 nt, synthetic construct
  misc_feature 1..9879: note = derived and/or modified CDS sequence (opt3) from DENV-1__GQ199834__SS-prME
  source 1..9879: mol_type = other RNA
agcgtgaccatgctgctcatgcttatgcccaccgccctggctttccacttgactacgaggggaggggaacctcatatgatcgtcaccaagcaggaaaggggaaaatccttactgtttaagacatctgctggtgttaatatgtgcactctgattgccatggacctcggcgaactgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggatcgttcaaactggagaaggaacttgctgagacccagcacggtacggtgttggtccagataaagtacgagggcacagacgcgccttgcaaaatcccattctcgacccaagatgaaaagggggtgactcagaacggacgcctgattacagcaaatcccatcgttaccgacaaagagaagcctgtgaacatagaagccgagccaccctttggcgagtcttatattgtaatcggtgctggggaaaaagccctcaagctgtcctggttcaagaaaggctcaagtatcggaaagatgtttgaggcaactgccagaggcgctaggcggatggccattcttggggataccgcatgggacttcggaagcatcggtggcgtctttacatccgtggggaaactggttcatcagattttcggaacggcgtacggcgtgttgttttctggtgtcagctggaccatgaagatagggatcggcgtgctcctgacttggttaggactaaattcacgaagtacatccctaagcatgacctgtattgctgtaggcctcgtgacactgtaccttggggttatggtccaggccgattctggatgcgtgatcaactggaaaggccgcgaattgaagtgtggttcagggatcttcgtgactaatgaggtccacacctggacggaacaatataagtttcaggcagacagtccgaaaagactgagcgccgctattggaaaggcctgggaggagggcgtttgcggtataaggtccgcaacacggctcgaaaacatcatgtggaaacagatttctaacgagctgaatcatatcttactggaaaacggcatgaagttcaccgtggtggtaggggacgtcgatggcattcttgctcagggcaaaaagatgatccgccctcaacccatggagcacaaatactcgtggaaaagctgggggaaggccaagataatcggagcggacgtgcagaatactacctttattatcgatggcccaaacacacctgaatgtcccgacgatcagagagcctggaatatttgggaggttgaggactatggtttcgggatctttactaccaacatatggttgaagctcagggattcctacacacaggtgtgcgaccaccgtctgatgtcagctgcaattaaagatagtaaggccgtccatgctgacatgggatattggatcgaatctgagaaaaatgaaacgtggaagctagcccgggcttccttcattgaggtgaagacctgtatctggccaaaatcccacactctgtggtcaaacggcgttctcgaaagcgagatgataatccccaagatttacggtggccctatctctcaacataattatcgaccagggtacttcacacagaccgcgggaccgtggcacctgggcaaacttgagttggattttgacctgtgcgaagggactacagtggtagtcgatgagcactgcggaaacagaggcccctccttaaggaccacgactgtgaccggtaagattatccatgaatggtgttgccgcagttgtacactccctccactgcggttcaaaggggaggacggatgctggtacggcatggagataagacccgtgaaggaaaaggaggaaaatcttgtcaaaagcatggtttctgccggttccggcgaggtggactcatttagtctggggttgctctgtattagcatcatgatcgaagaggtaatgaggtcgcgctggtcccgaaagatgctgatgaccggaactctagctgtgttcctgctcctgattatgggccagcttacatggaacgatttgatccggctgtgcattatggtcggggccaatgcatctgaccgtatgggaatgggcaccacatatttagctctcatggccacttttaaaatgagacctatgttcgcagtgggtctgctttttaggcgcctgaccagccgggaggttctactcctgacgatagggttgtcactggtggccagtgtcgaattaccaaactccctcgaggaactgggagatggccttgctatgggcatcatgattctgaagttgctcacagacttccaatctcaccagctgtgggcgaccctactgagccttacttttatcaaaaccacactctccctgcattacgcctggaagactatggcaatggtgttgtcaattgttagcctgttccccttatgtctcagtaccacgtctcagaagacaacctggctgccggtgcttctggggtccttgggatgcaaacctctcactatgtttctgatcgctgagaataagatatggggtagaaaaagctggccactaaacgaaggcatcatggccgtcggggtagtgtcgattctgctttcatctctcctgaagaacgatgttcccttggccggacctttaatcgctggcggtatgctgattgcatgttatgtgatcagtgggtccagcgccgacctctctctggagaaagcggctgaggtcagctgggaagaggaagccgagcactccggagcatcacataatatacttgtggaagtacaggatgacggcacaatgaagattaaagatgaggagagggacgataccctgactatcttgctaaaggccacactgctcgctgtgagtggcgtctaccccctgagcatcccagcaacccttttcgtttggtatttttggcaaaagaaaaagcagcgatctggggtgttatgggacacgccttcacccccagaagtggagcgcgccgtcctggatgacggaatttaccggataatgcagagaggtctcttgggcaggagccaggtgggggttggagtattccaagaaaacgtgttccacactatgtggcacgtcacccgtggcgcggtgctgatgtatcagggtaaacgcctcgagccgagttgggctagcgttaagaaagacctgatctcctacgggggaggctggcggcttcagggctcttggaatacaggggaggaagtgcaggtcattgccgtggagcctggaaagaaccccaagaatgtacaaaccgcaccaggtacatttaaaactcccgaaggcgaggtcggggccatcgctctggatttcaagcctggaacctcgggcagcccaattgtgaacagagaaggtaaaatcgttgggttgtacggaaatggcgtggtcacgacatcaggcacttatgtgtccgccatagcacaggctaaggccagtcaggaggggcccctacctgagatcgaagacgaggtttttaggaaacgaaacctgaccattatggatctccatccgggatctggtaagacacggcgctacttaccagcgatcgtgagagaagccattaagaggaaactgcggacccttatcctggcacccactcgagtcgtggctagcgagatggccgaagctctcaagggcatgcctataagatatcaaaccacagcagtaaaatccgagcacacggggaaggagattgtggacttgatgtgccatgccactttcaccatgcgcctgctctcaccagttagggtccccaattacaacatgatcatcatggatgaagcccactttacagacccttctagcattgctgcgcgtggatatatcagtacccgggtgggcatgggtgaggcagccgctatattcatgactgccacaccgcccgggtccgtggaagcatttccacagagcaatgccgtcattcaggatgaggaaagagacatccctgagaggtcttggaactcaggatacgagtggattaccgatttccccggcaaaacggtatggtttgtgccatccatcaagagtggcaatgacatagctaactgtctgcgcaagaatgggaaacgagttattcagcttagcagaaagactttcgatacagaatatcagaagaccaagaacaacgactgggactacgtggtcaccactgatatctcggagatgggagcgaattttcgggccgacagggtgatcgatcctcgccgttgcctaaaacccgttattctgaaggacggtccagaaagagtgatcttggcaggcccgatgcctgtcacagtggcttctgccgcacagcggagggggcgcattggacgaaaccataataaggagggcgatcagtacatatatatgggtcagcccttaaacaatgacgaggatcacgcccactggaccgaagctaaaatgctgctcgacaacatcaatacaccagaggggattatccccgccctgttcgaacctgagagagaaaagtccgcggcaatcgatggcgagtaccggcttaggggagaggcccgcaaaactttcgtagaactgatgagaaggggcgacctcccagtgtggttgagctataaggttgcttcagaggggtttcaatacagtgatcggcgttggtgcttcgacggagaacgcaacaatcaggtcctggaggaaaacatggatgtggagatttggacgaaagagggtgaacgaaagaaactaagacccaggtggctggacgcccggacctattctgaccctctcgcacttcgcgagtttaaggagttcgcagccggcagaaggtccgtgagcggggatctgatattagagatcggaaagttgccgcagcatctgacacagcgggctcaaaatgccctcgacaacctggtcatgcttcacaattcagaacagggcggtcgagcatacagacatgcgatggaggagctgccagatactattgaaaccctcatgttgctggccttaatcgctgttctaacagggggcgtgaccctgtttttcctcagtggacgcggccttgggaaaactagcattggactgttgtgtgtaatggcctcctctgtgctgctctggatggcaagcgtcgagccccactggatcgctgcctccataatcctggaatttttccttatggtgctcctgattcctgagcccgacaggcagcggacgccacaggataaccaattggcatatgttgtgatcggtctgttatttatgattctaaccgtcgccgctaatgagatgggcctgctcgaaacaactaagaaagaccttgggatcggacacgtagcggtggagaaccatcaccatgccaccatgctggatgttgacttgcaccctgcatcagcttggacactgtacgccgtggccaccactataattacacccatgatgcgtcatacgatcgaaaacaccactgcaaatatttctctcacagctatcgccaaccaggcggctatactgatgggccttgataagggttggccaatcagtaaaatggacattggggtccctttactggccctcggctgctacagccaggtgaatccgttgaccctgaccgcagccgtcctaatgctggtggctcactatgcaatcattggacccggcctccaagccaaggcgacaagagaggctcagaagaggactgccgcagggatcatgaaaaacccaacggttgatggaatagtggccattgaccttgatcctgtagtgtacgacgctaagttcgaaaaacagctgggccagatcatgttgctgatcctctgtaccagccaaattctgttaatgcgcacaacttgggccctttgcgagtccatcaccctggcaacaggtcccctcaccactctatgggaggggtctccaggaaagttttggaatacgacaatagctgtctcaatggccaacattttccggggcagctatctggcgggtgccggcttggcattttccctgatgaaaagtctcgggggaggccgaagagggaccggagctcagggcgaaactcttggtgagaagtggaagaggcagctgaatcagttgtctaaaagcgagttcaacatctacaagcgctcagggattatggaggttgaccggtccgaagccaaagagggactgaagagaggcgagaccacacgtcacgcagtgagtaggggtactgctaaactccggtggttcgtcgaacgcaatttagtgaagcctgagggcaaggtaatcgatctggggtgtggacgaggcgggtggagctattactgcgccggacttaaaaaggtgaccgaagttaaaggctatacaaagggtgggcccggacatgaggaaccgataccaatggccacgtacggctggaacctggtgaaactacactctggcaaggacgtctttttcacccctcccgagaaatgtgatactctcctgtgcgacatcggggagtcctcaccaaatcccacaattgaagagggaagaaccttgagggtgctgaagatggtcgaaccttggctccggggtaaccaattttgtatcaagattcttaatccgtacatgcccagcgtggttgagactctggagcagatgcagcgcaaacatggcgggatgttagtaagaaacccactgtcgagaaattctacacacgaaatgtattgggtgagttgcggaaccggcaacatcgtctccgcggtgaatatgacgagccgaatgttgctcaaccggttcaccatggctcaccgtaagcctacatacgagagagatgttgacctgggtgcagggactcgccatgtggccgtcgaacccgaggtggctaacctagatattatcggacagaggatagaaaatattaaacacgagcataagtcaacctggcactatgacgaggataacccttacaaaacatgggcctatcatggctcctacgaagtaaagccatctggcagcgcaagttccatggtgaatggggttgtcaaacttctgactaaaccctgggacgtgatccctatggtgacccaaatcgccatgacagataccactccatttggacagcagcgggtcttcaaggagaaagttgacacgagaacacccaaggctaaacgcggtaccgcgcaaattatggaagtgactgccaggtggctctggggctttctgagccgaaacaagaagccgcggatatgtaccagagaggagttcacaaggaaagtacgctctaatgcagctatcggggccgtgtttgtcgacgagaaccagtggaactcagcaaaggaggccgtggaagatgagcgtttctgggacttggttcagaaagaacgggagctgcacaagcagggaaaatgcgctacgtgcgtgtataacatgatgggcaagagagaaaagaaactcggtgagtttgggaaggccaaaggaagtagggcgatttggtacatgtggcttggcgcacgcttcctggagtttgaagccttaggcttcatgaatgaggatcactggttctcccgagaaaacagcctgtctggggtcgagggagagggtttgcataagctcggctacatcctgcgggacatttcgaaaatccctgggggaaatatgtatgctgatgacaccgccggctgggatactagaataacagaagacgatctacaaaacgaggcaaagatcaccgacattatggaaccagagcacgcacttctggccacttcaatctttaaactcacataccagaataaggtggtaagggttcagcgccccgctaagaacggtaccgtgatggatgtcattagcagacgggaccagagggggtccggacaagtgggcacatatggcctgaatactttcaccaacatggaagcccagttgatccgtcagatggagagtgaggggatatttttaccttctgaactggagacgccaaacctcgcagaacgagtgcttgattggctggagaaatacggagtcgaacgcctaaagagaatggcgattagcggtgacgactgtgttgtgaaacccatcgatgaccggttcgccaccgctctgacagccctcaatgatatgggcaaggtaaggaaagacatcccgcagtgggagccttccaaggggtggaacgattggcaacaggtgcccttttgctcacatcacttccaccagttgattatgaaggacggacgcgagatagtcgtgccatgtagaaatcaggatgaactggttggccgggcaagggtgagtcaaggtgctgggtggtctcttcgagagactgcctgcctgggaaaaagctatgcacagatgtggcagctcatgtactttcatcgtagagacttacgcctggccgcgaacgctatctgttccgccgtccctgtggattgggtacccacctcacggacaacttggagcattcacgcacatcaccaatggatgaccacggaagacatgttgtctgtttggaatagggtgtggatcgaggaaaacccatggatggaggataagacacatgtctccagttggggcgacgtgccctatctgggcaaaagagaggaccagtggtgcgggagcctcattggacttaccgcccgcgctacttgggcctcgaatatccaggttgcaataaaccaggtgcggaggctgatcggtaatgaaaactacctagattacatgacatccatgaagcgattcaaaaatgagggcgaccctgaaggggctctgtggtga

SEQ ID NO: 13820 - RNA, 9879 nt, synthetic construct
  misc_feature 1..9879: note = derived and/or modified CDS sequence (opt3) from DENV-1__GQ199835__SS-prME
  source 1..9879: mol_type = other RNA
agcgtgaccatgctgctcatgcttatgcccaccgccctggctttccacttgactacgaggggaggggagcctcatatgatcgtcaccaagcaggaaaggggaaaatccttactgtttaagacatctgccggtgttaatatgtgcactctaattgccatggacctcggcgagctgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggatcgttcaaactggagaaggaagtggctgagacccagcacggtacggtccttgtgcagataaagtacgagggcacagacgcgccttgcaaaatcccattctcgacccaagatgaaaagggggttactcagaacggacgcttgattacagcaaatcccatcgtgaccgacaaagagaagcctgtaaacatagaagccgagccaccctttggcgagtcttatattgtcatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtgtttacatccgttgggaaacttgtgcatcagattttcggaacggcgtacggcgtcctgttttctggtgtgagctggaccatgaagatagggatcggcgtattgctcacttggctgggattaaattcacgaagtacatccctgagcatgacctgtattgctgtgggcctagttacactctacctgggggtcatggtgcaggccgattctggatgcgtgatcaactggaaaggccgcgaacttaagtgtggttcagggatcttcgtcactaatgaggttcacacctggacggaacaatataagtttcaggcagacagtccgaaaagattgagcgccgctattggaaaggcctgggaggagggcgtgtgcggtataaggtccgcaacacggctggaaaacatcatgtggaaacagatttctaacgagctcaatcatatcctgttagaaaacgacatgaagttcaccgtggtagtcggcgatgtggttgggattctggctcagggcaagaagatgatccgccctcaacccatggagcacaaatactcgtggaaaagctggggcaaggccaagataatcggggcggacgtgcagaatactacctttattatcgatggaccaaacacacctgaatgtcccgacgatcagagagcctggaatatttgggaggtcgaggactatggcttcggtatctttactaccaacatatggcttaagttgagggattcctacacacaggtgtgcgaccaccgtctcatgtcagctgcaattaaagatagtaaggccgttcatgctgacatggggtattggatcgaatctgagaaaaatgaaacgtggaagctggcccgggcatccttcattgaggtgaagacctgtatctggccaaaatcccacactctatggtcaaacggagtactggaaagcgagatgataatccccaagatttacggcggtcctatctctcaacataattatcgaccaggctacttcacacagaccgcggggccgtggcacctcggaaaactggagcttgattttgacttgtgcgaaggcactacagtcgtggtggatgagcactgcgggaacagaggaccctccctgaggaccacgactgtcaccggcaagattatccatgaatggtgttgccgcagttgtacattacctccactccggttcaaaggtgaggacgggtgctggtacggaatggagataagacccgttaaggaaaaggaggaaaatctggtgaaaagcatggtatctgccggctccggtgaggtggactcatttagtcttggcctgttgtgtattagcatcatgatcgaagaggtcatgaggtcgcgctggtcccgaaagatgctcatgaccgggactctggctgtgttcctactgctcattatgggacagctgacatggaacgatcttatccggttgtgcattatggttggcgccaatgcatctgaccgtatggggatgggaaccacatatctgactttaatggctacctttaaaatgagacctatgttcgccgtgggcctcctgcttaggcgcctgacgagccgggaggtcctactcctgacaataggtttgtcactggtggcaagtgttgaattaccaaactccctcgaggaactgggggatggacttgccatgggcatcatgattctgaagttgctcaccgactttcaatctcaccagctgtgggctactctactgagccttaccttcatcaaaacaactctctccctgcattacgcgtggaagaccatggccatggtgttgtcaattgtcagcctgtttcccttatgtctcagtacgacatctcagaagaccacttggctgccggtacttctgggctccttggggtgcaaacctctcacaatgttcctgatcgcagagaataagatatggggaagaaaaagctggccactaaacgaaggtatcatggctgtgggcgttgtgtcgattctgctttcatctctcctgaagaacgatgtccccttggccgggcctttaatcgccggaggcatgctgattgcttgttatgtgatcagtggttccagcgcagacctctctctggagaaagccgcggaggtaagctgggaagaggaagctgagcactccggggcctcacataatatacttgtggaagtccaggatgacggaaccatgaagattaaagatgaggagagggacgatactctgacaatcttgctaaaggcaaccctgctcgccgttagtggcgtgtaccccctgagcatcccagctacgctttttgtgtggtatttctggcaaaagaaaaagcagcgatctggcgtcttatgggacactccttcacccccagaagtggagcgcgcagttctggatgacgggatttaccggataatgcagagaggactcttgggtaggagccaggtaggcgtgggggtctttcaagaaaacgtgttccacaccatgtggcacgttacacgtggagccgtgctgatgtatcagggcaaacgcctcgagccgagttgggcgagcgtcaagaaagacctgatctcctacggtgggggatggcggcttcagggctcttggaataccggcgaggaagtgcaggtaattgctgtcgagcctgggaagaaccccaagaatgtgcaaacagccccaggaactttcaaaacccccgaaggtgaggttggcgcaatcgccctggattttaagcctgggacgtcgggaagcccaattgtgaacagagaaggcaaaatcgtcggtttgtacgggaatggagtggttacaacttcaggcacctatgtgtccgctatagcccaggcaaaggctagtcaggagggccccctacctgagatcgaagacgaggtcttcaggaaacgaaacctgacaattatggatctccatccggggtctggaaagacccggcgctacttaccagccatcgtgagagaagcgattaagaggaaactgcggactcttatcctggcccccacccgagtagtggcaagcgagatggctgaagccctcaagggtatgcctataagatatcaaacaacggctgttaaatccgagcacactggcaaggagattgtcgacttgatgtgccatgcaacctttacaatgcgcctgctctcaccagtgagggtgcccaattacaacatgatcatcatggatgaagcccacttcaccgacccttctagcattgccgctcgtgggtatatcagtactcgggtcggaatgggcgaggcggcagccatatttatgacagctaccccgcccggttccgtagaagccttcccacagagcaatgcagtgattcaggatgaggaaagagacatccctgagaggtcttggaactcagggtacgagtggattacggattttcccggaaaaactgtttggttcgtgccatccatcaagagtggcaatgacatagccaactgtctgcgcaagaatggcaaacgagtcattcagcttagcagaaagacatttgataccgaatatcagaaaaccaagaacaacgactgggactacgtggttactacagatatctcggagatgggggctaatttccgggcggacagggtgatcgatcctcgccgttgcctaaaacccgtcattctgaaggacggaccagaaagagtgatcttggccggtccgatgcctgtaaccgtggcatctgctgcccagcggaggggccgcattgggcgaaaccataataaggagggagatcagtacatatatatgggccagcccttaaacaatgacgaggatcacgcacactggacagaagccaaaatgctgctcgacaacatcaatactccagagggtattatccccgctctgtttgaacctgagagagaaaagtccgccgcgatcgatggggagtaccggcttaggggcgaggcacgcaaaacgttcgttgaactgatgagaaggggagacctcccagtctggttgagctataaggtggcctcagagggcttccaatacagtgatcggcgttggtgctttgacggggaacgcaacaatcaggtgctggaggaaaacatggatgtcgagatttggaccaaagagggagaacgaaagaaactaagacccaggtggctggacgctcggacatattctgaccctctcgcccttcgcgagttcaaggaatttgctgcaggtagaaggtccgttagcggcgatctgatattagagatcgggaagttgccgcagcatctgactcagcgggcccaaaatgctctcgacaacctggtgatgcttcacaattcagaacagggaggccgagcctacagacatgcaatggaggagctgccagataccattgaaacactcatgttgctggcgttaatcgccgtactaaccggtggggtgactctgttctttctcagtggccgcggacttggcaaaacgagcattgggctgttgtgtgtcatggcttcctctgtgctgctctggatggccagcgttgagccccactggatcgcagcttccataatcctggagttctttcttatggtgctcctgattcctgagcccgacaggcagcggaccccacaggataaccaattggcctatgtcgtaatcggactgttattcatgattctaacagtggcagccaatgagatgggtctgctcgaaactaccaagaaagaccttggcatcgggcacgttgctgtggagaaccatcaccatgcgacaatgctggatgtcgacttgcaccctgcctcagcatggaccctgtacgctgtggccactacaataattacgcccatgatgcgtcataccatcgaaaacactacagccaatatttctctcaccgcaatcgctaaccaggccgcgatactgatgggacttgataagggctggccaatcagtaaaatggacattggtgtccctttactggctctcgggtgctacagccaggtgaatccgttgaccctgacagccgcagttctaatgctggtggcccactatgctatcattggccccggactccaagcaaaggccactagagaggcgcagaagaggacggctgccggcatcatgaaaaacccaaccgtagatgggatagtggcaattgaccttgatcctgtcgtttacgacgccaagtttgaaaaacagctgggacagatcatgttgctgatcctctgtacaagccaaattctgttaatgcgcactacctgggctctttgcgagtccatcacactggccaccggccccctcactacgctatgggagggttctccagggaagttctggaatacaaccatagcagtgtcaatggctaacatttttcggggaagctatctggccggcgcgggtttggccttctccctgatgaaaagtctcggcgggggacgaagaggcactggggcacagggagaaacccttggcgagaagtggaagaggcagctgaatcagttgtctaaaagcgaatttaacatctacaagcgctcaggtattatggaggtcgaccggtccgaagctaaagaggggctgaagagaggagagacaactcgtcacgccgtgagtaggggcaccgcaaaactccggtggttcgtagaacgcaatttagtgaagcctgagggtaaggttatcgatctgggctgtgggcgaggaggctggagctattactgcgctgggcttaaaaaggtgacagaagtcaaaggatatacgaagggcggtcccgggcatgaggaaccgataccaatggccacctacggatggaacctggtgaaactacactctggcaaggacgtcttctttactcctcccgagaaatgtgatacactcctgtgcgacatcggcgagtcctcaccaaatcccaccattgaagaggggagaactttgagggtgctgaagatggttgaaccttggctccggggaaaccaattctgtatcaagattcttaatccgtacatgcccagcgtagtggagacactggagcagatgcagcgcaaacatggtggcatgttagtcagaaacccactgtcgagaaattctacccacgaaatgtattgggtgagttgcgggacgggaaacatcgtttccgccgtgaatatgaccagccgaatgttgctcaaccggtttacaatggcgcaccgtaagcctacttacgagagagatgtcgacctgggcgctggtacccgccatgtggcagtagaacccgaggtggccaacctagatattatcgggcagaggatagaaaatattaaacacgagcataagtcaacatggcactatgacgaggataacccttacaaaacttgggcttatcatggatcctacgaagttaagccatctggcagcgccagttccatggtcaatggcgtggtgaaacttctgaccaaaccctgggacgtcatccctatggttacacaaatcgcaatgaccgatactacgccattcgggcagcagcgggtgtttaaggagaaagtagacacaagaacccccaaggccaaacgcggaactgctcaaattatggaagtgaccgcgaggtggctctggggtttcctgagccgaaacaagaagccgcggatatgtacaagagaggaatttacgaggaaagtccgctctaatgccgcaatcggcgctgtgttcgttgacgagaaccagtggaactcagccaaggaggcagtggaagatgagcgtttttgggacttggtccagaaagaacgggagctgcacaagcaggggaaatgcgcaacctgcgtgtataacatgatgggaaagagagaaaagaaactcggcgagttcggtaaggctaaagggagtagggccatttggtacatgtggcttggagcgcgctttctggagttcgaagcattaggctttatgaatgaggatcactggttctcccgagaaaacagcctgtctggcgtagagggggagggattgcataagctcggttacatcctgcgggacatttcgaaaatccctggcgggaatatgtatgccgatgacactgctggatgggatacaagaataaccgaagacgatctacaaaacgaggccaagatcactgacattatggaaccagagcacgcacttctggctacatcaatcttcaaactcacctaccagaataaggttgtgagggtccagcgccccgccaagaacggcacagtgatggatgtgattagcagacgggaccagaggggttccgggcaagtcggaacttatggcctgaatacctttacgaacatggaagctcagttgatccgtcagatggagagtgagggcatattcttaccttctgaactggagaccccaaacctcgccgaacgagttcttgattggctggagaaatacggggtggaacgcctaaagagaatggcaattagcggagacgactgtgtagtgaaacccatcgatgaccggtttgcgacagccctgactgctctcaatgatatgggtaaggtcaggaaagacatcccgcagtgggagccttccaagggctggaacgattggcaacaggtgcccttctgctcacatcactttcaccagttgattatgaaggacgggcgcgagatagttgtgccatgtagaaatcaggatgaactggtcggacgggccagggtgagtcaaggcgcaggttggtctcttcgagagaccgcttgcctggggaaaagctatgcccagatgtggcagctcatgtacttccatcgtagagacttacgcctggcagccaacgcgatctgttccgctgtacctgttgattgggtgcccacatcacggactacctggagcattcacgcccatcaccaatggatgacgacagaagacatgttgtctgtctggaatagggtgtggatcgaggaaaacccatggatggaggataagacccatgtttccagttggggagacgtgccctatctgggcaaaagagaggaccagtggtgcggcagcctcattgggcttactgcacgcgccacatgggcttcgaatatccaggtcgccataaaccaggtgcggaggctgatcggaaatgaaaactacctagattacatgacctccatgaagcgatttaaaaatgagggtgaccctgaaggcgcactgtggtga

SEQ ID NO: 13821 - RNA, 9879 nt, synthetic construct
  misc_feature 1..9879: note = derived and/or modified CDS sequence (opt3) from DENV-1__FJ898386__SS-prME
  source 1..9879: mol_type = other RNA
agcgtgaccatgctgctcatgcttatgcccaccgcactggctttccacttgactacgaggggaggggaacctcatatgatcgtcaccaagcaggaaaggggaaaatccttactgtttaagacatctgccggtgttaatatgtgcactctaattgccatggacctcggcgaactgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggatcgttcaaactggagaaggaagtggctgagacccagcacggtacggtccttgtgcagataaagtacgagggcacagacgcgccttgcaaaatcccattctcgacccaagatgaaaagggggttactcagaacggacgcttgattacagcaaatcccatcgtgaccgacaaagagaagcctgtaaacatagaagccgagccaccctttggcgagtcttatattgtcatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtgtttacatccgttgggaaacttgtgcatcagattttcggaacggcgtacggcgtcctgttttctggtgtgagctggaccatgaagatagggatcggcgtattgctcacttggctgggattaaattcacgaagtacatccctgagcatgacctgtattgctgtgggcctagttacactctacctgggggtcatggtgcaggccgattctggatgcgtgatcaactggaaaggccgcgaacttaagtgtggttcagggatcttcgtcactaatgaggttcacacctggacggaacaatataagtttcaggcagacagtccgaaaagattgagcgccgctattggaaaggcctgggaggagggcgtgtgcggtataaggtccgcaacacggctggaaaacatcatgtggaaacagatttctaacgagctcaatcatatcctgttagaaaacgacatgaagttcaccgtggtagtcggcgatgtggttgggattctggctcagggcaaaaagatgatccgccctcaacccatggagcacaaatactcgtggaaaagctggggcaaggccaagataatcggggcggacgtgcagaatactacctttattatcgatggaccaaacacacctgaatgtcccgacgatcagagagcctggaatatttgggaggtcgaggactatggcttcggtatctttactaccaacatatggcttaagttgagggattcctacacacaggtgtgcgaccaccgtctcatgtcagctgcaattaaagatagtaaggccgttcatgctgacatggggtattggatcgaatctgagaaaaatgaaacgtggaagctggcccgggcatccttcattgaggtgaagacctgtatctggccaaaatcccacactctatggtcaaacggagtactggaaagcgagatgataatccccaagatttacggcggtcctatctctcaacataattatcgaccaggctacttcacacagaccgcggggccgtggcacctcggaaaactggagcttgattttgacttgtgcgaaggcactacagtcgtggtggatgagcactgcgggaacagaggaccctccctgaggaccacgactgtcaccggcaagattatccatgaatggtgttgccgcagttgtacattacctccactccggttcaaaggtgaggacgggtgctggtacggaatggagataagacccgttaaggaaaaggaggaaaatctggtgaaaagcatggtatctgccggctccggtgaggtggactcatttagtcttggcctgttgtgtattagcatcatgatcgaagaggtcatgaggtcgcgctggtcccgaaagatgctcatgaccgggactctggctgtgttcctactgctcattatgggacagctgacatggaacgatcttatccggttgtgcattatggttggcgccaatgcatctgaccgtatggggatgggaaccacatatctggctttaatggccacttttaaaatgagacctatgttcgcagtgggcctcctgtttaggcgccttaccagccgggaggtcctgctactcacgataggtctgtcattggtggccagtgttgaactgccaaactccttagaggaactcggggatggactggctatgggcatcatgattcttaagctgttgacagacttccaatctcaccagctctgggcgaccctgctaagcctgacttttatcaaaaccacactttccctccattacgcctggaagactatggcaatggtgctgtcaattgtcagcttgttccccctgtgtttaagtaccacgtctcagaagacaacctggctcccggtactgcttggctccctggggtgcaaacctttgactatgtttctcatcgctgagaataagatatggggaagaaaaagctggccactgaacgaaggtatcatggccgtgggcgttgtgtcgattctactgtcatctcttctcaagaacgatgtccccctggccgggcctttgatcgctggaggcatgttaattgcatgttatgtgatcagtggttccagcgccgacctgtctctcgagaaagcggctgaggtaagctgggaagaggaagccgagcactccggggcatcacataatatactggtggaagtccaggatgacggaacaatgaagattaaagatgaggagagggacgatacccttactatcctgttgaaggccacactactggctgttagtggcgtgtaccccctcagcatcccagcaaccctgttcgtgtggtatttttggcaaaagaaaaagcagcgatctggcgtcctttgggacacgccttcacccccagaagtggagcgcgccgttttagatgacgggatttaccggataatgcagagaggactgctcggtaggagccaggtaggcgtgggggtcttccaagaaaacgtgttccacactatgtggcacgttacccgtggagcggtgttgatgtatcagggcaaacgcctggagccgagttgggctagcgtcaagaaagacctcatctcctacggtgggggatggcggctgcagggctcttggaatacaggcgaggaagtgcaggtaattgccgtcgagcctgggaagaaccccaagaatgtgcaaaccgcaccaggaacatttaaaactcccgaaggtgaggttggcgccatcgctcttgatttcaagcctgggacctcgggaagcccaattgtgaacagagaaggcaaaatcgtcggtctgtacgggaatggagtggttacgacatcaggcacttatgtgtccgccatagcacaggctaaggccagtcaggagggccccttgcctgagatcgaagacgaggtctttaggaaacgaaacctaaccattatggatctgcatccggggtctggaaagacacggcgctacctcccagcgatcgtgagagaagccattaagaggaaattacggaccctgatccttgcacccactcgagtagtggctagcgagatggccgaagctctgaagggtatgcctataagatatcaaaccacagcagttaaatccgagcacacgggcaaggagattgtcgacctcatgtgccatgccactttcaccatgcgcttgctgtcaccagtgagggtgcccaattacaacatgatcatcatggatgaagcccactttacagacccttctagcattgctgcgcgtgggtatatcagtacccgggtcggaatgggcgaggcagccgctatattcatgactgccacaccgcccggttccgtagaagcatttccacagagcaatgccgtgattcaggatgaggaaagagacatccctgagaggtcttggaactcagggtacgagtggattaccgatttccccggaaaaacggtttggtttgtgccatccatcaagagtggcaatgacatagctaactgtctccgcaagaatggcaaacgagtcattcagctgagcagaaagactttcgatacagaatatcagaaaaccaagaacaacgactgggactacgtggttaccactgatatctcggagatgggggcgaattttcgggccgacagggtgatcgatcctcgccgttgccttaaacccgtcattctaaaggacggaccagaaagagtgatcctggcaggtccgatgcctgtaacagtggcttctgccgcacagcggaggggccgcattgggcgaaaccataataaggagggagatcagtacatatatatgggccagcccttgaacaatgacgaggatcacgcccactggaccgaagctaaaatgttactggacaacatcaatacaccagagggtattatccccgccctcttcgaacctgagagagaaaagtccgcggcaatcgatggggagtaccggctgaggggcgaggcccgcaaaactttcgttgaacttatgagaaggggagacctgccagtctggctcagctataaggtggcttcagagggctttcaatacagtgatcggcgttggtgcttcgacggggaacgcaacaatcaggtgttggaggaaaacatggatgtcgagatttggacgaaagagggagaacgaaagaaactgagacccaggtggctagacgcccggacctattctgaccctctggctctccgcgagtttaaggagttcgcagccggtagaaggtccgttagcggcgatcttatactggagatcgggaagttaccgcagcatttgacacagcgggctcaaaatgccctggacaacctcgtgatgctgcacaattcagaacagggaggccgagcatacagacatgcgatggaggagcttccagatactattgaaaccctgatgctcttggccctgatcgctgtattaacaggtggggtgaccctatttttcctgagtggccgcggactcggcaaaactagcattgggcttctgtgtgtcatggcctcctctgtgttgctgtggatggcaagcgttgagccccactggatcgctgcctccataatcctcgaatttttcctgatggtgcttctcattcctgagcccgacaggcagcggacgccacaggataaccaactggcatatgtcgtaatcggattgctgtttatgattttaaccgtggccgctaatgagatgggtctactggaaacaactaagaaagacctcggcatcgggcacgttgcggtggagaaccatcaccatgccaccatgcttgatgtcgacctgcaccctgcatcagcttggacattgtacgccgtggccaccactataattacacccatgatgcgtcatacgatcgaaaacaccactgcaaatatttctctgacagctatcgccaaccaggcggctatactcatgggactggataagggctggccaatcagtaaaatggacattggtgtccctcttttagccctggggtgctacagccaggtgaatccgctcaccttgaccgcagccgttctgatgctagtggctcactatgcaatcattggccccggactgcaagccaaggcgacaagagaggctcagaagaggactgccgcaggcatcatgaaaaacccaacggtagatgggatagtggccattgacctcgatcctgtcgtttacgacgctaagttcgaaaaacagcttggacagatcatgctgttgatcctgtgtaccagccaaattctcctgatgcgcacaacttgggccttatgcgagtccatcacccttgcaacaggccccctgaccactctctgggagggttctccagggaagttttggaatacgacaatagctgtgtcaatggccaacattttccggggaagctatctagcgggcgccggtctggcattttccttgatgaaaagtctgggcgggggacgaagaggcaccggggctcagggagaaactctcggcgagaagtggaagaggcagcttaatcagctgtctaaaagcgagttcaacatctacaagcgctcaggtattatggaggtcgaccggtccgaagccaaagaggggttgaagagaggagagaccacacgtcacgcagtgagtaggggcactgctaaactgcggtggttcgtagaacgcaatctcgtgaagcctgagggtaaggttatcgatttaggctgtgggcgaggaggctggagctattactgcgccgggctgaaaaaggtgaccgaagtcaaaggatatacaaagggcggtcccgggcatgaggaaccgataccaatggccacgtacggatggaaccttgtgaaactgcactctggcaaggacgtctttttcacccctcccgagaaatgtgatactctactctgcgacatcggcgagtcctcaccaaatcccacaattgaagaggggagaaccctgagggtgttgaagatggttgaaccttggctgcggggaaaccaattttgtatcaagattctcaatccgtacatgcccagcgtagtggagactcttgagcagatgcagcgcaaacatggtggcatgctggtcagaaacccattatcgagaaattctacacacgaaatgtattgggtgagttgcgggaccggaaacatcgtttccgcggtgaatatgacgagccgaatgctgttgaaccggttcaccatggctcaccgtaagcctacatacgagagagatgtcgacctcggcgcaggtactcgccatgtggccgtagaacccgaggtggctaacctggatattatcgggcagaggatagaaaatattaaacacgagcataagtcaacctggcactatgacgaggataacccttacaaaacatgggcctatcatggatcctacgaagttaagccatctggcagcgcaagttccatggtcaatggcgtggtgaagctacttactaaaccctgggacgtcatccctatggttacccaaatcgccatgacagataccactccatttgggcagcagcgggtgttcaaggagaaagtagacacgagaacacccaaggctaaacgcggaaccgcgcaaattatggaagtgactgccaggtggctgtggggttttctcagccgaaacaagaagccgcggatatgtaccagagaggagttcacaaggaaagtccgctctaatgcagctatcggcgccgtgtttgttgacgagaaccagtggaactcagcaaaggaggccgtggaagatgagcgtttctgggacctggtccagaaagaacgggagttgcacaagcaggggaaatgcgctacgtgcgtgtataacatgatgggaaagagagaaaagaaactgggcgagtttggtaaggccaaagggagtagggcgatttggtacatgtggctcggagcacgcttccttgagtttgaagccctgggcttcatgaatgaggatcactggttctcccgagaaaacagcttatctggcgtagagggggagggactgcataagttgggttacatcctccgggacatttcgaaaatccctggcgggaatatgtatgctgatgacaccgccggatgggatactagaataacagaagacgatctgcaaaacgaggcaaagatcaccgacattatggaaccagagcacgctctacttgccacttcaatctttaaactgacataccagaataaggttgtgagggtccagcgccccgctaagaacggcaccgtgatggatgtgattagcagacgggaccagaggggttccgggcaagtcggaacatatggcctcaatactttcaccaacatggaagcccagctgatccgtcagatggagagtgagggcatatttttgccttctgaattagagacgccaaacctggcagaacgagttctcgattggcttgagaaatacggggtggaacgcctgaagagaatggcgattagcggagacgactgtgtagtgaaacccatcgatgaccggttcgccaccgctctaacagccctgaatgatatgggtaaggtcaggaaagacatcccgcagtgggagccttccaagggctggaacgattggcaacaggtgcccttttgctcacatcacttccaccagctcattatgaaggacgggcgcgagatagttgtgccatgtagaaatcaggatgaattggtcggacgggcaagggtgagtcaaggcgctggttggtctctgcgagagactgcctgccttgggaaaagctatgcacagatgtggcagctgatgtactttcatcgtagagacctccgcttagccgcgaacgctatctgttccgccgtacctgttgattgggtgcccacctcacggacaacttggagcattcacgcacatcaccaatggatgaccacggaagacatgctgtctgtctggaatagggtgtggatcgaggaaaacccatggatggaggataagacacatgtttccagttgggaggacgtgccctatttgggaaaaagagaagaccagtggtgcggcagcctgattggcctcaccgcccgcgctacttgggcctcgaatatccaggtcgcaataaaccaggtgcggaggcttatcgggaatgagaactacctggattacatgacatccatgaagcgattcaaaaatgaaggagaccctgagggtgctttttggtga

SEQ ID NO: 13822 - RNA, 9879 nt, synthetic construct
  misc_feature 1..9879: note = derived and/or modified CDS sequence (opt3) from DENV-1__FJ898387__SS-prME
  source 1..9879: mol_type = other RNA
agcgtgaccatgctgctaatgcttatgcccaccgcactggctttccacttgactacgagaggcggggaacctcatatgatcgtctccaagcaggaaagggggaagtctttactgtttaagacctcagccggtgttaacatgtgcacactaattgccatggacctcggcgagttctgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaagacgcaaactttgtttgccgccgaacattcgtggatagaggctggggtaatgggtgtggactgtttggcaaaggctccttgataacttgcgctaagttcaagtgcgtaaccaaactcgaggggaagacagtgcagtacgaaaacctgaaatattcagtcattgtgaccgttcacactggagaccagcatcaagtgggtaatgagagtacggaacacggcacaaccgccactatcacaccccaggcgcctagcacagagattcagttaaccgactacggggccctgactctcgattgttctccaaggacaggacttgactttaacgaaatggtcctgttgacgatgaaggagaaatcctggctagtgcataagcagtggttcctggatctcccgctgccctggacctcaggcgcaagcacaagtcaagagacatggaatcggaaagaccttctggtaacctttaagacagctcacgccaagaaacaggaagttgtggtcttgggttctcaggagggggctatgcacactgccctcaccggcgcaacggaaatccaaacctccggaacaactaccatcttcgccggccatctgaagtgccgtttaaaaatggataagctgacactaaaagggatgagctatgtgatgtgtactggatcgttcaagctcgagaaggaagtcgctgagacccagcacggtacggtgctggttcagattaaatacgagggcacagacgcgccttgcaagataccattttctacccaggatgaaaaaggggtgactcaaaacggacgccttatcacagcaaatcccattgtaaccgacaaggagaaacctgtcaacatcgaagccgagccacccttcggcgagtcctatatagtgattggtgctggggaaaaggccttgaagctgtcatggtttaaaaagggcagtagcatcggaaaaatgttcgaggcaactgccagaggcgctaggcggatggccatcctcggggataccgcatgggactttggatccattggtggcgttttcacatctgtggggaagctggtccatcagatctttggaacggcgtacggcgtgcttttcagcggtgtatcatggaccatgaaaattgggataggcgtgctgttgacttggctcggactgaatagtcgatccactagcttatctatgacctgtatcgctgttggcctggtcacactatacctcggggtgatggtgcaggccgattcaggatgcgtcattaactggaagggccgcgaactgaagtgtggtagtgggatctttgttactaatgaggtgcacacctggacggaacagtataaattccaagcagacagcccgaagagactttccgccgctatcggaaaagcctgggaggagggcgtgtgcggtattaggtctgcaacacggttggaaaacataatgtggaagcagatctcgaacgagctgaatcatattctcctggaaaacgacatgaaatttaccgtagtcgtgggcgatgttgctgggatcttagcccagggaaagaaaatgattcgccctcagcccatggagtacaagtatagctggaagtcctggggcaaagcgaagatcataggggccgacgtgcaaaatactaccttcatcattgatggaccaaacacacctgaatgtcccgacgatcagagagcttggaatatctgggaggtcgaggactacggctttggtattttcactaccaacatctggctgaaacttagggattcatatacacaggtgtgcgaccaccgtttgatgagtgcagccataaaggattctaaagctgttcacgccgacatggggtactggattgaaagcgagaagaatgaaacgtggaagctcgcacgggcgtccttcatcgaggtgaaaacctgtatttggccaaagtcacatactctgtggagcaacggagtactagaatctgagatgatcatacccaaaatctatggcggtcctatttcccagcacaattaccgaccaggctactttacacaaaccgccgggccgtggcatctgggaaagctcgagctggatttcgacctttgcgaaggcactacagtcgtggtggatgagcactgcgggaacagaggacccagtttgaggaccacgactgtcaccggcaaaatcattcacgaatggtgttgccgcagctgtacactgcctccattacggtttaagggtgaggacgggtgctggtatggaatggagatcagacccgttaaggaaaaagaggaaaatctcgtgaagtctatggtatccgctggctcaggtgaggtggacagtttcagcctgggccttctgtgtatatcgattatgatcgaagaggtcatgaggtcccgctggtctcgaaaaatgttgatgaccgggactctcgccgtgtttttcctgctaatcatgggacagctgacatggaacgatctcattcggctgtgcatcatggttggcgcaaatgctagcgaccgtatggggatgggaaccacataccttgccttgatggcaacttttaagatgagacctatgttcgccgtgggcctgttatttaggcgcctcacctcacgggaggtcctgcttctgacgattggtctaagtctcgtggcttccgttgaactgccaaactctttggaggaactgggggatggattagcgatgggcataatgatcctcaaactgcttacagacttccagagccatcaactgtgggccaccttgctctccctgacttttattaagaccacattctcactacactatgcatggaagactatggctatggtgctgagcatcgtcagtctttttcccctctgtctgtctaccacgtcccagaaaacaacctggttgccggtactgttaggcagcctcgggtgcaagcctctgactatgttccttattgccgagaataaaatctggggaagaaagtcgtggccactgaacgaaggtataatggccgtgggcatcgtttcaattttgctctctagtctgctcaagaatgatgtgcccctggctgggcctcttatcgcaggaggcatgctcattgcctgttacgtcatctccggtagctctgcggacctgagcttggagaaggctgccgaggtgtcctgggaagaggaagcagagcattcaggggccagtcacaatatattagtagaagtgcaggatgacggaacaatgaaaattaaggatgaggagagggacgataccctgactatcctcctgaaggctacacttctggcagtcagcggcgtttatcccttgtctatcccagccaccctattcgtgtggtacttttggcagaaaaagaaacaacgatccggcgtgctgtgggacacgccttcacccccagaagtcgagcgcgcggtgctcgatgacgggatttatcggataatgcagagaggactgcttggtaggagtcaggttggcgtaggggtgttccaggaaaacgtctttcatactatgtggcacgtgacccgtggagctgttttaatgtaccaaggcaagcgcctggagccgagctgggcctccgtgaaaaaggacctcatctcttacggtgggggatggcggttgcagggctcgtggaatacaggcgaggaagtccaggtgattgcagtagagcctgggaagaaccccaaaaatgtccagaccgccccaggaacattcaagactagcgaaggtgaggtgggcgctatcgccctggattttaaacccgggacctcaggatcccctattgttaacagagaaggcaagatcgtgggtctctatgggaatggagtcgtgacgacaagtggcacttacgtttctgcaatagctcaagccaaagcgagccaggagggcccactgcccgagatcgaagacgaggtgttcaggaagcgaaaccttaccattatggatctgcaccctgggtccggaaagacacggcgctatttgccggccatcgtcagagaagcaattaaaaggaagctacggaccctgatcctcgctccaactcgagtggtagcctcagagatggctgaagcattaaaaggtatgcccataagataccagaccacagccgtgaagtctgagcatacgggcaaagagattgttgacctgatgtgccacgccacttttaccatgcgccttctgagccctgtcagggtgccaaattataacatgatcatcatggatgaagctcatttcacagaccccagttccattgcggcacgtgggtacatcagcacccgggtgggaatgggcgaggccgctgccatatttatgactgcaacacctccgggttctgtcgaagccttcccccaatcaaatgctgtaattcaggatgaggaaagagacatcccagagaggtcctggaacagtgggtatgagtggattaccgattttcctggaaagacggtgtggttcgttcccagcatcaagtcgggcaatgacatagcgaactgtctccgcaaaaatggcaagcgagtgattcagttgtctagaaaaactttcgatacagaataccagaagaccaaaaacaacgactgggactacgtcgtgaccactgatatctccgagatgggggccaattttcgggcagacagggttatcgatccacgccgttgcctgaagcctgtgattctcaaggacggacccgaaagagtcatcctggctggtccaatgccggtgacagtagccagcgcagcccaacggaggggccgcattgggcgaaaccacaataaagagggagatcagtatatatacatgggccagcctcttaacaatgacgaggatcatgctcactggaccgaagccaagatgctactggacaacatcaatacacccgagggtattatcccagcgttgttcgaacccgagagagaaaaatcagcagccatcgatggggagtatcggttaaggggcgaggctcgcaagacttttgtggaactgatgagaaggggagacctccctgtttggctgagttacaaagtcgcctctgagggcttccagtattccgatcggcgttggtgctttgacggggaacgcaacaatcaagtgcttgaggaaaacatggatgtggagatttggacgaaggagggagaacgaaagaaactgagaccaaggtggctcgacgctcggacctacagcgaccccttggcactgcgcgagttcaaagaatttgccgctggtagaaggtcagtcagtggcgatctaatactggagatcgggaaactccctcagcaccttacacagcgggcccagaatgcactggacaacttagttatgttgcataatagcgaacaaggaggccgagcgtatagacacgccatggaggagctgccggatactattgaaaccctcatgctgcttgctctgatcgccgtgctcacaggtggggtaaccttgttctttctgtccggccgcggattaggcaagacttctattgggctactgtgtgtgatggcaagctccgtcctcctttggatggcttcagtggagccacattggatcgccgcatctataatcctggagttctttttgatggttctgctcattcccgagcctgacaggcagcggacgccccaggataaccagctggcctacgtggtcatcggacttctcttcatgattctgaccgtagctgcgaatgagatgggtttgctggaaacaactaaaaaggacttaggcatcgggcacgtggccgttgagaaccaccatcacgcagctatgctagatgtggacctgcatccagccagtgcctggaccctctacgcagtcgctacaaccataattactcctatgatgcgtcacacaatcgaaaacacgaccgccaatatttcgcttactgcgatcgctaaccaagccgcaatactgatgggattggataaaggctggcccatcagcaagatggacattggtgtgccactgctcgccctggggtgctattcccaggtcaatcctcttacattaaccgctgcagtgctgatgctcgttgcccattacgcgatcattggcccgggattgcaggctaaggccaccagagaggcacagaagaggacagccgctggcatcatgaagaaccccactgtggatgggatagtagccattgacctggatccagtggtctatgacacgaaatttgaaaagcagctaggacagatcatgctgctcatcctttgtacctctcagattctgttgatgcgcacaacttgggcactgtgcgagtcaatcaccctcgctacaggccctctgaccactttatgggagggtagccccgggaaattctggaatacgacaatagccgtttccatggcgaacattttccggggaagttaccttgccggcgcaggtctggctttttctctcatgaaaagcctaggcgggggacgaagaggcaccggggcccaaggagaaactctgggcgagaagtggaaaaggcagttgaatcagctgtcaaagtccgagttcaacacctataaacgcagtggtatcatggaggtggaccggagcgaagcaaaggaggggctcaaaagaggagagacaactaagcacgctgtctctcgtggcaccgccaaacttaggtggtttgtggaacggaatctggtaaaaccagagggtaaggtgattgatttgggctgtgggcgcggaggctggtcctactattgcgccgggctgaaaaaggttacagaagtgaaaggatacacgaagggcggtcctgggcacgaggaacccatcccgatggcgacctacggatggaacctcgtcaaattacattcaggcaaggacgtgttctttataccacctgagaagtgtgatactctgctttgcgacatcggcgagagctcgcccaatccaacaattgaagaggggcgaaccctgagagtcctaaaaatggtggaaccctggctcaggggaaaccagttctgtatcaagattctgaatccttatatgccgtctgttgtagagactttggagcaaatgcagcggaaacacggtggcatgctggtgcgcaaccccctcagtagaaattccacacatgaaatgtactgggtcagctgcgggaccggaaacatcgtgtcagctgttaatatgacgtccaggatgcttctgaaccgatttaccatggcacaccggaagccaacatatgagcgtgatgtggacttaggcgccggtactagacacgtcgctgtggaacctgaggtagccaacctggatattatcgggcagcgcatagaaaatattaaacatgagcacaagtctacctggcattacgacgaggataacccctataagacatgggcataccacggaagctatgaagtgaaacctagtggctccgccagctctatggttaatggcgtcgtgaagttgctcactaaaccatgggacgtgatccccatggtcacccagatcgctatgacagataccactcctttcgggcaacagagggtttttaaggagaaagtggacacgcggacaccaaaggcgaagagaggaaccgcccagattatggaagtaactgcaaaatggctgtggggtttcctatcacgcaacaagaaacccaggatatgtacccgagaggaatttacacggaaggtgagaagtaatgctgccatcggcgcagtcttcgtggacgagaaccaatggaactccgccaaagaggctgttgaagatgagaggttttgggaccttgtgcatcgcgaacgtgagctgcacaagcaggggaagtgcgccacgtgcgtctacaacatgatgggaaaacgggaaaagaaactcggcgagttcggtaaggcgaaagggagcagagcaatttggtacatgtggctgggagccaggttcttggagtttgaagctctgggcttcatgaatgaggatcactggttttctcgcgaaaactcgctctcaggcgtggagggggagggacttcataagctgggttatatcttacgagacattagcaaaatcccgggcgggaatatgtacgccgatgacaccgcaggatgggatactcggataacagaagacgatctgcagaacgaggctaagatcaccgacattatggaacctgagcacgccttgctcgctaagtccatcttcaaactgacttatcagaataaggtagttagagtgcaaaggccagccaaaaacggcacagtcatggatgtgattagtcgcagagaccagcggggttctggacaggtgggaacctacggcctaaatacatttactaacatggaagcacagcttatcaggcaaatggagagcgagggcatattctccccctcagaactggagacccctaacctcgcggggcgtgtcctggattggttggaaaagcatggagttgagcgattaaaacgcatggccattagtggtgacgactgtgtggtaaagccaatcgatgacagatttgctacggccctgaccgcactcaatgatatgggcaaggtgcggaaagacatcccccagtgggaaccgtctaaggggtggaacgattggcagcaggtccctttctgcagccaccactttcatcaacttattatgaaagacggaagggagatagtggttccctgtcgcaatcaggatgagctggtgggcagagctcgggtctcccagggtgccgggtggtcactaagggaaacagcatgcctgggaaagagctatgcccagatgtggcaactcatgtacttccaccgacgtgacttgagactggcggctaacgccatctgttctgcagtgccagtagattgggttcctacttcccgcaccacatggagtattcatgcccaccatcagtggatgactaccgaggacatgcttagcgtgtggaatcgggtctggatcgaagagaacccctggatggaagataaaacgcacatttcgtcctggggcgacgtgccatatctgggcaagagggaggaccagtggtgcgggtctctcatcggattaacagctagagccacctgggcaactaatatacaagttgctatcaaccaggtgcgccggctgattggtaatgagaactacttggattacatgacatcaatgaagaggtttaaaaatgaaagcgaccccgagggcgccctgtggtga

SEQ ID NO: 13823 - RNA, 9879 nt, synthetic construct
  misc_feature 1..9879: note = derived and/or modified CDS sequence (opt3) from DENV-1__FJ898389__SS-prME
  source 1..9879: mol_type = other RNA
agcgtgaccatgctgctcatgcttatgcccacagcactggctttccacttgactacgaggggaggggaacctcatatgatcgtcaccaagcaggaaaggggaaaatccttactgtttaagacatctgccggtgttaatatgtgcactctaattgccatggacctcggcgagctgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggtagcttcaaactggagaaggaagtggctgagacccagcacggaacggtccttgtgcagataaagtacgagggcacagacgcgccttgcaaaatcccattctcgacccaagatgaaaagggggttactcagaacggacgcttgattacagcaaatcccatcgtgaccgacaaagagaagcctgtaaacatagaagccgagccaccctttggcgagtcttatattgtcatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtgtttacatccgttgggaaacttgtgcatcagattttcggaacggcgtacggcgtcctgttttctggtgtgagctggaccatgaagatagggatcggcgtattgctcacttggctgggattaaattcacgaagtacatccctgagcatgacctgtattgctgtgggcctagttacactctacctgggggtcatggtgcaggccgattctggatgcgtgatcaactggaaaggccgcgaacttaagtgtggttcagggatcttcgtcactaatgaggttcacacctggacggaacaatataagtttcaggcagacagtccgaaaagattgagcgccgctattggaaaggcctgggaggagggcgtgtgcggtataaggtccgcaacacggctggaaaacatcatgtggaaacagatttctaacgagctcaatcatatcctgttagaaaacgacatgaagttcaccgtggtagtcggcgatgtggttgggattctggctcagggcaagaagatgatccgccctcaacccatggagcacaaatactcgtggaaaagctggggcaaggccaagataatcggggcggacgtgcagaatactacctttattatcgatggaccaaacacacctgaatgtcccgacgatcagagagcctggaatatttgggaggtcgaggactatggcttcggtatctttactaccaacatatggcttaagttgagggattcctacacacaggtgtgcgaccaccgtctcatgtcagctgcaattaaagatagtaaggccgttcatgctgacatggggtattggatcgaatctgagaaaaatgaaacgtggaagctggcccgggcatccttcattgaggtgaagacctgtatctggccaaaatcccacactctatggtcaaacggagtactggaaagcgagatgataatccccaagatttacggcggtcctatctctcaacataattatcgaccaggctacttcacacagaccgcggggccgtggcacctcggaaaactggagcttgattttgacttgtgcgaaggcactacagtcgtggtggatgagcactgcgggaacagaggaccctccctgaggaccacgactgtcaccggcaagattatccatgaatggtgttgccgcagttgtacattacctccactccggttcaaaggtgaggacgggtgctggtacggaatggagataagacccgttaaggaaaaggaggaaaatctggtgaaaagcatggtatctgccggctccggtgaggtggactcatttagtcttggcctgttgtgtattagcatcatgatcgaagaggtcatgaggtcgcgctggtcccgaaagatgctcatgaccgggactctggctgtgttcctatttctgattatgggacagctcacatggaacgatctgatccggctttgcattatggttggcgccaatgcatctgaccgtatggggatgggaaccacatatttggctctgatggccactttcaaaatgagacctatgtttgcagtgggcttactcttcaggcgcctgaccagccgggaggtccttctgctaacgataggtctctcactggtggccagtgttgaattgccaaactccctggaggaattaggggatggactcgctatgggcatcatgattctgaaacttctgacagactttcaatctcaccagttgtgggcgaccctcctgagcctaactttcatcaaaaccacactgtcccttcattacgcctggaagactatggcaatggtgctctcaattgtcagcctgtttcccttgtgtctgagtaccacgtctcagaagacaacctggttaccggtactcctgggctccttcgggtgcaaacctcttgctatgtttctgatcgccgagaataagatatggggaagaaaaagctggccattgaacgaaggtatcatggccgtgggcgttgtgtcgattctcctgtcatctctactgaagaacgatgtcccccttgctgggcctctcatcgcaggaggcatgctgattgcctgttatgtgatcagtggttccagcgcggacttgtctttagagaaagctgccgaggtaagctgggaagaggaagcagagcactccggggcctcacataatatactggtggaagtccaggatgacggaactatgaagattaaagatgaggagagggacgatacactcaccatcctgcttaaggctactctgttggcagttagtggcgtgtaccccctaagcatcccagccacactgttcgtgtggtatttctggcaaaagaaaaagcagcgatctggcgtcctctgggacaccccttcacccccagaagtggagcgcgcggttctggatgacgggatttaccggataatgcagagaggacttttaggtaggagccaggtaggcgtgggggtctttcaagaaaacgtgttccacacgatgtggcacgttactcgtggagctgtgctgatgtatcagggcaaacgcctcgagccgagttgggccagcgtcaagaaagacttgatctcctacggtgggggatggcggctgcagggctcttggaataccggcgaggaagtgcaggtaattgcagtcgagcctgggaagaaccccaagaatgtgcaaacagccccaggaacctttaaaacacccgaaggtgaggttggcgctatcgccctcgatttcaagcctgggacttcgggaagcccaattgtgaacagagaaggcaaaatcgtcggtctgtacgggaatggagtggttaccacgtcaggcacatatgtgtccgcaatagctcaggccaaggcgagtcaggagggcccccttcctgagatcgaagacgaggtctttaggaaacgaaacctgactattatggatttgcatccggggtctggaaagacccggcgctacctaccagccatcgtgagagaagcaattaagaggaaactgcggacactcatcttagctcccacccgagtagtggccagcgagatggctgaagcactgaagggtatgcctataagatatcaaactaccgccgttaaatccgagcacacaggcaaggagattgtcgaccttatgtgccatgccacgttcactatgcgcctgctctcaccagtgagggtgcccaattacaacatgatcatcatggatgaagctcactttaccgaccctttctctattgcggcacgtgggtatatcagcacacgggtcggaatgggcgaggccgctgccatatttatgaccgcaactccgcccggtagtgtagaagccttcccacagtccaatgctgtgattcaggatgaggaaagagacatccctgagaggagctggaactctgggtacgagtggattacagattttcccggaaaaaccgtttggttcgtgccatcaatcaagtccggcaatgacatagcgaactgtttgcgcaagaatggcaaacgagtcattcagctgagtagaaagacgttcgatactgaatatcagaagaccaagaacaacgactgggactacgtggttaccaccgatatcagcgagatgggggccaattttcgggcagacagggtgatcgatcctcgccgttgcctcaaacccgtcattctgaaggacggaccagaaagagtgatccttgctggtccgatgcctgtaactgtggcctcggcagcccagcggaggggccgcattgggcgaaaccataataaggagggagatcagtacatatatatgggccagcccctaaacaatgacgaggatcacgctcactggacagaagccaaaatgctgttggacaacatcaataccccagagggtattatccccgcgttattcgaacctgagagagaaaagtctgcagccatcgatggggagtaccggctgaggggcgaggctcgcaaaacatttgttgaactcatgagaaggggagacctgccagtctggctttcctataaggtggccagcgagggcttccaatactcagatcggcgttggtgctttgacggggaacgcaacaatcaggtgctggaggaaaacatggatgtcgagatttggactaaagagggagaacgaaagaaactcagacccaggtggttggacgctcggacgtatagtgaccctctggcactacgcgagttcaaggaatttgccgctggtagaaggtctgtttccggcgatctgatactcgagatcgggaaacttccgcagcatctgacccagcgggcccaaaatgcattagacaacttggtgatgctgcacaatagcgaacagggaggccgagcgtacagacatgccatggaggagctcccagatacaattgaaactctgatgcttctggctctcatcgccgtattgaccggtggggtgacactgttctttttatcaggccgcggactaggcaaaaccagtattgggctgctctgtgtcatggcaagctccgtgcttctgtggatggcttctgttgagccccactggatcgccgcaagcataatcttggagttctttctgatggtgctcctgattcctgagcccgacaggcagcggactccacaggataaccaacttgcctatgtcgtaatcggactcctgttcatgattttgacggtggctgcgaatgagatgggtctgttagaaaccacaaagaaagacctaggcatcgggcacgttgccgtggagaaccatcaccatgcaactatgctggatgtcgacctccaccctgcttccgcctggaccctttacgccgtggcaacaaccataattactcccatgatgcgtcatacaatcgaaaacacgaccgctaatatttcactgactgccatcgcgaaccaggctgccatattgatgggactggataagggctggccaatctctaaaatggacattggtgtccctctcctggcacttgggtgctacagtcaggtgaatccgttaacactgaccgccgctgttctcatgttggtggcacactatgccatcattggccccggactgcaagcgaaggctaccagagaggcccagaagaggacagcagccggcatcatgaaaaacccaactgtagatgggatagtggctattgacctagatcctgtcgtttacgacgccaagtttgaaaaacagctgggacagatcatgctccttatcctgtgtacgtcgcaaattttgctgatgcgcaccacatgggcactctgcgagagcatcactctggctaccggccccttaacaaccctttgggagggttccccagggaagttctggaatactacgatagccgtgtctatggcgaacattttccggggatcatatctggccggcgcaggtctcgcttttagcctaatgaaatccctgggcgggggacgaagaggcacaggggcccagggagaaaccttgggcgagaagtggaagaggcagctgaatcagctcagtaaatctgagttcaacatctacaagcgcagcggtattatggaggtcgaccggtcagaagcaaaagaggggcttaagagaggagagactacccgtcacgctgtgtccaggggcacagccaaactgcggtggtttgtagaacgcaatttggtgaagcctgagggtaaggttatcgatctgggctgtgggcgaggaggctggagttattactgcgccgggctcaaaaaggtgactgaagtcaaaggatataccaagggcggtcccgggcatgaggaaccgataccaatggcgacatacggatggaacttagtgaaactgcacagcggcaaggacgtcttctttacgcctcccgagaaatgtgatacccttctgtgcgacatcggcgagtcttccccaaatcccactattgaagaggggagaacactaagggtgctcaagatggttgaaccttggctgcggggaaaccaattctgtatcaagattttgaatccgtacatgccctcagtagtggagaccctggagcagatgcagcgcaaacatggtggcatgctcgtcagaaacccacttagcagaaattcgactcacgaaatgtattgggtgtcttgcgggacaggaaacatcgttagtgctgtgaatatgacctcccgaatgctgttaaaccggtttacgatggcacaccgtaagcctacctacgagagagatgtcgacctgggcgccggtacacgccatgtggctgtagaacccgaggtggccaacttggatattatcgggcagaggatagaaaatattaaacacgagcataagagcacttggcactatgacgaggataacccttacaaaacctgggcatatcatggatcatacgaagttaagccatccggctctgccagcagtatggtcaatggcgtggtgaagctcctgacaaaaccctgggacgtcatccctatggttactcaaatcgctatgaccgatacaaccccattcgggcagcagcgggtgtttaaggagaaagtagacactagaacgcccaaggcgaaacgcggaacagcccaaattatggaagtgaccgcaaggtggctatggggtttcctttcccgaaacaagaagccgcggatatgtactagagaggaatttaccaggaaagtccgcagcaatgctgccatcggcgcagtgttcgttgacgagaaccagtggaactctgccaaggaggctgtggaagatgagcgtttttgggacctggtccagaaagaacgggagctccacaagcaggggaaatgcgccacatgcgtgtataacatgatgggaaagagagaaaagaaactgggcgagttcggtaaggcgaaagggtcaagggcaatttggtacatgtggttgggagcccgcttcctggagtttgaagctctcggcttcatgaatgaggatcactggtttagtcgagaaaactcccttagcggcgtagagggggagggactgcataagttaggttacatcctgcgggacatttctaaaatccctggcgggaatatgtatgccgatgacacggcaggatgggataccagaataactgaagacgatttgcaaaacgaggctaagatcacagacattatggaaccagagcacgccctcctggctacctcgatcttcaaactaacttaccagaataaggttgtgagggtccagcgccccgccaagaacggcacagtgatggatgtgatttcaagacgggaccagaggggtagcgggcaagtcggaacctatggccttaatacatttactaacatggaagcacagctgatccgtcagatggagtccgagggcatattcctccctagtgaactggagaccccaaacttggcggaacgagttttagattggctggagaaatacggggtggaacgcctcaagagaatggccatttctggagacgactgtgtagtgaaacccatcgatgaccggtttgctacggcccttaccgcactgaatgatatgggtaaggtcaggaaagacatcccgcagtgggagcctagcaagggctggaacgattggcaacaggtgcccttctgctcccatcactttcaccagctaattatgaaggacgggcgcgagatagttgtgccatgtagaaatcaggatgaactggtcggacgggctagggtgtcacaaggcgccggttggagtctccgagagacagcatgcttggggaaatcttatgcccagatgtggcagctgatgtacttccatcgtagagaccttcgcctggcggctaacgccatctgtagcgcagtacctgttgattgggtgcccacttcccggaccacatggtcaattcacgcccatcaccaatggatgactaccgaagacatgctcagcgtctggaatagggtgtggatcgaggaaaacccatggatggaggataagacgcatgtttcttcctggggagacgtgccctatttaggcaaaagagaggaccagtggtgcggcagtctgattgggttgacagctcgcgccacctgggcaagcaatatccaggtcgctataaaccaggtgcggaggctgatcggaaatgaaaactacctcgattacatgacttcgatgaagcgatttaaaaatgagggtgaccctgaaggcgccctttggtga

SEQ ID NO: 13824 - RNA, 9879 nt, synthetic construct
  misc_feature 1..9879: note = derived and/or modified CDS sequence (opt3) from DENV-1__FJ898390__SS-prME
  source 1..9879: mol_type = other RNA
agcgtgaccatgctgctcatgcttatgcccaccgcactggctttccacttgactacgaggggaggggaacctcatatgatcgtcaccaagcaggaaaggggaaaatccttactgtttaagacatctgccggtgttaatatgtgcactctaattgccatggacctcggcgaactgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggtagcttcaaactggagaaggaagtggctgagacccagcacggaacggtccttgtgcagataaagtacgagggcacagacgcgccttgcaaaatcccattctcgacccaagatgaaaagggggttactcagaacggacgcttgattacagcaaatcccatcgtgaccgacaaagagaagcctgtaaacatagaagccgagccaccctttggcgagtcttatattgtcatcggtgtgggggaaaaagctctgaagctctcctggttcaagaaaggctcaagtatcggaaagatgtttgaggccactgcaagaggcgccaggcggatggctattctgggggataccgcctgggacttcggaagcatcggtggcgtttttacatccgtggggaaacttgtccatcagattttcggaacggcatacggcgtgctgttttctggtgtaagctggaccatgaagatagggatcggcgtgttgctcacttggctgggattaaattcacgaagtacatccctgagcatgacctgtattgcggttggcctagtcacactctacctgggggtgatggtgcaggctgattctggatgcgtcatcaactggaaaggccgcgaacttaagtgtggttcagggatcttcgttactaatgaggtgcacacctggacggaacaatataagtttcaggccgacagtccgaaaagattgagcgcagccattggaaaggcttgggaggagggcgtgtgcggtataaggtccgccacacggctggaaaacatcatgtggaaacagatttctaacgagctcaatcatatcctgttagaaaacgacatgaagttcaccgtagtcgtgggcgatgttgtggggattctggcacagggcaaaaagatgatccgccctcaacccatggagcacaaatactcgtggaaaagctggggcaaggctaagataatcggggccgacgtccagaatactacctttattatcgatggaccaaacacacctgaatgtcccgacgatcagagagcgtggaatatttgggaggtggaggactatggcttcggtatctttactaccaacatatggcttaagttgagggattcctacacacaggtttgcgaccaccgtctcatgtcagccgctattaaagatagtaaggcagtgcatgccgacatggggtattggatcgaatctgagaaaaatgaaacgtggaagctggctcgggccagcttcattgaggtaaagacctgtatctggccaaaatcccacactctatggtcaaacggagtcctggaaagcgagatgataatccccaagatttacggcggtcctatctctcaacataattatcgaccaggctacttcacacagaccgcagggccgtggcacctcggaaaactggagcttgattttgacttgtgcgaaggcactacagtggtggtcgatgagcactgcgggaacagaggaccctccctgaggaccacgactgttaccggcaagattatccatgaatggtgttgccgcagttgtacattacctccactccggttcaaaggtgaggacgggtgctggtacggaatggagataagacccgtgaaggaaaaggaggaaaatctggtaaaaagcatggtgtctgcgggctccggtgaggtcgactcatttagtcttggcctgttgtgtattagcatcatgatcgaagaggtgatgaggtcgcgctggtcccgaaagatgctcatgaccgggactctggccgttttcctactgctcattatgggacagctgacatggaacgatcttatccggttgtgcattatggtgggcgctaatgcctctgaccgtatggggatgggaaccacatatctggcattaatggctacttttaaaatgagacctatgttcgccgtcggcctcctgtttaggcgccttaccagccgggaggtgctgctactcacgataggtctgtcattggttgcaagtgtggaactgccaaactccttagaggaactcggggatggactggccatgggcatcatgattcttaagctgttgacagacttccaatctcaccagctctgggctaccctgctaagcctgacttttatcaaaaccacactttccctccattacgcgtggaagactatggccatggtcctgtcaattgtatccttgttccccctgtgtttaagtaccacgtctcagaagacaacctggctcccggtgctgcttggctccctggggtgcaaacctttgactatgtttctcatcgcagagaataagatatggggaagaaaaagctggccactgaacgaaggtatcatggctgttggcgtggtctcgattctactgtcatctcttctcaagaacgatgtgcccctggccgggcctttgatcgccggaggcatgttaattgcttgttatgtaatcagtggttccagcgcagacctgtctctcgagaaagccgcggaggtgagctgggaagaggaagctgagcactccggggcctcacataatatactggtcgaagttcaggatgacggaacaatgaagattaaagatgaggagagggacgatacccttactatcctgttgaaggcaacactactggccgtgagtggcgtgtaccccctcagcatcccagctaccctgttcgtctggtatttttggcaaaagaaaaagcagcgatctggcgtgctttgggacacgccttcacccccagaagttgagcgcgcagtattagatgacgggatttaccggataatgcagagaggactgctcggtaggagccaggtgggcgtcggggtgttccaagaaaacgttttccacactatgtggcacgtgacccgtggagccgtcttgatgtatcagggcaaacgcctggagccgagttgggcgagcgtgaagaaagacctcatctcctacggtgggggatggcggctgcagggctcttggaatacaggcgaggaagtacaggtcattgctgtggagcctgggaagaaccccaagaatgttcaaaccgccccaggaacatttaaaactcccgaaggtgaggtgggcgcaatcgcccttgatttcaagcctgggacctcgggaagcccaattgtcaacagagaaggcaaaatcgtgggtctgtacgggaatggagttgtgacgacatcaggcacttatgtctccgctatagcccaggcaaaggctagtcaggagggccccttgcctgagatcgaagacgaggtgtttaggaaacgaaacctaaccattatggatctgcatccggggtctggaaagacacggcgctacctcccagccatcgtaagagaagcgattaagaggaaattacggaccctgatccttgcccccactcgagtggttgcaagcgagatggctgaagccctgaagggtatgcctataagatatcaaaccacagctgtcaaatccgagcacacgggcaaggagattgtggacctcatgtgccatgcaactttcaccatgcgcttgctgtcaccagtgagggtccccaattacaacatgatcatcatggatgaagcccactttacagacccttctagcattgccgctcgtgggtatatcagtacccgggtaggaatgggcgaggcggcagccatattcatgactgctacaccgcccggttccgtggaagcctttccacagagcaatgcagttattcaggatgaggaaagagacatccctgagaggtcttggaactcagggtacgagtggattaccgatttccccggaaaaacggtgtggtttgtcccatccatcaagagtggcaatgacatagccaactgtctccgcaagaatggcaaacgagtgattcagctgagcagaaagactttcgatacagaatatcagaaaaccaagaacaacgactgggactacgttgtgaccactgatatctcggagatgggggctaattttcgggcggacagggtcatcgatcctcgccgttgccttaaacccgtgattctaaaggacggaccagaaagagtaatcctggccggtccgatgcctgtgacagttgcatctgctgcccagcggaggggccgcattgggcgaaaccataataaggagggagatcagtacatatatatgggccagcccttgaacaatgacgaggatcacgcacactggaccgaagccaaaatgttactggacaacatcaatacaccagagggtattatccccgctctcttcgaacctgagagagaaaagtccgccgcgatcgatggggagtaccggctgaggggcgaggcacgcaaaactttcgtcgaacttatgagaaggggagacctgccagtgtggctcagctataaggtggcctcagagggctttcaatacagtgatcggcgttggtgcttcgacggggaacgcaacaatcaggtcttggaggaaaacatggatgttgagatttggacgaaagagggagaacgaaagaaactgagacccaggtggctagacgctcggacctattctgaccctctggccctccgcgagtttaaggagttcgctgcaggtagaaggtccgtgagcggcgatcttatactggagatcgggaagttaccgcagcatttgacacagcgggcccaaaatgctctggacaacctcgtaatgctgcacaattcagaacagggaggccgagcctacagacatgcaatggaggagcttccagatactattgaaaccctgatgctcttggcgctgatcgccgtgttaacaggtggggtcaccctatttttcctgagtggccgcggactcggcaaaactagcattgggcttctgtgtgtgatggcttcctctgttttgctgtggatggccagcgtggagccccactggatcgcagcttccataatcctcgaatttttcctgatggtccttctcattcctgagcccgacaggcagcggacgccacaggataaccaactggcctatgtagtgatcggattgctgtttatgattttaaccgttgcagccaatgagatgggtctactggaaacaactaagaaagacctcggcatcgggcacgtggctgtcgagaaccatcaccatgcgaccatgcttgatgtggacctgcaccctgcctcagcatggacattgtacgctgtcgccaccactataattacacccatgatgcgtcatacgatcgaaaacaccactgccaatatttctctgacagcaatcgctaaccaggccgcgatactcatgggactggataagggctggccaatcagtaaaatggacattggtgtgcctcttttagctctggggtgctactcgcaggttaatccgctcaccttgaccgccgcagtgctgatgctagtagcccactatgctatcattggccccggactgcaagcaaaggccacaagagaggcgcagaagaggactgctgccggcatcatgaaaaacccaacggtggatgggatagtcgcaattgacctcgatcctgttgtgtacgacgccaagttcgaaaaacagcttggacagatcatgctgttgatcctgtgtaccagccaaattctcctgatgcgcacaacttgggctttatgcgagtccatcacccttgccacaggccccctgaccactctctgggagggttctccagggaagttttggaatacgacaatagcagtctcaatggctaacattttccggggaagctatctagccggcgcgggtctggccttttccttgatgaaaagtctgggcgggggacgaagaggcaccggggcacagggagaaactctcggcgagaagtggaagaggcagcttaatcagctgtctaaaagcgagttcaacatctacaagcgctcaggtattatggaggtggaccggtccgaagctaaagaggggttgaagagaggagagaccacacgtcacgccgtaagtaggggcactgcaaaactgcggtggttcgtggaacgcaatctcgttaagcctgagggtaaggtgatcgatttaggctgtgggcgaggaggctggagctattactgcgctgggctgaaaaaggtcaccgaagtgaaaggatatacaaagggcggtcccgggcatgaggaaccgataccaatggccacgtacggatggaaccttgtcaaactgcactctggcaaggacgtgtttttcacccctcccgagaaatgtgatactctactctgcgacatcggcgagtcctcaccaaatcccacaattgaagaggggagaaccctgagggttttgaagatggtagaaccttggctgcggggaaaccaattttgtatcaagattctcaatccgtacatgcccagcgtggtcgagactcttgagcagatgcagcgcaaacatggtggcatgctggtgagaaacccattatcgagaaattctacacacgaaatgtattgggttagttgcgggaccggaaacatcgtgtccgccgtcaatatgacgagccgaatgctgttgaaccggttcaccatggcgcaccgtaagcctacatacgagagagatgtggacctcggcgctggtactcgccatgtagcagtggaacccgaggttgccaacctggatattatcgggcagaggatagaaaatattaaacacgagcataagtcaacctggcactatgacgaggataacccttacaaaacatgggcttatcatggatcctacgaagtcaagccatctggcagcgccagttccatggtgaatggcgtggtcaagctacttactaaaccctgggacgttatccctatggtgacccaaatcgcaatgacagataccactccatttgggcagcagcgggtattcaaggagaaagtggacacgagaacacccaaggccaaacgcggaaccgctcaaattatggaagtcactgcgaggtggctgtggggttttctcagccgaaacaagaagccgcggatatgtaccagagaggagttcacaaggaaagtgcgctctaatgccgcaatcggcgctgtttttgtggacgagaaccagtggaactcagccaaggaggcagtcgaagatgagcgtttctgggacctggtgcagaaagaacgggagttgcacaagcaggggaaatgcgccacgtgcgtatataacatgatgggaaagagagaaaagaaactgggcgagtttggtaaggctaaagggagtagggccatttggtacatgtggctcggagcgcgcttccttgagtttgaagcactgggcttcatgaatgaggatcactggttctcccgagaaaacagcttatctggcgttgagggggagggactgcataagttgggttacatcctccgggacatttcgaaaatccctggcgggaatatgtatgccgatgacaccgctggatgggatactagaataacagaagacgatctgcaaaacgaggccaagatcaccgacattatggaaccagagcacgcactacttgctacttcaatctttaaactgacataccagaataaggtggtcagggtgcagcgccccgccaagaacggcaccgtgatggatgtcattagcagacgggaccagaggggttccgggcaagttggaacatatggcctcaatactttcaccaacatggaagctcagctgatccgtcagatggagagtgagggcatatttttgccttctgaattagagacgccaaacctggccgaacgagtgctcgattggcttgagaaacatggggtagaacgcctgaagagaatggcaattagcggagacgactgtgtggtcaaacccatcgatgaccggttcgcgaccgccctaacagctctgaatgatatgggtaaggtgaggaaagacatcccgcagtgggagccttccaagggctggaacgattggcaacaggttcccttttgctcacaccacttccatcagctcattatgaaggacgggcgcgagatagtggtcccatgtagaaatcaggatgaattggtgggacgggccagggtaagtcaaggcgcaggttggtctctgcgagagactgcttgccttgggaaaagctacgcccagatgtggcagctgatgtattttcaccgtagagacctccgcttagcagccaacgcgatctgttccgctgttcctgtggattgggtccccacctcacggacaacttggagcattcatgcccaccatcaatggatgaccacggaagacatgctgtctgtgtggaatagggtttggatcgaggaaaacccatggatggaggataagacacacgtgtccagttggggagacgtcccctacttgggcaaaagagaggaccagtggtgcggcagcctgattgggctcaccgcacgcgccacttgggcttcgaatatccaggtggccataaaccaggtacggaggcttatcggaaatgaaaactatctggattacatgacatccatgaagcgattcaaaaatgagggtgaccctgaaggcgcactatggtga

SEQ ID NO: 13825 - RNA, 9879 nt, synthetic construct
  misc_feature 1..9879: note = derived and/or modified CDS sequence (opt3) from DENV-1__FJ898391__SS-prME
  source 1..9879: mol_type = other RNA
agcgtgaccatgctgctaatgcttatgcccaccgcactggctttccacttgactacgagaggcggggaacctcatatgatcgtctccaagcaggaaagggggaaatctttactgtttaagacctcagccggtgttaacatgtgcacactaattgcaatggacctcggcgagttctgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaagacgcaaactttgtttgccgccgaacattcgtggatagaggctggggtaatgggtgtggactgtttggcaaaggctccttgataacttgcgctaagttcaagtgcgtaaccaaactcgaggggaagacagtgcagtacgaaaacctgaaatattcagtcattgtgaccgttcacactggagaccagcatcaagtgggtaatgagagtacggaacacggcacaaccgccactatcacaccccaggcgcctagcacagagattcagttaaccgactacggggccctgactctcgattgttctccaaggacaggacttgactttaacgaaatggtcctgttgacgatgaaggagaaatcctggctagtgcataagcagtggttcctggatctcccgctgccctggacctcaggcgcaagcacaagtcaagagacatggaatcggaaagaccttctggtaacctttaagacagctcacgccaagaaacaggaagttgtggtcttgggttctcaggagggggctatgcacactgccctcaccggcgcaacggaaatccaaacctccggaacaactaccatcttcgccggccatctgaagtgccgtttaaaaatggataagctgacactaaaagggatgagctatgtgatgtgtactggatcgttcaagctcgagaaggaagtcgctgagacccagcacggtacggtgctggttcagattaaatacgagggcacagacgcgccttgcaagataccattttctacccaggatgaaaaaggggtgactcaaaacggacgccttatcacagcaaatcccattgtaaccgacaaggagaaacctgtcaacatcgaagccgagccacccttcggcgagtcctatatagtgattggtgctggggaaaaggccttgaagctgtcatggtttaaaaagggcagtagcatcggaaaaatgttcgaggcaactgccagaggcgctaggcggatggccatcctcggggataccgcatgggactttggatccattggtggcgttttcacatctgtggggaagctggtccatcagatctttggaacggcgtacggcgtgcttttcagcggtgtatcatggaccatgaaaattgggataggcgtgctgttgacttggctcggactgaatagtcgatccactagcttatctatgacctgtatcgctgttggcctggtcacactatacctcggggtgatggtgcaggccgattcaggatgcgtcattaactggaagggccgcgaactgaagtgtggtagtgggatctttgttactaatgaggtgcacacctggacggaacagtataaattccaagcagacagcccgaagagactttccgccgctatcggaaaagcctgggaggagggcgtgtgcggtattaggtctgcaacacggttggaaaacataatgtggaagcagatctcgaacgagctgaatcatattctcctggaaaacgacatgaaatttaccgtagtcgtgggcgatgttgctgggatcttagcccagggaaagaaaatgattcgccctcagcccatggagtacaagtatagctggaagtcctggggcaaagcgaagatcataggggccgacgtgcaaaatactaccttcatcattgatggaccaaacacacctgaatgtcccgacgatcagagagcttggaatatctgggaggtcgaggactacggctttggtattttcactaccaacatctggctgaaacttagggattcatatacacaggtgtgcgaccaccgtttgatgagtgcagccataaaggattctaaagctgttcacgccgacatggggtactggattgaaagcgagaagaatgaaacgtggaagctcgcacgggcgtccttcatcgaggtgaaaacctgtatttggccaaagtcacatactctgtggagcaacggagtactagaatctgagatgatcatacccaaaatctatggcggtcctatttcccagcacaattaccgaccaggctactttacacaaaccgccgggccgtggcatctgggaaagctcgagctggatttcgacctttgcgaaggcactacagtcgtggtggatgagcactgcgggaacagaggacccagtttgaggaccacgactgtcaccggcaaaatcattcacgaatggtgttgccgcagctgtacactgcctccattacggtttaagggtgaggacgggtgctggtatggaatggagatcagacccgttaaggaaaaagaggaaaatctcgtgaagtctatggtatccgctggctcaggtgaggtggacagtttcagcctgggccttctgtgtatatcgattatgatcgaagaggtcatgaggtcccgctggtctcgaaaaatgttgatgaccgggactctcgccgtgtttttcctgctaatcatgggacagctgacatggaacgatctcattcggctgtgcatcatggttggcgcaaatgctagcgaccgtatggggatgggaaccacataccttgccttgatggcaacttttaagatgagacctatgttcgccgtgggcctgttatttaggcgcctcacctcacgggaggtcctgcttctgacgattggtctaagtctcgtggcttccgttgaactgccaaactctttggaggaactgggggatggattagcgatgggcataatgatcctcaaactgcttacagacttccagagccatcaactgtgggccaccttgctctccctgacttttattaagaccacattctcactacactatgcatggaagactatggctatggtgctgagcatcgtcagtctttttcccctctgtctgtctaccacgtcccagaaaacaacctggttgccggtactgttaggcagcctcgggtgcaagcctctgactatgttccttattgccgagaataaaatctggggaagaaagtcgtggccactgaacgaaggtataatggccgtgggcatcgtttcaattttgctctctagtctgctcaagaatgatgtgcccctggctgggcctcttatcgcaggaggcatgctcattgcctgttacgtcatctccggtagctctgcggacctgagcttggagaaggctgccgaggtgtcctgggaagaggaagcagagcattcaggggccagtcacaatatattagtagaagtgcaggatgacggaacaatgaaaattaaggatgaggagagggacgataccctgactatcctcctgaaggctacacttctggcagtcagcggcgtttatcccttgtctatcccagccaccctattcgtgtggtacttttggcagaaaaagaaacaacgatccggcgtgctgtgggacacgccttcacccccagaagtcgagcgcgcggtgctcgatgacgggatttatcggataatgcagagaggactgcttggtaggagtcaggttggcgtaggggtgttccaggaaaacgtctttcatactatgtggcacgtgacccgtggagctgttttaatgtaccaaggcaagcgcctggagccgagctgggcctccgtgaaaaaggacctcatctcttacggtgggggatggcggttgcagggctcgtggaatacaggcgaggaagtccaggtgattgcagtagagcctgggaagaaccccaaaaatgtccagaccgccccaggaacattcaagactagcgaaggtgaggtgggcgctatcgccctggattttaaacccgggacctcaggatcccctattgttaacagagaaggcaagatcgtgggtctctatgggaatggagtcgtgacgacaagtggcacttacgtttctgcaatagctcaagccaaagcgagccaggagggcccactgcccgagatcgaagacgaggtgttcaggaagcgaaaccttaccattatggatctgcaccctgggtccggaaagacacggcgctatttgccggccatcgtcagagaagcaattaaaaggaagctacggaccctgatcctcgctccaactcgagtggtagcctcagagatggctgaagcattaaaaggtatgcccataagataccagaccacagccgtgaagtctgagcatacgggcaaagagattgttgacctgatgtgccacgccacttttaccatgcgccttctgagccctgtcagggtgccaaattataacatgatcatcatggatgaagctcatttcacagaccccagttccattgcggcacgtgggtacatcagcacccgggtgggaatgggcgaggccgctgccatatttatgactgcaacacctccgggttctgtcgaagccttcccccaatcaaatgctgtaattcaggatgaggaaagagacatcccagagaggtcctggaacagtgggtatgagtggattaccgattttcctggaaagacggtgtggttcgttcccagcatcaagtcgggcaatgacatagcgaactgtctccgcaaaaatggcaagcgagtgattcagttgtctagaaaaactttcgatacagaataccagaagaccaaaaacaacgactgggactacgtcgtgaccactgatatctccgagatgggggccaattttcgggcagacagggttatcgatccacgccgttgcctgaagcctgtgattctcaaggacggacccgaaagagtcatcctggctggtccaatgccggtgacagtagccagcgcagcccaacggaggggccgcattgggcgaaaccacaataaagagggagatcagtatatatacatgggccagcctcttaacaatgacgaggatcatgctcactggaccgaagccaagatgctactggacaacatcaatacacccgagggtattatcccagcgttgttcgaacccgagagagaaaaatcagcagccatcgatggggagtatcggttaaggggcgaggctcgcaagacttttgtggaactgatgagaaggggagacctccctgtttggctgagttacaaagtcgcctctgagggcttccagtattccgatcggcgttggtgctttgacggggaacgcaacaatcaagtgcttgaggaaaacatggatgtggagatttggacgaaggagggagaacgaaagaaactgagaccaaggtggctcgacgctcggacctacagcgaccccttggcactgcgcgagttcaaagaatttgccgctggtagaaggtcagtcagtggcgatctaatactggagatcgggaaactccctcagcaccttacacagcgggcccagaatgcactggacaacttagttatgttgcataatagcgaacaaggaggccgagcgtatagacacgccatggaggagctgccggatactattgaaaccctcatgctgcttgctctgatcgccgtgctcacaggtggggtaaccttgttctttctgtccggccgcggattaggcaagacttctattgggctactgtgtgtgatggcaagctccgtcctcctttggatggcttcagtggagccacattggatcgccgcatctataatcctggagttctttttgatggttctgctcattcccgagcctgacaggcagcggacgccccaggataaccagctggcctacgtggtcatcggacttctcttcatgattctgaccgtagctgcgaatgagatgggtttgctggaaacaactaaaaaggacttaggcatcgggcacgtggccgttgagaaccaccatcacgcagctatgctagatgtggacctgcatccagccagtgcctggaccctctacgcagtcgctacaaccataattactcctatgatgcgtcacacaatcgaaaacacgaccgccaatatttcgcttactgcgatcgctaaccaagccgcaatactgatgggattggataaaggctggcccatcagcaagatggacattggtgtgccactgctcgccctggggtgctattcccaggtcaatcctcttacattaaccgctgcagtgctgatgctcgttgcccattacgcgatcattggcccgggattgcaggctaaggccaccagagaggcacagaagaggacagccgctggcatcatgaagaaccccactgtggatgggatagtagccattgacctggatccagtggtctatgacgcaaaatttgaaaagcagctaggacagatcatgctgctcatcctttgtacgtctcagattctgttgatgcgcaccacatgggctctgtgcgagtcaatcactctcgccaccggccctctgacaaccttatgggagggtagccccgggaaattctggaatactacgatagcggtttccatggccaacattttccggggaagttaccttgcaggcgctggtctggccttttctctcatgaaaagcctaggcgggggacgaagaggcacaggggcacaaggagaaaccctgggcgagaagtggaaaaggcagttgaatcagctgtcaaagtccgagttcaacacttataaacgcagtggtatcatggaggtggaccggagcgaagctaaggaggggctcaaaagaggagagaccacaaagcacgccgtctctcgtggcactgccaaacttaggtggtttgtggaacggaatctggtaaaaccagagggtaaggtgattgatttgggctgtgggcgcggaggctggtcctactattgcgcggggctgaaaaaggttaccgaagtgaaaggatacacaaagggcggtcctgggcacgaggaacccatcccgatggctacgtacggatggaacctcgtcaaattacattcaggcaaggacgtgttctttataccacctgagaagtgtgataccctgctttgcgacatcggcgagagctcgcccaatccaactattgaagaggggcgaacactgagagtcctaaaaatggtggaaccctggctcaggggaaaccagttctgtatcaagattctgaatccttatatgccgtctgttgtagagaccttggagcaaatgcagcggaaacacggtggcatgctggtgcgcaaccccctcagtagaaattccactcatgaaatgtactgggtcagctgcgggacaggaaacatcgtgtcagcagttaatatgacctccaggatgcttctgaaccgatttacgatggcccaccggaagccaacctatgagcgtgatgtggacttaggcgctggtacaagacacgtcgccgtggaacctgaggtagcaaacctggatattatcgggcagcgcatagaaaatattaaacatgagcacaagtctacttggcattacgacgaggataacccctataagacctgggcctaccacggaagctatgaagtgaaacctagtggctccgctagctctatggttaatggcgtcgtgaagttgctcacaaaaccatgggacgtgatccccatggtcactcagatcgcgatgaccgatacaacccctttcgggcaacagagggtttttaaggagaaagtggacactcggacgccaaaggccaagagaggaacagcacagattatggaagtaaccgctaaatggctgtggggtttcctatcacgcaacaagaaacccaggatatgtactcgagaggaatttacccggaaggtgagaagtaatgccgcaatcggcgccgtcttcgtggacgagaaccaatggaactccgctaaagaggccgttgaagatgagaggttttgggaccttgtgcatcgcgaacgtgagctgcacaagcaggggaagtgcgcgacatgcgtctacaacatgatgggaaaacgggaaaagaaactcggcgagttcggtaaggcaaaagggagcagagccatttggtacatgtggctgggagctaggttcttggagtttgaagccctgggcttcatgaatgaggatcactggttttctcgcgaaaactcgctctcaggcgtggagggggagggacttcataagctgggttatatcttacgagacattagcaaaatcccgggcgggaatatgtacgcagatgacacggctggatgggatacccggataactgaagacgatctgcagaacgaggccaagatcacagacattatggaacctgagcacgctttgctcgccaagtccatcttcaaactgacctatcagaataaggtagttagagtgcaaaggccagccaagaacggcactgtcatggatgtgattagtcgcagagaccagcggggttctggacaggtgggaacatacggcctaaatacctttacaaacatggaagcgcagcttatcaggcaaatggagagcgagggcatattctccccctcagaactggagactcctaacctcgccgggcgtgtcctggattggttggaaaagcatggagttgagcgattaaaacgcatggctattagtggtgacgactgtgtggtaaagccaatcgatgacagatttgccaccgcactgacggctctcaatgatatgggcaaggtgcggaaagacatcccccagtgggaaccgtctaaggggtggaacgattggcagcaggtccctttctgcagccaccactttcatcaacttattatgaaagacggaagggagatagtggttccctgtcgcaatcaggatgagctggtgggcagagcccgggtctcccagggtgcagggtggtcactaagggaaaccgcctgcctgggaaagagctatgcgcagatgtggcaactcatgtacttccaccgacgtgacttgagactggctgccaacgcaatctgttctgccgtgccagtagattgggttcctacatcccgcactacctggagtattcatgctcaccatcagtggatgacaactgaggacatgcttagcgtgtggaatcgggtctggatcgaagagaacccctggatggaagataaaacccacatttcgtcctggggcgacgtgccatatctgggcaagagggaggaccagtggtgcgggtctctcatcggattaacggccagagcaacatgggctaccaatatacaagttgccatcaaccaggtgcgccggctgattggtaatgagaactacttggattacatgacttcaatgaagaggtttaaaaatgaaagcgaccccgagggcgcgctgtggtga

SEQ ID NO: 13826 - RNA, 9879 nt, synthetic construct
  misc_feature 1..9879: note = derived and/or modified CDS sequence (opt3) from DENV-1__FJ898392__SS-prME
  source 1..9879: mol_type = other RNA
agcgtgaccatgctgctcatgcttatgcccaccgcactggctttccacttgactacgaggggaggggaacctcatatgatcgtcaccaagcaggaaaggggaaaatccttactgtttaagacatctgccggtgttaatatgtgcactctgattgccatggacctcggcgaactgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggatcgttcaaactggagaaggaagtggctgagacccagcacggtacggtccttgtgcagataaagtacgagggcacagacgcgccttgcaaaatcccattctcgacccaagatgaaaagggggttactcagaacggacgcttgattacagcaaatcccatcgtgaccgacaaagagaagcctgtaaacatagaagccgagccaccctttggcgagtcttatattgtcatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtgtttacatccgttgggaaacttgtgcatcagattttcggaacggcgtacggcgtcctgttttctggtgtgagctggaccatgaagatagggatcggcgtattgctcacttggctgggattaaattcacgaagtacatccctgagcatgacctgtattgctgtgggcctagttacactctacctgggggtcatggtgcaggccgattctggatgcgtgatcaactggaaaggccgcgaacttaagtgtggttcagggatcttcgtcactaatgaggttcacacctggacggaacaatataagtttcaggcagacagtccgaaaagattgagcgccgctattggaaaggcctgggaggagggcgtgtgcggtataaggtccgcaacacggctggaaaacatcatgtggaaacagatttctaacgagctcaatcatatcctgttagaaaacggcatgaagttcaccgtggtagtcggggacgtggttggcattctggctcagggcaaaaagatgatccgccctcaacccatggagcacaaatactcgtggaaaagctgggggaaggccaagataatcggagcggatgtgcagaatactacctttattatcgacggcccaaacacacctgaatgtcccgatgaccagagagcctggaatatttgggaggtcgaggattatggtttcgggatctttactaccaacatatggcttaagttgagggactcctacacacaggtgtgcgatcaccgtctcatgtcagctgcaattaaagacagtaaggccgttcatgctgatatgggatattggatcgaatctgagaaaaatgaaacgtggaagctggcccgggcatccttcattgaggtgaagacctgtatctggccaaaatcccacactctatggtcaaacggcgtactggaaagcgagatgataatccccaagatttacggtggccctatctctcaacataattatcgaccagggtacttcacacagaccgcgggaccgtggcacctcggcaaactggagcttgactttgatttgtgcgaagggactacagtcgtggtggacgagcactgcggaaacagaggcccctccctgaggaccacgactgtcaccggtaagattatccatgaatggtgttgccgcagttgtacattacctccactccggttcaaaggggaggatggatgctggtacggcatggagataagacccgttaaggaaaaggaggaaaatctggtgaaaagcatggtatctgccggttccggcgaggtggactcatttagtcttgggctgttgtgtaccagcattatgatcgaagaggtcatgaggtcgcgctggtcccgaaagatgctcatgactggaacactggctgtgttcctactgctcatcatgggccagctgacctggaacgaccttattcggttgtgcatcatggttggggccaatgcatctgatcgtatgggaatgggcacaacttatctggctttaatggccacctttaaaatgagacctatgttcgcagtgggtctcctgtttaggcgccttacgagccgggaggtcctgctactcacaattgggctgtcattggtggccagtgttgaactgccaaactccttagaggaactcggagacggcctggctatgggcataatgatccttaagctgttgaccgatttccaatctcaccagctctgggcgactctgctaagcctgacctttattaaaacaactctttccctccattacgcctggaagaccatggcaatggtgctgtcaatcgtcagcttgttccccctgtgtttaagtacgacatctcagaagaccacttggctcccggtactgcttgggtccctgggatgcaaacctttgacaatgtttctcattgctgagaataagatctggggtagaaaaagctggccactgaacgaaggcataatggccgtgggggttgtgtcgatcctactgtcatctcttctcaagaacgacgtccccctggccggacctttgattgctggcggtatgttaatcgcatgttatgtgattagtgggtccagcgccgatctgtctctcgagaaagcggctgaggtaagctgggaagaggaagccgagcactccggagcatcacataatatcctggtggaagtccaggacgatggcaccatgaagataaaagacgaggagagggatgacactcttacaattctgttgaaggccaccctactggctgttagtggcgtgtaccccctcagcatcccagcaacgctgttcgtgtggtatttttggcaaaagaaaaagcagcgatctggggtcctttgggatactccttcacccccagaagtggagcgcgccgttttagacgatggaatctaccggattatgcagagaggtctgctcggcaggagccaggtaggggtgggagtcttccaagaaaacgtgttccacaccatgtggcacgttacacgtggcgcggtgttgatgtatcagggtaaacgcctggagccgagttgggctagcgtcaagaaagacctcatatcctacgggggaggctggcggctgcagggctcttggaataccggggaggaagtgcaggtaatcgccgtcgagcctggaaagaaccccaagaatgtgcaaacagcaccaggtacttttaaaacccccgaaggcgaggttggggccattgctcttgacttcaagcctggaacgtcgggcagcccaatcgtgaacagagaaggtaaaattgtcgggctgtacggaaatggcgtggttacaacttcaggcacctatgtgtccgccatcgcacaggctaaggccagtcaggaggggcccttgcctgagatagaagatgaggtctttaggaaacgaaacctaacaatcatggacctgcatccgggatctggtaagacccggcgctacctcccagcgattgtgagagaagccatcaagaggaaattacggactctgattcttgcacccacccgagtagtggctagcgagatggccgaagctctgaagggcatgcctatcagatatcaaacaacggcagttaaatccgagcacactgggaaggagatagtcgatctcatgtgccatgccaccttcacaatgcgcttgctgtcaccagtgagggtgcccaattacaacatgattatcatggacgaagcccactttaccgatccttctagcatcgctgcgcgtggatatattagtactcgggtcggcatgggtgaggcagccgctatcttcatgacagccaccccgcccgggtccgtagaagcatttccacagagcaatgccgtgatacaggacgaggaaagagatattcctgagaggtcttggaactcaggatacgagtggatcacggacttccccggcaaaactgtttggtttgtgccatccattaagagtggcaatgatatcgctaactgtctccgcaagaatgggaaacgagtcatacagctgagcagaaagacattcgacaccgaatatcagaaaaccaagaacaacgattgggactacgtggttactacagacatttcggagatgggagcgaattttcgggccgatagggtgatcgaccctcgccgttgccttaaacccgtcatcctaaaggatggtccagaaagagtgattctggcaggcccgatgcctgtaaccgtggcttctgccgcacagcggagggggcgcatcggacgaaaccataataaggagggcgaccagtacatttatatgggtcagcccttgaacaatgatgaggaccacgcccactggacagaagctaaaatgttactggataacataaatactccagaggggatcattcccgccctcttcgaacctgagagagaaaagtccgcggcaatcgacggcgagtaccggctgaggggagaggcccgcaaaacgttcgttgaacttatgagaaggggcgatctgccagtctggctcagctataaggtggcttcagaggggtttcaatacagtgaccggcgttggtgcttcgatggagaacgcaacaatcaggtgttggaggaaaacatggacgtcgagatctggaccaaagagggtgaacgaaagaaactgagacccaggtggctagatgcccggacatattctgaccctctggctctccgcgagtttaaggagttcgcagccggcagaaggtccgttagcggggaccttattctggagataggaaagttaccgcagcatttgactcagcgggctcaaaatgccctggataacctcgtgatgctgcacaattcagaacagggcggtcgagcatacagacatgcgatggaggagcttccagacaccatcgaaacactgatgctcttggccctgattgctgtattaaccgggggcgtgactctatttttcctgagtggacgcggcctcgggaaaacgagcatcggacttctgtgtgtcatggcctcctctgtgttgctgtggatggcaagcgttgagccccactggattgctgcctccatcatactcgaatttttcctgatggtgcttctcatccctgagcccgataggcagcggaccccacaggacaaccaactggcatatgtcgtaattggtttgctgtttatcattttaacagtggccgctaatgagatgggcctactggaaactaccaagaaagatctcgggatcggacacgttgcggtggagaaccatcaccatgccacaatgcttgacgtcgatctgcaccctgcatcagcttggaccttgtacgccgtggccactacaataattacgcccatgatgcgtcataccatcgaaaacactacagcaaatatttctctgaccgctatcgccaaccaggcggctatactcatgggcctggacaagggttggccaatcagtaaaatggatattggggtccctcttttagccctgggctgctacagccaggtgaatccgctcaccttgacagcagccgttctgatgctagtggctcactatgcaatcattggacccggcctgcaagccaaggcgactagagaggctcagaagaggacggccgcagggatcatgaaaaacccaaccgtagacggaatagtggccattgatctcgaccctgtcgtttacgatgctaagttcgaaaaacagcttggccagatcatgctgttgatcctgtgtacaagccaaattctcctgatgcgcactacctgggccttatgcgagtccatcacacttgcaaccggtcccctgactacgctctgggaggggtctccaggaaagttttggaatacaaccatagctgtgtcaatggccaacattttccggggcagctatctagcgggtgccggcctggcattttccttgatgaaaagtctagggggaggccgaagagggactggagctcagggcgaaaccctcggtgagaagtggaagaggcagcttaatcagctgtctaaaagcgagttcaacatctacaagcgctcagggattatggaggtcgaccggtccgaagccaaagagggattgaagagaggcgagacaactcgtcacgcagtgagtaggggtaccgctaaactgcggtggttcgtagaacgcaatctcgtgaagcctgagggcaaggttatcgacttagggtgtggacgaggcgggtggagctattactgcgccggactgaaaaaggtgacagaagtcaaaggctatacgaagggtgggcccggacatgaggaaccgataccaatggccacctacggctggaaccttgtgaaactgcactctggcaaggatgtctttttcactcctcccgagaaatgtgacacactactctgcgatatcggggagtcctcaccaaatcccaccattgaagagggaagaactctgagggtgttgaagatggttgaaccttggctgcggggtaaccaattttgtatcaagattctcaatccgtacatgcccagcgtagtggagacacttgagcagatgcagcgcaaacatggcgggatgctggtcagaaacccattatcgagaaattctacccacgaaatgtattgggtgagttgcggaacgggcaacatcgtttccgcggtgaatatgaccagccgaatgctgttgaaccggttcacaatggctcaccgtaagcctacttacgagagagacgtcgatctcggtgcagggacccgccatgtggccgtagaacccgaggtggctaacctggacattatcggacagaggatagaaaatattaaacacgagcataagtcaacatggcactatgatgaggacaacccttacaaaacttgggcctatcatggctcctacgaagttaagccatctggcagcgcaagttccatggtcaatggggtggtgaagctacttaccaaaccctgggatgtcatccctatggttacacaaatcgccatgaccgacactacgccatttggacagcagcgggtgttcaaggagaaagtagatacaagaacccccaaggctaaacgcggtactgcgcaaattatggaagtgaccgccaggtggctgtggggctttctcagccgaaacaagaagccgcggatatgtacaagagaggagttcacgaggaaagtccgctctaatgcagctatcggggccgtgtttgttgacgagaaccagtggaactcagcaaaggaggccgtggaagacgagcgtttctgggatctggtccagaaagaacgggagttgcacaagcagggaaaatgcgctacctgcgtgtataacatgatgggcaagagagaaaagaaactgggtgagtttgggaaggccaaaggaagtagggcgatttggtacatgtggctcggcgcacgcttccttgagtttgaagccctgggcttcatgaatgaggaccactggttctcccgagaaaacagcttatctggggtagagggagagggtctgcataagttgggctacatcctccgggatatttcgaaaatccctgggggaaatatgtatgctgacgatactgccggctgggacacaagaataaccgaagatgacctgcaaaacgaggcaaagatcactgatattatggaaccagagcacgctctacttgccacatcaatctttaaactgacctaccagaataaggttgtgagggtccagcgccccgctaagaacggtacagtgatggacgtgattagcagacgggatcagagggggtccggacaagtcggcacttatggcctcaataccttcacgaacatggaagcccagctgatccgtcagatggagagtgaggggatatttttgccttctgaattagagaccccaaacctggcagaacgagttctcgactggcttgagaaatacggagtggaacgcctgaagagaatggcgattagcggtgatgactgtgtagtgaaacccatcgacgatcggttcgccacagctctaactgccctgaatgacatgggcaaggtcaggaaagatatcccgcagtgggagccttccaaggggtggaacgactggcaacaggtgcccttttgctcacatcacttccaccagctcattatgaaggatggacgcgagatagttgtgccatgtagaaatcaggacgaattggtcggccgggcaagggtgagtcaaggtgctgggtggtctctgcgagagaccgcctgccttggaaaaagctatgcacagatgtggcagctgatgtactttcatcgtagagatctccgcttagccgcgaacgctatctgttccgccgtacctgttgactgggtgcccacatcacggactacctggagcattcacgcacatcaccaatggatgacgacagaagatatgctgtctgtctggaatagggtgtggatcgaggaaaacccatggatggaggacaagacccatgtttccagttggggcgatgtgccctatttgggcaaaagagaggaccagtggtgcgggagcctgattggactcactgcccgcgctacatgggcctcgaatatccaggtcgcaataaaccaggtgcggaggcttatcggtaatgaaaactacctggactacatgacctccatgaagcgattcaaaaatgagggcgatcctgaaggggctctatggtga

SEQ ID NO: 13827 - RNA, 9879 nt, synthetic construct
  misc_feature 1..9879: note = derived and/or modified CDS sequence (opt3) from DENV-1__FJ898393__SS-prME
  source 1..9879: mol_type = other RNA
agcgtgaccatgctgctcatgcttatgcccacagcactggctttccacttgactacgagaggcggggagcctcatatgatcgtcaccaagcaggaaaggggaaaatccttactgtttaagacatctgccggtgttaatatgtgcactctaattgccatggacctcggcgagctgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaggaacaggacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactgggagcttcaaactggagaaggaagtggctgagacccagcacggtacggtccttgtgcagataaagtacgagggcacagacgcgccttgcaaaatcccattctcgacccaagatgaaaagggggttactcagaacggacgcttgattacagcaaatcccatcgtgaccgacaaagagaagcctgtaaacatagaagccgagccaccctttggcgagtcttatattgtcatcggtgctggggaaaaagccctgaagctctcctggttcaagaaaggctcaagtatcggaaagatgtttgaggcaactgccagaggcgctaggcggatggccattctgggggataccgcatgggacttcggaagcgtgggtggcgtttttacatccgtggggaaacttgtccatcagatcttcggaacggcgtacggcgtgctgttttctggtgtaagctggaccatgaagattgggataggcgtgttgctcacttggctgggattaaattcacgaagtacatccctgagcatgacctgtatcgctgttggcctagtcacactctacctgggggtgatggtgcaggccgattctggatgcgtcattaactggaaaggccgcgaacttaagtgtggttcagggatcttcgttactaatgaggtgcacacctggacggaacaatataagtttcaggcagacagtccgaaaagattgagcgccgctatcggaagggcctgggaggagggcgtgtgcggtattcggtccgcaacacgcctggaaaacataatgtggaagcagatctctaacgagctcaatcatattctgttagaaaacgacatgaaattcaccgtagtcgtgggcgatgttgtggggatcctggctcagggaaagaaaatgattagacctcaacccatggagcacaagtactcgtggaaaagctggggcaaggccaagatcataggggcggacgtccagaatactacctttatcattgatggaccaaacacacctgaatgtcccgacgatcagagggcctggaatatctgggaggtggaggactatggcttcggtatttttactaccaacatctggcttaaattgcgtgattcctacacacaggtttgcgaccaccggctcatgtcagctgcaataaaggatagtaaagccgtgcatgctgacatggggtattggattgaatctgagaagaatgaaacgtggaaactggcccgagcatccttcatcgaggtaaagacctgtatttggccaaagtcccacactctatggtcaaacggagtcctggaaagcgagatgatcatacccaaaatctacggcggtcctatttctcaacataattatagaccaggctacttcacacagaccgcggggccgtggcacctcggaaagctggagcttgattttgacttgtgcgaaggcactacagtggtggtcgatgagcactgcgggaacaggggaccctccctgcgcaccacgactgttaccggcaaaatcattcatgaatggtgttgccggagttgtacattacctccactcagattcaagggtgaggacgggtgctggtacggaatggagatcaggcccgtgaaagaaaaggaggaaaatctggtaaagagcatggtgtctgccggctccggtgaggtcgactcatttagtcttggcctgttgtgtataagcattatgatcgaagaggtgatgcgctcgcgatggtcccggaaaatgctcatgaccgggactctggctgttttcctactgctcatcatgggacagctgacatggaacgatcttattcgtttgtgcatcatggtgggcgccaatgcatctgacagaatggggatgggaaccacatatctggctttaatggccacttttaagatgaggcctatgttcgcagtcggcctcctgtttcgccggcttaccagcagagaggtgctgctactcacgattggtctgtcattggttgccagtgtggaactgccaaactccttagaggaactcggggatggactggctatgggcataatgatccttaaactgttgacagacttccaatctcaccagctctgggcgaccctgctaagcctgacttttattaagaccacactttccctccattacgcctggaaaactatggcaatggtcctgtcaatcgctagcttgttccccctgtgtttaagtaccacgtctcagaagacaacctggctcccggtactgcttggctccctggggtgcaagcctttgactatgtttctcattacagagaccaaaatctggggaagaaagagctggccactgaatgaaggtataatggccgtgggcgttgtgtcgatcctactgtcatctcttctcaaaaacgatgtccccctggccgggcctttgattgctggaggcatgttaatcgcatgttatgtgattagtggttccagcgccgacctgtctctcgagaaggcggctgaggtaagctgggaagaggaagccgagcactccggggcatcacataacatcctggtggtcgttcaggatgacggaactatgaaaataaaggatgaggaacgagacgatacacttaccattctgttgaaagccacgctactggctgtgagtggcgtgtaccccctcagcatcccagcaactctgttcgtctggtatttttggcaaaagaagaaacagcgctctggcgtgctttgggacaccccttcacccccagaggttgaacgggccgtattagatgacgggatctacagaattatgcagaggggactgctcggtcgtagccaggtgggcgtcggggtgttccaagagaatgttttccacacaatgtggcacgtgacccgcggagcggtcttgatgtatcagggcaagcggctggaaccgagttgggctagcgtgaaaaaggacctcatatcctacggtgggggatggagactgcagggctcttggaacacaggcgaggaggtacaggtcatcgccgtggaacctgggaaaaatcccaagaacgttcaaactgcaccaggaacctttaagacgcccgagggtgaagtgggcgccattgctcttgatttcaaacctgggacatcgggaagcccaatcgtcaatagggagggcaagattgtgggtctgtacgggaacggagttgtgactacctcaggcacatatgtctccgccatcgcacaggctaaagccagtcaggaaggccccttgcctgagatagaggacgaagtgtttcgaaagcggaatctaaccatcatggatctgcatccggggtctggaaaaactcgcagatacctcccagcgattgtaagggaggccatcaagcggaagttacgaaccctgattcttgcacccacaagagtggttgctagcgaaatggccgaggctctgaaaggtatgcctatccgctatcaaacgactgcagtcaagtccgaacacaccggcaaagagatagtggacctcatgtgccatgccacattcaccatgaggttgctgtcaccagtgcgtgtccccaactacaatatgattatcatggatgaggcccactttactgacccttctagcatcgctgcgcgggggtatattagtacaagagtaggaatgggcgaagcagccgctatcttcatgaccgccacgccgcccggttccgtggaggcatttccacagagcaacgccgttatacaggatgaagagagggacattcctgaacgctcttggaactcagggtacgagtggatcactgatttccccggaaagacagtgtggtttgtcccatccattaaaagtggcaacgacatcgctaattgtctccgaaagaacggcaagagagtgatacagctgagccggaaaaccttcgataccgagtatcaaaagactaaaaataacgactgggactacgttgtgacaaccgatatttcggaaatgggggcgaactttagggccgaccgcgtcatcgatcctcgtagatgccttaagcccgtgatcctaaaagacggaccagagcgggtaattctggcaggtccgatgcctgtgacagttgcttctgccgcacagaggcgcggccgaatcgggagaaatcataacaaggaaggagatcagtacatttatatgggccagcccttgaataacgacgaggatcacgcccactggactgaggctaagatgttactggacaatataaacacgccagaaggtatcattcccgccctcttcgagcctgaacgggagaaatccgcggcaatcgatggggaatacaggctgcgcggcgaggccagaaagaccttcgtcgagcttatgaggcggggagacctgccagtgtggctcagctataaagtggcttcagaaggctttcaatacagtgatcgtcgctggtgcttcgacggggagcgaaataaccaggtcttggaagagaatatggatgttgaaatctggacaaaggagggagagaggaaaaagctgaggccccggtggctagacgcccgcacttattctgaccctctggctctcagagaatttaaagagttcgcagccggtaggcggtccgtgagcggcgatcttattctggaaatagggaagttaccgcagcatttgacccagcgagctcaaaacgccctggacaatctcgtaatgctgcacaactcagagcagggaggcagagcataccgccatgcgatggaggaacttccagatacaatcgagaccctgatgctcttggccctgattgctgtgttaactggtggggtcacgctatttttcctgagtggcaggggactcggcaagaccagcatcgggcttctgtgtgtgatggcctcctctgttttgctgtggatggcaagcgtggaaccccactggattgctgcctccatcatactcgagtttttcctgatggtccttctcatccctgaacccgaccggcagcgtacaccacaggataatcaactggcatatgtagtgattggattgctgtttatgatcttaactgttgccgctaacgagatgggtctactggagaccaccaaaaaggacctcggcattgggcacgtggcggtcgaaaatcatcaccatgccaccatgcttgatgtggacctgcaccctgcatcagcttggactttgtacgccgtcgccacaacgatcataacccccatgatgagacatactattgagaacacaaccgcaaacatctctctgaccgctattgccaatcaggcggctatcctcatgggactggataaaggctggccaataagtaagatggacatcggtgtgcctcttttagccctggggtgctactcgcaggttaacccgctcacattgactgcagccgtgctgatgctagtagctcactatgcaattatcggccccggactgcaagccaaagcgacgagggaagctcagaagcgcaccgccgcaggcattatgaagaatccaacagtggatgggatcgtcgccatagacctcgatcctgttgtgtacgacgctaaattcgagaagcagcttggacagattatgctgttgatcctgtgtactagccaaatcctcctgatgcggaccacatgggccttatgcgaatccattacccttgcaactggccccctgacgacactctgggagggttctccagggaaattttggaacaccactatcgctgtctcaatggccaatatattccgaggaagctatctagcgggcgccggtctggcattttccttgatgaagagtctgggcgggggaagaaggggcaccggggctcagggagagacactcggcgaaaaatggaagcgccagcttaaccagctgtctaagagcgagttcaatatttacaaacggtcaggtatcatggaagtggacagatccgaggccaaggaagggttgaaacgtggagagactaccaggcacgcagtaagtcggggcacagctaagctgcgctggttcgtggagcgaaacctcgttaaacctgaaggtaaggtgattgatttaggctgtgggagaggaggctggagctattactgcgccgggctgaagaaagtcacggaggtgaagggatataccaaaggcggtcccgggcatgaggaaccgatcccaatggccacttacggatggaatcttgtcaagctgcactctggcaaagacgtgtttttcacacctcccgaaaagtgtgataccctactctgcgacataggcgagtcctcaccaaaccccactatcgaggaagggaggacactgcgggttttgaaaatggtagagccttggctgcgcggaaatcaattttgtattaagatcctcaacccgtacatgcccagcgtggtcgaaacccttgagcagatgcagagaaagcatggtggcatgctggtgaggaatccattatcgcgaaactctacgcacgagatgtattgggttagttgcgggaccggaaatattgtgtccgcggtcaacatgacaagccggatgctgttgaatcgtttcactatggctcacagaaaacctacctacgaacgcgatgtggacctcggcgcaggtacaaggcatgtagccgtggagcccgaagttgctaacctggatatcattgggcagcggatcgagaacataaagcacgaacataaatcaacttggcactatgacgaggataatccttacaagacctgggcctatcatggatcctacgaggtcaaaccatctggcagcgcaagttccatggtgaacggcgtggtcaagctacttacaaagccctgggacgttattcctatggtgacccaaatcgccatgactgatacgacaccatttgggcagcagagagtattcaaagaaaaggtggacacccgcactcccaaagctaagaggggaaccgcgcaaatcatggaggtcacagcccgatggctgtggggttttctcagccggaataaaaagccgagaatttgtacgagggaagagttcacccgcaaggtgcgttctaacgcagctataggcgccgtttttgtggacgaaaatcagtggaactcagcaaaagaggccgtcgaggatgaacggttctgggacctggtgcagaaggagagagaattgcacaaacaggggaagtgcgctacttgcgtatataatatgatgggaaaaagggagaagaagctgggcgaatttggtaaagccaaggggagtcgcgcgatctggtacatgtggctcggagcacgattccttgagtttgaggccctgggcttcatgaacgaagatcactggttctcccgggagaatagcttatctggcgttgaaggggagggactgcataaattgggttacattctcagagacatctcgaagattcctggcgggaacatgtatgctgatgacacagccggatgggataccaggatcactgaggacgatctgcaaaatgaagcaaaaataacagacatcatggagccagaacacgctctacttgccacctcaatttttaagctgacataccagaacaaagtggtccgcgtgcagagacccgctaagaatggcactgtgatggatgtcatcagccggagggaccagcgtggttccgggcaagttggaacctatggcctcaacacgttcaccaatatggaggcccagctgattcgacagatggaaagtgagggcatctttttgccttctgagttagaaacaccaaacctggcagagcgcgtgctcgattggcttgaaaagtacggggtagagagactgaaacggatggcgataagcggagacgactgtgtggtcaagcccattgatgacaggttcgccactgctctaaccgccctgaacgatatgggtaaagtgcgcaaggacatcccgcagtgggaaccttccaaaggctggaatgattggcaacaggttcccttttgctcacatcacttccaccagctcatcatgaaggacgggagagagattgtggtcccatgtcggaaccaggatgagttggtgggaagggcacgagtaagtcaaggcgctggttggtctctgcgtgaaacagcctgccttggaaagagctatgcacagatgtggcagctgatgtactttcatagacgcgacctccggttagccgcgaatgctatatgttccgccgttcctgtggattgggtccccacttcaaggaccacgtggagcatccacgcacatcaccaatggatgacaaccgaggacatgctgtctgtgtggaacagagtttggattgaagagaatccatggatggaagataaaactcatgtgtccagttggggagacgtcccctatttgggcaagcgcgaggaccagtggtgcggcagcctgatcgggctcacagcccgggctacctgggcctcgaacattcaggtggcaatcaatcaggtaaggcgacttataggaaacgagaattacctggattacatgacttccatgaaaagattcaagaacgaaggtgaccctgagggcgctctatggtga

SEQ ID NO: 13828 - RNA, 9879 nt, synthetic construct
  misc_feature 1..9879: note = derived and/or modified CDS sequence (opt3) from DENV-1__FJ898394__SS-prME
  source 1..9879: mol_type = other RNA
agcgtgaccatgctgctcatgcttatgcccacagccctggctttccacttgactacgagaggcggggagcctcatatgatcgtcaccaagcaggaaaggggaaaatccttactgtttaagacatctgcaggtgttaacatgtgcactctaattgccatggacctcggcgagctgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagagcaggacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattaccccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactcctcaagagacatggaatcggcaggacctgttggtgaccttcaaaacagctcacgccaagaagcaggaagtagttgtgctcggtagccaagagggggctatgcacactgccctgaccggcgcaacggaaatccagaccagtggaacaactaccatttttgccggccatttaaaatgccgtctgaagatggataaactaacactcaaggggatgtcttatgtcatgtgtactggatccttcaaactggagaaggaagtggctgagacccagcacggtacggtccttgtgcagataaagtacgagggcacagacgcgccatgcaaaatccccttcagcacccaagatgaaaagggggttactcagaacggacgcttgattacagcaaatcctatcgtgaccgacaaagagaagccagtaaacatagaagccgagcccccgtttggcgagtcgtatattgtcatcggtgctggggaaaaagccctgaagctctcttggttcaagaaaggctcctcaatcggaaagatgtttgaggcaactgccagaggcgctaggcggatggccattctgggggataccgcatgggacttcggaagtatcggtggcgtgtttacaagcgttgggaaacttgtgcatcagattttcggaacggcgtacggcgtcctgttttccggtgtgtcttggaccatgaagatagggatcggcgtattgctcacttggctgggattaaatagccgatcaacaagtctgtccatgacctgtattgctgtgggcctagttacactctacctgggggtcatggtgcaggccgatagcggatgcgtgatcaactggaaaggccgcgaacttaagtgtggttctgggatcttcgtcactaatgaggttcacacctggacggaacaatataagtttcaggcagactcacctaaaagattgagtgccgctattggaaaggcctgggaggagggcgtgtgcggtataaggagcgcaacacggctggaaaacatcatgtggaaacagatttccaacgagctcaatcatatcctgttagaaaacgacatgaagttcaccgtggtagtcggcgatgtggttgggattctggctcagggaaaaaagatgatccgcccccaaccaatggagcacaaatactcttggaagtcgtggggcaaggccaaaataatcggggcggacgtgcagaatactacctttattatcgatggacctaacacacccgaatgtccagacgatcagagagcctggaatatttgggaggtcgaggactatggcttcggtatctttactaccaacatatggcttaagttgagggatagctacacacaggtgtgcgaccaccgtctcatgtccgctgcaattaaagattcaaaggccgttcatgctgacatggggtattggatcgaaagtgagaaaaatgaaacgtggaagctggcccgggcatctttcattgaggtgaagacctgtatctggcccaaaagccacactctatggtccaacggagtactggaatcagagatgataatccctaagatttacggcggtccaatcagccaacataattatcgaccgggctacttcacacagaccgcggggccctggcacctcggaaaactggagcttgattttgacttgtgcgaaggcactacagtcgtggtggatgagcactgcgggaacagaggaccttctctgaggaccacgactgtcaccggcaagattatccatgaatggtgttgccgctcctgtacattaccacccctccggttcaaaggtgaggacgggtgctggtacggaatggagataagacctgttaaggaaaaggaggaaaatctggtgaaaagtatggtaagcgccggctctggtgaggtggactccttttcacttggcctgttgtgtattagtatcatgatcgaagaggtcatgaggagccgctggtcgcgaaagatgctcatgaccgggactctggctgtgttcctactgctcattatgggacagctgacatggaacgatcttatccggttgtgcattatggttggcgccaatgtgtccgaccgtatggggatgggaaccacatatctggcattaatggctacttttaaaatgagaccaatgttcgccgtcggcctcctgtttaggcgccttacctctcgggaggtgctgctactcacgataggtctgagcttggttgcatcagtggaactgcccaacagtttagaggaactcggggatggactggccatgggcatcatgattcttaagctgttgacagacttccaatcccaccagctctgggctaccctgctatctctgacttttatcaaaaccacacttagcctccattacgcgtggaagactatggccatggtcctgtccattgtatcattgttcccgctgtgtttaagcaccacgagtcagaagacaacctggctccctgtgctgcttggctctctggggtgcaaaccattgactatgtttctcatcgcagagaataagatatggggaagaaaatcctggcccctgaacgaaggtatcatggctgttggcgtggtcagcattctactgtcgtcacttctcaagaacgatgtgcctctggccgggcccttgatcgccggaggcatgttaattgcttgttatgtaatctctggtagttccgcagacctgagcctcgagaaagccgcggaggtgtcttgggaagaggaagctgagcacagcggggcctcccataatatactggtcgaagttcaggatgacggaacaatgaagattaaagatgaggagagggacgatacccttactatcctgttgaaggcaacactactggccgtgtcaggcgtgtacccactcagtatccctgctaccctgttcgtctggtatttttggcaaaagaaaaagcagcgaagcggcgtgctttgggacacgccctctccaccggaagttgagcgcgcagtattagatgacgggatttaccggataatgcagagaggactgctcggtaggtcccaggtgggcgtcggggtgttccaagaaaacgttttccacactatgtggcacgtgacccgtggagccgtcttgatgtatcagggcaaacgcctggagccttcatgggcgagtgtgaagaaagacctcatcagctacggtgggggatggcggctgcagggctcctggaatacaggcgaggaagtacaggtcattgctgtggagcccgggaagaacccaaagaatgttcaaaccgcccccggaacatttaaaactcctgaaggtgaggtgggcgcaatcgcccttgatttcaagccagggacctctggatcgcccattgtcaacagagaaggcaaaatcgtgggtctgtacgggaatggagttgtgacgacaagcggcacttatgtctcagctatagcccaggcaaaggcttcccaggagggccctttgccggagatcgaagacgaggtgtttaggaaacgaaacctaaccattatggatctgcatccagggagtggaaagacacggcgctacctccccgccatcgtaagagaagcgattaagaggaaattacggaccctgatccttgcccctactcgagtggttgcatctgagatggctgaagccctgaagggtatgccaataagatatcaaaccacagctgtcaaaagcgagcacacgggcaaggagattgtggacctcatgtgccatgcaactttcaccatgcgcttgctgtcccccgtgagggtccctaattacaacatgatcatcatggatgaagcccactttacagacccgtcatctattgccgctcgtgggtatatcagcacccgggtaggaatgggcgaggcggcagccatattcatgactgctacacccccaggtagtgtggaagcctttcctcagtccaatgcagttattcaggatgaggaaagagacatccccgagaggagctggaactctgggtacgagtggattaccgatttcccaggaaaaacggtgtggtttgtcccttcaatcaagtccggcaatgacatagccaactgtctccgcaagaatggcaaacgagtgattcagctgagtagaaagactttcgatacagaatatcaaaaaaccaagaacaacgactgggactacgttgtgaccactgatatcagcgagatgggggctaattttcgggcggacagggtcatcgatccccgccgttgccttaaaccagtgattctaaaggacggaccggaaagagtaatcctggccggtcctatgcccgtgacagttgcatcggctgcccagcggaggggccgcattgggcgaaaccataataaggagggagatcagtacatatatatgggccagccattgaacaatgacgaggatcacgcacactggaccgaagccaaaatgttactggacaacatcaatacacccgagggtattatccctgctctcttcgaaccagagagagaaaagtctgccgcgatcgatggggagtaccggctgaggggcgaggcacgcaaaactttcgtcgaacttatgagaaggggagacctgcccgtgtggctctcctataaggtggccagcgagggctttcaatactcagatcggcgttggtgcttcgacggggaacgcaacaatcaggtcttggaggaaaacatggatgttgagatttggacgaaagagggagaacgaaagaaactgagacctaggtggctagacgctcggacctatagtgacccgctggccctccgcgagtttaaggaattcgctgcaggtagaaggtctgtgtccggcgatcttatactggagatcgggaagttaccacagcatttgacacagcgggcccaaaatgctctggacaacctcgtaatgctgcacaatagcgaacagggaggccgagcctacagacatgcaatggaggagcttcccgatactattgaaaccctgatgctcttggcgctgatcgccgtgttaacaggtggggtcaccctatttttcctgtcaggccgcggactcggcaaaactagtattgggcttctgtgtgtgatggctagctccgttttgctgtggatggcctctgtggagcctcactggatcgcagctagcataatcctcgaatttttcctgatggtccttctcattcccgagccagacaggcagcggacgcctcaggataaccaactggcctatgtagtgatcggattgctgtttatgattttaaccgttgcagccaatgagatgggtctactggaaacaactaagaaagacctcggcatcgggcacgtggctgtcgagaaccatcaccatgcgaccatgcttgatgtggacctgcaccccgcctccgcatggacattgtacgctgtcgccaccactataattacaccaatgatgcgtcatacgatcgaaaacaccactgccaatatttcactgacagcaatcgctaaccaggccgcgatactcatgggactggataagggctggcctatctctaaaatggacattggtgtgccgcttttagctctggggtgctacagtcaggttaatcccctcaccttgaccgccgcagtgctgatgctagtagcccactatgctatcattggcccaggactgcaagcaaaggccacaagagaggcgcagaagaggactgctgccggcatcatgaaaaaccctacggtggatgggatagtcgcaattgacctcgatcccgttgtgtacgacgccaagttcgaaaaacagcttggacagatcatgctgttgatcctgtgtacctcgcaaattctcctgatgcgcacaacttgggctttatgcgagagcatcacccttgccacaggcccactgaccactctctgggagggttcccctgggaagttttggaatacgacaatagcagtctctatggctaacattttccggggatcatatctagccggcgcgggtctggcctttagcttgatgaaatccctgggcgggggacgaagaggcaccggggcacagggagaaactctcggcgagaagtggaagaggcagcttaatcagctgagtaaatctgaattcaacatctacaagcgcagcggtattatggaggtggaccggtcagaagctaaagaggggttgaagagaggagagaccacacgtcacgccgtatccaggggcactgcaaaactgcggtggttcgtggaacgcaatctcgttaagcccgagggtaaggtgatcgatttaggctgtgggcgaggaggctggagttattactgcgctgggctgaaaaaggtcaccgaagtgaaaggatatacaaagggcggtccggggcatgaggaaccaatacctatggccacgtacggatggaaccttgtcaaactgcacagcggcaaggacgtgtttttcacccccccagagaaatgtgatactctactctgcgacatcggcgagtcttcccccaatcctacaattgaagaggggagaaccctgagggttttgaagatggtagaaccgtggctgcggggaaaccaattttgtatcaagattctcaatccctacatgccatcagtggtcgagactcttgagcagatgcagcgcaaacatggtggcatgctggtgagaaaccctttaagcaggaattcgacacacgaaatgtattgggtttcttgcgggaccggaaacatcgtgagtgccgtcaatatgacgtcccgaatgctgttgaaccggttcaccatgacacaccgtaagcccacttacgagagagatgtggacctcggcgcgggtacccgccatgtagctgtggaacctgaggttgcaaacctggatattatcgggcagaggatagaaaatattaaacacgagcataagagcacatggcactatgacgaggataacccatacaaaacttgggcctatcatggatcatacgaagtcaagccctccggctctgctagcagtatggtgaatggcgtggtcaagctacttaccaaaccttgggacgttatcccaatggtgacacaaatcgccatgaccgatactacgccctttgggcagcagcgggtattcaaggagaaagtggacacaagaaccccgaaggcaaaacgcggaactgcccaaattatggaagtcaccgctaggtggctgtggggttttctctcccgaaacaagaagcctcggatatgtacaagagaggaattcacgaggaaagtgcgcagcaatgcggccatcggcgcagtttttgtggacgagaaccagtggaattctgctaaggaggccgtcgaagatgagcgtttctgggacctggtgcagaaagaacgggagttgcacaagcaggggaaatgcgcaacctgcgtatataacatgatgggaaagagagaaaagaaactgggcgagtttggtaaggccaaagggtcaagggctatttggtacatgtggctcggagcccgcttccttgagtttgaagcgctgggcttcatgaatgaggatcactggttcagtcgagaaaactccttaagcggcgttgagggggagggactgcataagttgggttacatcctccgggacatttctaaaatcccaggcgggaatatgtatgcagatgacactgccggatgggatacaagaataaccgaagacgatctgcaaaacgaggctaagatcactgacattatggaacccgagcacgccctacttgcaacatcgatctttaaactgacctaccagaataaggtggtcagggtgcagcgccctgctaagaacggcacagtgatggatgtcatttcaagacgggaccagaggggtagcgggcaagttggaacttatggcctcaataccttcacgaacatggaagcccagctgatccgtcagatggagtccgagggcatatttttgccaagtgaattagagacccccaacctggctgaacgagtgctcgattggcttgagaaacatggggtagaacgcctgaagagaatggccatttctggagacgactgtgtggtcaaaccgatcgatgaccggttcgcaacagcgctaactgccctgaatgatatgggtaaggtgaggaaagacatccctcagtgggagcccagcaagggctggaacgattggcaacaggttccattttgctcccaccacttccatcagctcattatgaaggacgggcgcgagatagtggtcccttgtagaaatcaggatgaattggtgggacgggctagggtatcacaaggcgccggttggagtctgcgagagaccgcatgccttgggaaatcttacgctcagatgtggcagctgatgtattttcaccgtagagacctccgcttagccgcaaacgccatctgtagcgcggttcccgtggattgggtcccaacatcccggactacctggtcaattcatgctcaccatcaatggatgacgacagaagacatgctgagcgtgtggaatagggtttggatcgaggaaaacccctggatggaggataagacccacgtgtcttcctggggagacgtcccttacttgggcaaaagagaggaccagtggtgcggcagtctgattgggctcactgcccgcgcaacatgggccagcaatatccaggtggctataaaccaggtacggaggcttatcggaaatgaaaactatctggattacatgacctcgatgaagcgattcaaaaatgagggtgacccagaaggcgccctatggtga

SEQ ID NO: 13829 - RNA, 9879 nt, synthetic construct
  misc_feature 1..9879: note = derived and/or modified CDS sequence (opt3) from DENV-1__GQ199838__SS-prME
  source 1..9879: mol_type = other RNA
agcgtgaccatgctgctcatgcttatgcccaccgccctggctttccacttgactacgaggggaggggagcctcatatgatcgtcaccaagcaggaaaggggaaaatccttactgtttaagacatctgctggtgttaatatgtgcactctgattgccatggacctcggcgagctgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaactttggttgatagaggctggggtaatgggtgtggactctttggcaaaggcagcctgataacctgcgctaagttcaagtgcgtgacaaaattagaggggaagattgtacagtacgaaaacctgaaatattccgtgatcgtcaccgtgcacactggagaccagcatcaagttggtaatgagtcaacggaacacggcacaaccgccactattacaccccaggcgcctacaagtgagatccagctcaccgactacggggcccttactctggattgtagcccaaggacaggattggactttaacgaaatggtgctactgacgatgaaggagaaatcttggctcgtccataagcagtggttcctggatcttccgctgccctggacctccggcgcatcaactagccaagagacatggaatcggcaggacttgctcgtgacctttaaaacagctcacgccaagaagcaggaagtagttgtgctgggtagtcaagagggggctatgcacactgccttaaccggcgcaacggaaatccagacctctggaacaactaccattttcgccggccatctgaaatgccgtctaaagatggataaactcacactgaaggggatgtcctatgtcatgtgtactggatcgtttaaacttgagaaggaagtggctgagacccagcacggtacggtcttggtgcagataaagtacgagggcacagacgcgccttgcaaaatcccattctcgacccaagatgaaaagggggttactcagaacggacgcctgattacagcaaatcccatcgtgaccgacaaagagaagcctgtaaacatagaagccgagccacccttcggcgagtcttatattgtcatcggtgctggggaaaaagccctcaagctgtcctggtttaagaaaggctcaagtatcggaaagatgttcgaggcaactgccagaggcgctaggcggatggccattcttggggataccgcatgggactttggaagcatcggtggcgtgttcacatccgttgggaaactggtgcatcagatttttggaacggcgtacggcgtcttgttctctggtgtgagctggaccatgaagatagggatcggcgtactcctgacttggttaggactaaattcacgaagtacatccctaagcatgacctgtattgctgtgggcctcgttacactgtaccttggggtcatggtgcaggccgattctggatgcgtgatcaactggaaaggccgcgaattgaagtgtggttcagggatctttgtcactaatgaggttcacacctggacggaacaatataagttccaggcagacagtccgaaaagactgagcgccgctattggaaaggcctgggaggagggcgtgtgcggtataaggtccgcaacacggctcgaaaacatcatgtggaaacagatttctaacgagctgaatcatatcttactggaaaacggcatgaagtttaccgtggtagtcggggacgtggttggcattcttgctcagggcaaaaagatgatccgccctcaacccatggagcacaaatactcgtggaaaagctgggggaaggccaagataatcggagcggatgtgcagaatactaccttcattatcgacggcccaaacacacctgaatgtcccgatgaccagagagcctggaatatttgggaggtcgaggattatggttttgggatcttcactaccaacatatggttgaagctcagggactcctacacacaggtgtgcgatcaccgtctgatgtcagctgcaattaaagacagtaaggccgttcatgctgatatgggatattggatcgaatctgagaaaaatgaaacgtggaagctagcccgggcttcctttattgaggtgaagacctgtatctggccaaaatcccacactctgtggtcaaacggcgtactcgaaagcgagatgataatccccaagatttacggtggccctatctctcaacataattatcgaccagggtacttcacacagaccgcgggaccgtggcacctgggcaaacttgagttggacttcgatctgtgcgaagggactacagtcgtggtggacgagcactgcggaaacagaggcccctccttaaggaccacgactgtcaccggtaagattatccatgaatggtgttgccgcagttgtacactccctccactgcggtttaaaggggaggatggatgctggtacggcatggagataagacccgttaaggaaaaggaggaaaatcttgtgaaaagcatggtatctgccggttccggcgaggtggactcattcagtctggggttgctctgtaccagcattatgatcgaagaggtcatgaggtcgcgctggtcccgaaagatgctgatgactggaacactagctgtgtttctgctcctgatcatgggccagcttacctggaacgacttgattcggctgtgcatcatggttggggccaatgcatctgatcgtatgggaatgggcacaacttatttagctctcatggccaccttcaaaatgagacctatgtttgcagtgggtctgcttttcaggcgcctgacgagccgggaggtcctactcctgacaattgggttgtcactggtggccagtgttgaattaccaaactccctcgaggaactgggagacggccttgctatgggcataatgatcctgaagttgctcaccgattttcaatctcaccagctgtgggcgactctactgagccttaccttcattaaaacaactctctccctgcattacgcctggaagaccatggcaatggtgttgtcaatcgtcagcctgtttcccttatgtctcagtacgacatctcagaagaccacttggctgccggtacttctggggtccttgggatgcaaacctctcacaatgttcctgattgctgagaataagatctggggtagaaaaagctggccactaaacgaaggcataatggccgtgggggttgtgtcgatcctgctttcatctctcctgaagaacgacgtccccttggccggacctttaattgctggcggtatgctgatcgcatgttatgtgattagtgggtccagcgccgatctctctctggagaaagcggctgaggtaagctgggaagaggaagccgagcactccggagcatcacataatatccttgtggaagtccaggacgatggcaccatgaagataaaagacgaggagagggatgacactctgacaattttgctaaaggccaccctgctcgctgttagtggcgtgtaccccctgagcatcccagcaacgctttttgtgtggtatttctggcaaaagaaaaagcagcgatctggggtcttatgggatactccttcacccccagaagtggagcgcgccgttctggacgatggaatctaccggattatgcagagaggtctcttgggcaggagccaggtaggggtgggagtctttcaagaaaacgtgttccacaccatgtggcacgttacacgtggcgcggtgctgatgtatcagggtaaacgcctcgagccgagttgggctagcgtcaagaaagacctgatatcctacgggggaggctggcggcttcagggctcttggaataccggggaggaagtgcaggtaatcgccgtcgagcctggaaagaaccccaagaatgtgcaaacagcaccaggtactttcaaaacccccgaaggcgaggttggggccattgctctggactttaagcctggaacgtcgggcagcccaatcgtgaacagagaaggtaaaattgtcgggttgtacggaaatggcgtggttacaacttcaggcacctatgtgtccgccatcgcacaggctaaggccagtcaggaggggcccctacctgagatagaagatgaggtcttcaggaaacgaaacctgacaatcatggacctccatccgggatctggtaagacccggcgctacttaccagcgattgtgagagaagccatcaagaggaaactgcggactcttattctggcacccacccgagtagtggctagcgagatggccgaagctctcaagggcatgcctatcagatatcaaacaacggcagttaaatccgagcacactgggaaggagatagtcgatttgatgtgccatgccacctttacaatgcgcctgctctcaccagtgagggtgcccaattacaacatgattatcatggacgaagcccacttcaccgatccttctagcatcgctgcgcgtggatatattagtactcgggtcggcatgggtgaggcagccgctatctttatgacagccaccccgcccgggtccgtagaagcattcccacagagcaatgccgtgatacaggacgaggaaagagatattcctgagaggtcttggaactcaggatacgagtggatcacggactttcccggcaaaactgtttggttcgtgccatccattaagagtggcaatgatatcgctaactgtctgcgcaagaatgggaaacgagtcatacagcttagcagaaagacatttgacaccgaatatcagaagaccaagaacaacgattgggactacgtggttactacagacatttcggagatgggagcgaatttccgggccgatagggtgatcgaccctcgccgttgcctaaaacccgtcatcctgaaggatggtccagaaagagtgattttggcaggcccgatgcctgtaaccgtggcttctgccgcacagcggagggggcgcatcggacgaaaccataataaggagggcgaccagtacatttatatgggtcagcccttaaacaatgatgaggaccacgcccactggacagaagctaaaatgctgctcgataacataaatactccagaggggatcattcccgccctgtttgaacctgagagagaaaagtccgcggcaatcgacggcgagtaccggcttaggggagaggcccgcaaaacgttcgttgaactgatgagaaggggcgatctcccagtctggttgagctataaggtggcttcagaggggttccaatacagtgaccggcgttggtgctttgatggagaacgcaacaatcaggtgctggaggaaaacatggacgtcgagatctggaccaaagagggtgaacgaaagaaactaagacccaggtggctggatgcccggacatattctgaccctctcgcacttcgcgagttcaaggaatttgcagccggcagaaggtccgttagcggggacctgattttagagataggaaagttgccgcagcatctgactcagcgggctcaaaatgccctcgataacctggtgatgcttcacaattcagaacagggcggtcgagcatacagacatgcgatggaggagctgccagacaccatcgaaacactcatgttgctggccttaattgctgtactaaccgggggcgtgactctgttctttctcagtggacgcggccttgggaaaacgagcatcggactgttgtgtgtcatggcctcctctgtgctgctctggatggcaagcgttgagccccactggattgctgcctccatcatactggagttctttcttatggtgctcctgatccctgagcccgataggcagcggaccccacaggacaaccaattggcatatgtcgtaattggtctgttattcatcattctaacagtggccgctaatgagatgggcctgctcgaaactaccaagaaagatcttgggatcggacacgttgcggtggagaaccatcaccatgccacaatgctggacgtcgatttgcaccctgcatcagcttggaccctgtacgccgtggccactacaataattacgcccatgatgcgtcataccatcgaaaacactacagcaaatatttctctcaccgctatcgccaaccaggcggctatactgatgggccttgacaagggttggccaatcagtaaaatggatattggggtccctttactggccctcggctgctacagccaggtgaatccgttgaccctgacagcagccgttctaatgctggtggctcactatgcaatcattggacccggcctccaagccaaggcgactagagaggctcagaagaggacggccgcagggatcatgaaaaacccaaccgtagacggaatagtggccattgatcttgaccctgtcgtttacgatgctaagtttgaaaaacagctgggccagatcatgttgctgatcctctgtacaagccaaattctgttaatgcgcactacctgggccctttgcgagtccatcacactggcaaccggtcccctcactacgctatgggaggggtctccaggaaagttctggaatacaaccatagctgtgtcaatggccaacatttttcggggcagctatctggcgggtgccggcttggcattctccctgatgaaaagtctcgggggaggccgaagagggactggagctcagggcgaaacccttggtgagaagtggaagaggcagctgaatcagttgtctaaaagcgaatttaacatctacaagcgctcagggattatggaggtcgaccggtccgaagccaaagagggactgaagagaggcgagacaactcgtcacgcagtgagtaggggtaccgctaaactccggtggttcgtagaacgcaatttagtgaagcctgagggcaaggttatcgacctggggtgtggacgaggcgggtggagctattactgcgccggacttaaaaaggtgacagaagtcaaaggctatacgaagggtgggcccggacatgaggaaccgataccaatggccacctacggctggaacctggtgaaactacactctggcaaggatgtcttctttactcctcccgagaaatgtgacacactcctgtgcgatatcggggagtcctcaccaaatcccaccattgaagagggaagaactttgagggtgctgaagatggttgaaccttggctccggggtaaccaattctgtatcaagattcttaatccgtacatgcccagcgtagtggagacactggagcagatgcagcgcaaacatggcgggatgttagtcagaaacccactgtcgagaaattctacccacgaaatgtattgggtgagttgcggaacgggcaacatcgtttccgcggtgaatatgaccagccgaatgttgctcaaccggtttacaatggctcaccgtaagcctacttacgagagagacgtcgatctgggtgcagggacccgccatgtggccgtagaacccgaggtggctaacctagacattatcggacagaggatagaaaatattaaacacgagcataagtcaacatggcactatgatgaggacaacccttacaaaacttgggcctatcatggctcctacgaagttaagccatctggcagcgcaagttccatggtcaatggggtggtgaaacttctgaccaaaccctgggatgtcatccctatggttacacaaatcgccatgaccgacactacgccattcggacagcagcgggtgtttaaggagaaagtagatacaagaacccccaaggctaaacgcggtactgcgcaaattatggaagtgaccgccaggtggctctggggcttcctgagccgaaacaagaagccgcggatatgtacaagagaggaatttacgaggaaagtccgctctaatgcagctatcggggccgtgttcgttgacgagaaccagtggaactcagcaaaggaggccgtggaagacgagcgtttttgggatttggtccagaaagaacgggagctgcacaagcagggaaaatgcgctacctgcgtgtataacatgatgggcaagagagaaaagaaactcggtgagttcgggaaggccaaaggaagtagggcgatttggtacatgtggcttggcgcacgctttctggagttcgaagccttaggctttatgaatgaggaccactggttctcccgagaaaacagcctgtctggggtagagggagagggtttgcataagctcggctacatcctgcgggatatttcgaaaatccctgggggaaatatgtatgctgacgatactgccggctgggacacaagaataaccgaagatgacctacaaaacgaggcaaagatcactgatattatggaaccagagcacgcacttctggccacatcaatcttcaaactcacctaccagaataaggttgtgagggtccagcgccccgctaagaacggtacagtgatggacgtgattagcagacgggatcagagggggtccggacaagtcggcacttatggcctgaatacctttacgaacatggaagcccagttgatccgtcagatggagagtgaggggatattcttaccttctgaactggagaccccaaacctcgcagaacgagttcttgactggctggagaaatacggagtggaacgcctaaagagaatggcgattagcggtgatgactgtgtagtgaaacccatcgacgatcggtttgccacagctctgactgccctcaatgacatgggcaaggtcaggaaagatatcccgcagtgggagccttccaaggggtggaacgactggcaacaggtgcccttctgctcacatcactttcaccagttgattatgaaggatggacgcgagatagttgtgccatgtagaaatcaggacgaactggtcggccgggcaagggtgagtcaaggtgctgggtggtctcttcgagagaccgcctgcctgggaaaaagctatgcacagatgtggcagctcatgtacttccatcgtagagatttacgcctggccgcgaacgctatctgttccgccgtacctgttgactgggtgcccacatcacggactacctggagcattcacgcacatcaccaatggatgacgacagaagatatgttgtctgtctggaatagggtgtggatcgaggaaaacccatggatggaggacaagacccatgtttccagttggggcgatgtgccctatctgggcaaaagagaggaccagtggtgcgggagcctcattggacttactgcccgcgctacatgggcctcgaatatccaggtcgcaataaaccaggtgcggaggctgatcggtaatgaaaactacctagactacatgacctccatgaagcgatttaaaaatgagggcgatcctgaaggggctctgtggtga

SEQ ID NO: 13830 - RNA, 9879 nt, synthetic construct
  misc_feature 1..9879: note = derived and/or modified CDS sequence (opt3) from DENV-1__FJ898396__SS-prME
  source 1..9879: mol_type = other RNA
agcgtgaccatgctgctcatgcttatgcccaccgcactggctttccacttgactacgagaggaggggagcctcatatgatcgtcaccaagcaggaaaggggaaaatccttactgtttaagacatctgccggtgttaatatgtgcactctaattgccatggacctcggcgagctgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcattttcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggtagcttcaaactggagaaggaagtggctgagacccagcacggaacggtccttgtgcagataaagtacgagggcacagacgcgccttgcaaaatcccattctcgacccaagatgaaaagggggttactcagaacggacgcttgattacagcaaatcccatcgtgaccgacaaagagaagcctgtaaacatagaagccgagccaccctttggcgagtcttatattgtcatcggtgctggggaaaaagccctgaagctctcctggttcaagaaaggctcaagtatcggaaagatgtttgaggcaactgccagaggcgctaggcggatggccattctgggggataccgcatgggacttcggaagcgtgggtggcgtttttacatccgtggggaaacttgtccatcagatcttcggaacggcgtacggcgtgctgttttctggtgtaagctggaccatgaagattgggataggcgtgttgctcacttggctgggattaaattcacgaagtacatccctgagcatgacctgtatcgctgttggcctagtcacactctacctgggggtgatggtgcaggccgattctggatgcgtcattaactggaaaggccgcgaacttaagtgtggttcagggatcttcgttactaatgaggtgcacacctggacggaacaatataagtttcaggcagacagtccgaaaagattgagcgccgctatcggaaaggcctgggaggagggcgtgtgcggtattaggtccgcaacacggctggaaaacataatgtggaaacagatctctaacgagctcaatcatattctgttagaaaacgacatgaagttcaccgtagtcgtgggcgatgttgtggggatcctggctcagggcaaaaagatgattcgccctcaacccatggagcacaaatactcgtggaaaagctggggcaaggccaagatcataggggcggacgtccagaatactacctttatcattgatggaccaaacacacctgaatgtcccgacgatcagagagcctggaatatctgggaggtggaggactatggcttcggtatttttactaccaacatctggcttaagttgagggattcctacacacaggtttgcgaccaccgtctcatgtcagctgcaataaaagatagtaaggccgtgcatgctgacatggggtattggattgaatctgagaaaaatgaaacgtggaagctggcccgggcatccttcatcgaggtaaagacctgtatttggccaaaatcccacactctatggtcaaacggagtcctggaaagcgagatgatcatacccaagatctacggcggtcctatttctcaacataattatcgaccaggctacttcacacagaccgcggggccgtggcacctcggaaaactggagcttgattttgacttgtgcgaaggcactacagtggtggtcgatgagcactgcgggaacagaggaccctccctgaggaccacgactgttaccggcaagatcattcatgaatggtgttgccgcagttgtacattacctccactccggttcaaaggtgaggacgggtgctggtacggaatggagatcagacccgtgaaggaaaaggaggaaaatctggtaaaaagcatggtgtctgccggctccggtgaggtcgactcatttagtcttggcctgttgtgtataagcattatgatcgaagaggtgatgaggtcgcgctggtcccgaaagatgctcatgaccgggactctggctgttttcctactgctcatcatgggacagctgacatggaacgatcttattcggttgtgcatcatggtgggcgccaatgcatctgaccgtatggggatgggaaccacatatctggctttaatggccacttttaaaatgagacctatgttcgcagtcggcctcctgtttaggcgccttaccagccgggaggtgctgctactcacgattggtctgtcattggttgccagtgtggaactgccaaactccttagaggaactcggggatggactggctatgggcataatgatccttaagctgttgacagacttccaatctcaccagctctgggcgaccctgctaagcctgacttttattaaaaccacactttccctccattacgcctggaagactatggcaatggtcctgtcaatcgctagcttgttccccctgtgtttaagtaccacgtctcagaagacaacctggctcccggtactgcttggctccctggggtgcaaacctttgactatgtttctcattacagagaccaagatctggggaagaaaaagctggccactgaatgaaggtataatggccgtgggcgttgtgtcgatcctactgtcatctcttctcaagaacgatgtccccctggccgggcctttgattgctggaggcatgttaatcgcatgttatgtgattagtggttccagcgccgacctgtctctcgagaaagcggctgaggtaagctgggaagaggaagccgagcactccggggcatcacataacatcctggtggtcgttcaggatgacggaactatgaagataaaagatgaagagagggacgatacacttaccattctgttgaaggccacgctactggctgtgagtggcgtgtaccccctcagcatcccagcaactctgttcgtctggtatttttggcaaaagaaaaagcagcgatctggcgtgctttgggacaccccttcacccccagaggttgaacgcgccgtattagatgacgggatctaccggattatgcagagaggactgctcggtaggagccaggtgggcgtcggggtgttccaagagaatgttttccacacaatgtggcacgtgacccgtggagcggtcttgatgtatcagggcaaacgcctggaaccgagttgggctagcgtgaagaaagacctcatatcctacggtgggggatggcggctgcagggctcttggaacacaggcgaggaggtacaggtcatcgccgtggaacctgggaagaatcccaagaacgttcaaactgcaccaggaacctttaaaacgcccgagggtgaagtgggcgccattgctcttgatttcaagcctgggacatcgggaagcccaatcgtcaatagagagggcaaaattgtgggtctgtacgggaacggagttgtgactacctcaggcacatatgtctccgccatcgcacaggctaaggccagtcaggaaggccccttgcctgagatagaggacgaagtgtttaggaaacgaaatctaaccatcatggatctgcatccggggtctggaaagactcggcgctacctcccagcgattgtaagagaggccatcaagaggaaattacggaccctgattcttgcacccacacgagtggttgctagcgaaatggccgaggctctgaagggtatgcctatcagatatcaaacgactgcagtcaaatccgaacacaccggcaaggagatagtggacctcatgtgccatgccacattcaccatgcgcttgctgtcaccagtgagggtccccaactacaatatgattatcatggatgaggcccactttactgacccttctagcatcgctgcgcgtgggtatattagtacacgggtaggaatgggcgaagcagccgctatcttcatgaccgccacgccgcccggttccgtggaggcatttccacagagcaacgccgttatacaggatgaagagagagacattcctgaaaggtcttggaactcagggtacgagtggatcactgatttccccggaaaaacagtgtggtttgtcccatccattaagagtggcaacgacatcgctaattgtctccgcaagaacggcaaacgagtgatacagctgagcagaaagaccttcgataccgagtatcagaaaactaagaataacgactgggactacgttgtgacaaccgatatttcggaaatgggggcgaactttcgggccgacagggtcatcgatcctcgccgttgccttaaacccgtgatcctaaaggacggaccagagagagtaattctggcaggtccgatgcctgtgacagttgcttctgccgcacagcggaggggccgcatcgggcgaaatcataacaaggaaggagatcagtacatttatatgggccagcccttgaataacgacgaggatcacgcccactggactgaggctaaaatgttactggacaatataaacacgccagaaggtatcattcccgccctcttcgagcctgaaagagagaagtccgcggcaatcgatggggaataccggctgaggggcgaggcccgcaaaaccttcgtcgagcttatgagaaggggagacctgccagtgtggctcagctataaggtggcttcagaaggctttcaatacagtgatcggcgttggtgcttcgacggggagcgcaataaccaggtcttggaagagaatatggatgttgaaatctggacaaaagagggagagcgaaagaaactgagacccaggtggctagacgcccggacttattctgaccctctggctctccgcgaatttaaggagttcgcagccggtagaaggtccgtgagcggcgatcttattctggaaatagggaagttaccgcagcatttgacccagcgggctcaaaacgccctggacaatctcgtaatgctgcacaactcagagcagggaggccgagcatacagacatgcgatggaggaacttccagatacaatcgagaccctgatgctcttggccctgattgctgtgttaactggtggggtcacgctatttttcctgagtggccgcggactcggcaaaaccagcatcgggcttctgtgtgtgatggcctcctctgttttgctgtggatggcaagcgtggaaccccactggattgctgcctccatcacactcgagtttttcctgatggtccttctcatacctgaacccgacaggcagcggactccacaggataatcaactggcatatgtagtgatcggattgctgtttatgattttaaccgttgccgctaacgagatgggtctactggagacaaccaagaaagacctcggcatcgggcacgtggcggtcgaaaatcatcaccatgccactatgcttgatgtggacctgcaccctgcatcagcttggacattgtacgccgtcgccacgaccattatcactcccatgatgcgtcatacaatagagaacaccaccgcaaacatttctctgacagctatcgccaatcaggcggctattctcatgggactggataagggctggccaatcagtaaaatggacataggtgtgcctcttttagccctggggtgctactcgcaggttaacccgctcactttgacggcagccgtgctgatgctagtagctcactatgcaatcattggccccggactgcaagccaaggcgaccagagaagctcagaagaggacagccgcaggcatcatgaaaaatccaactgtggatgggattgtcgccatcgacctcgatcctgttgtgtacgacgctaagttcgagaaacagcttggacagataatgctgttgattctgtgtaccagccaaatcctcctgatgcgcacaacctgggccttatgcgaatccatcactcttgcaacgggccccctgacaaccctctgggagggttctccagggaagttttggaacactaccattgctgtctcaatggccaatatcttccggggaagctatctagcgggcgccggtctggcattttccttgatgaaaagtctgggcgggggacgaagaggcacaggggctcagggagagactctcggcgaaaagtggaagaggcagcttaaccagctgtctaaaagcgagttcaatatatacaagcgctcaggtattatggaagtggaccggtccgaggccaaagaagggttgaagagaggagagaccacacgtcacgcagtaagtaggggcacggctaaactgcggtggttcgtggagcgcaacctcgttaagcctgaaggtaaggtgatcgatttaggctgtgggcgaggaggctggagctattactgcgccgggctgaaaaaggtcaccgaggtgaaaggatatactaagggcggtcccgggcatgaggagccgattccaatggccacatacggatggaatcttgtcaaactgcactctggcaaggacgtgtttttcacccctcccgaaaaatgtgatactctactctgcgacatcggcgagtcctcaccaaaccccacaatagaggaagggagaaccctgagggttttgaagatggtagagccttggctgcggggaaatcaattttgtatcaagattctcaacccgtacatgcccagcgtggtcgaaacgcttgagcagatgcagcgcaaacatggtggcatgctggtgagaaatccattatcgaggaactctacccacgagatgtattgggttagttgcgggacaggaaatatcgtgtccgcggtcaacatgactagccgaatgctgttgaatcggttcaccatggctcaccgtaagcctacatacgaaagagatgtggacctcggcgcaggtactcgccatgtagccgtggagcccgaagttgctaacctggatattatcgggcagaggattgagaacatcaaacacgaacataagtcaacctggcactatgacgaggataatccttacaaaacatgggcctatcatggatcctacgaggtcaagccatctggcagcgcaagttccatggtgaacggcgtggtcaagctacttaccaaaccctgggacgttatacctatggtgactcaaattgccatgacggatacaaccccatttgggcagcagcgggtattcaaggaaaaagtggacactagaacccccaaggctaaacgcggaacagcgcaaatcatggaggtcacggccaggtggctgtggggttttctcagccgaaataagaagccgcggatctgtaccagagaagagttcactaggaaagtgcgctctaacgcagctattggcgccgtttttgtggacgaaaatcagtggaactcagcaaaggaggccgtcgaggatgaacgtttctgggacctggtgcagaaagagcgggaattgcacaagcaggggaaatgcgctacatgcgtatataatatgatgggaaagagagagaagaaactgggcgaatttggtaaggccaaagggagtagggcgatatggtacatgtggctcggagcacgcttccttgagtttgaggccctgggcttcatgaacgaagatcactggttctcccgagagaatagcttatctggcgttgaaggggagggactgcataagttgggttacatcctccgggacatttcgaaaatccctggcgggaacatgtatgctgatgacaccgccggatgggatactagaattacagaggacgatctgcaaaatgaagcaaagatcaccgacataatggagccagaacacgctctacttgccacatcaatctttaaactgacttaccagaacaaggtggtcagggtgcagcgccccgctaagaatggcaccgtgatggatgtcattagcagacgggaccagaggggttccgggcaagttggaacgtatggcctcaacaccttcacaaatatggaggcccagctgatccgtcagatggaaagtgagggcatatttttgccttctgagttagaaactccaaacctggcagagcgagtgctcgattggcttgaaaaatacggggtagagcgcctgaagagaatggcgatcagcggagacgactgtgtggtcaaacccatagatgaccggttcgccaccgctctaacagccctgaacgatatgggtaaggtgaggaaagacattccgcagtgggaaccttccaagggctggaatgattggcaacaggttcccttttgctcacatcacttccaccagctcatcatgaaggacgggcgcgagatcgtggtcccatgtagaaaccaggatgagttggtgggacgggcaagggtaagtcaaggcgctggttggtctctgcgagaaactgcctgccttgggaaaagctatgcacagatgtggcagctgatgtactttcatcgtagagacctccgcttagccgcgaatgctatttgttccgccgttcctgtggattgggtccccacctcacggacgacatggagcatacacgcacatcaccaatggatgaccactgaggacatgctgtctgtgtggaacagggtttggatcgaagagaatccatggatggaagataagacacatgtgtccagttggggagacgtcccctatttgggcaaaagagaggaccagtggtgcggcagcctgattgggctcaccgcccgcgctacttgggcctcgaacatccaggtggcaattaatcaggtacggaggcttatcggaaacgagaattacctggattacatgacctccatgaagcgattcaaaaacgaaggtgaccctgagggcgctctatggtga

SEQ ID NO: 13831 - RNA, 9879 nt, synthetic construct
  misc_feature 1..9879: note = derived and/or modified CDS sequence (opt3) from DENV-1__GQ199839__SS-prME
  source 1..9879: mol_type = other RNA
agcgtgaccatgctgctcatgcttatgcccaccgcactggctttccacttgactacgagaggaggggaacctcatatgatcgtcaccaagcaggaaaggggaaaatccttactgtttaagacatctgccggtgttaatatgtgcactctgattgccatggacctcggcgagctgtgtgaagataccatgacatacaaatgcccacggataaccgaggcggaaccggacgatgtggactgttggtgcaatgctactgatacatgggtaacctatgggacgtgttcacgcactggagagcaccgacgtgacaagagaagtgtggcccttgcaccccatgtcggcctgggtttggagaccaggacagaaacttggatgagctccgagggggcctggaaacaaatccagcgggtggaaacctgggctctccgccaccctggattcacagttattgcactgtttctggcccatgctatcggcacctctattacgcagaagggcatcatattcatcctcttaatgctggtgactccatcgatggccatgagatgcgtcgggattggatcaagggattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgcggaaactttgcattgaagctaagatctccaataccacaactgattctcgctgtccaacccagggagaggccacactgatggaagaacaagacgcaaacttcgtctgccgaagaacttttgttgataggggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaggttggtaatgagtcaacggaacacggcacaaccgccactattacaccccaagcgcctacaagtgagatccagctgaccgactacggggccctcactcttgattgtagcccacggacaggactggacttcaacgaaatggtgttgctaacgatgaaggagaaatcttggctggtccataagcagtggtttctcgatctgccgcttccctggacctccggcgcatcaactagccaggagacatggaatcgtcaagacctgttggtgaccttcaaaacagctcacgccaagaagcaggaagtagttgtgctcggtagtcaggagggggctatgcacactgccctgaccggcgcaacggaaatccaaacctctggaacaactaccatttttgccggccatttaaaatgccgcctgaagatggataaactaacactcaaggggatgtcctatgtcatgtgtactggtagcttcaaactggagaaggaagtggctgagacccagcacggaacggtccttgtgcagataaagtacgagggcacagacgcgccttgcaaaatcccattctcgacccaggatgaaaagggggttactcaaaacggaagattgattacagcaaatcccatcgtgaccgacaaagagaagcctgtaaacatagaagccgagccaccctttggcgagtcttatattgtcatcggtgctggggaaaaagccctgaagctctcctggttcaagaaaggctcaagtatcggaaagatgtttgaggcaactgccaggggcgctcggcgaatggccattctgggggataccgcatgggacttcggaagcatcggtggcgtgtttacatccgttgggaaacttgtgcatcagattttcggaacggcgtacggcgtcctgttttctggtgtgagctggaccatgaagatagggatcggcgtattgctcacttggctgggattaaattcacgcagtacatccctgagcatgacctgtattgctgtgggcctagttacactctacctgggggtcatggtgcaggccgattctggatgcgtgatcaactggaaaggcagagaacttaagtgtggttcagggatcttcgtcactaatgaggttcacacctggacggaacagtataagtttcaagcagacagtccgaaaaggttgagcgccgctattggaaaggcctgggaggagggcgtgtgcggtatacggtccgcaacacgcctggaaaacatcatgtggaaacagatttctaacgagctcaatcatatcctgttagaaaacggcctgaagttcaccgtggtagtcggggacgtggttggcattcttgctcagggcaaaaagatgatcagacctcagcccatggagcacaaatactcgtggaaaagctgggggaaggccaagataatcggagcggatgtgcaaaatactacctttattatcgacggcccaaacacacctgaatgtcccgatgaccagagggcctggaatatttgggaggtcgaggattatggtttcgggatctttactaccaacatatggttgaagctccgtgactcctacacacaggtgtgcgatcaccggctgatgtcagctgcaattaaagacagtaaggccgttcatgctgatatgggatattggatcgaatctgagaaaaatgaaacgtggaagctagcccgagcatccttcattgaggtgaagacctgtatctggccaaaatcccacactctgtggtcaaacggcgtactcgaaagcgagatgataatccccaagatttacggtggccctatctctcagcataattatagaccagggtacttcacacaaaccgcgggaccgtggcacctgggcaaacttgagttggactttgatctgtgcgaagggactacagtcgtggtggacgagcactgcggaaacaggggcccctccttacgcaccacgactgtcaccggtaagattatccatgaatggtgttgccggagttgtacactccctccactgagattcaaaggggaggatggatgctggtacggcatggagataaggcccgttaaggaaaaggaggaaaatcttgtgaaaagcatggtatctgccggttccggcgaggtggactcatttagtctggggttgctctgtaccagcattatgatcgaagaggtcatgcgctcgcgatggtcccggaagatgctgatgactggaacactagctgtgttcctgctcctgatcatgggccagcttacctggaacgacttgattcgtctgtgcatcatggttggggccaatgcatctgatagaatgggaatgggcacaacttatttagctctcatggccacctttaaaatgaggcctatgttcgcagtgggtctgctttttcgccggctgacgagcagagaggtcctactcctgacaattgggttgtcactggtggccagtgttgaattaccaaactccctcgaggaactgggagacggccttgctatgggcataatgatcctgaagttgctcaccgatttccagtctcaccaactgtgggcgactctactgagccttacctttattaaaacaactctctccctgcattacgcctggaagaccatggcaatggtgttgtcaatcgtcagcctgttccccttatgtctcagtacgacatctcagaagaccacttggctgccggtacttctggggtccttgggatgcaaacctctcacaatgtttctgattgctgagaataagatctggggtaggaaaagctggccactaaacgaaggcataatggccgtgggggttgtgtcgatcctgctttcatctctcctgaagaacgacgtccccttggccggacctttaattgctggcggtatgctgatcgcatgttatgtgattagtgggtccagcgccgatctctctctggagaaagcggctgaggtaagctgggaagaggaagccgagcactccggagcatcacataatatcttcgtggaagtccaggacgatggcaccatgaagataaaagacgaggagcgagatgacactcttacaattctgttgaaggccaccctactggctgttagtggcgtgtaccccctcagcatcccagcaacgctgtttgtgtggtatttctggcagaagaaaaagcaacgctctggggtcctttgggatactccttcacccccagaagtggagcgggccgcgttagacgatggaatctacagaattatgcagaggggtctgctcggccgtagccaggttggggtaggagtgttccaggaaaacgtctttcacaccatgtggcacgtgacacgcggcgctgttttgatgtatcaaggtaaacggctggagccgagttgggccagcgtgaagaaagacctcatatcctacgggggaggctggagactgcagggctcttggaataccggggaggaagtccaggtgatcgcagtagagcctggaaagaaccccaagaatgtccagacagccccaggtactttcaaaacccccgaaggcgaggtgggggctattgcccttgactttaagcctggaacgtcgggcagcccaatcgttaacagggaaggtaaaattgtggggctgtacggaaatggcgtcgtgacaacttcaggcacctatgtttccgcaatcgctcaaacaaaggccagtcaggaggggcccttgcctgagatagaagatgaggtgttccgaaaacggaacctaaccatcatggacctgcatccgggatctggtaagactcgcagatacctcccagcgattgtcagggaagccatcaagcggaaattacgaaccctgattcttgcacccacaagagtggtagctagcgagatggccgaagctctgaagggcatgcctatccgctatcagacgactgcagtgaaatccgagcacaccgggaaggagatagttgatctcatgtgccatgccacatttaccatgaggttgctgtcaccagtccgtgtgcccaattacaacatgattatcatggacgaagcccacttcactgatccttctagcatcgctgcgcggggatatattagtacaagagtgggcatgggtgaggcagccgctatctttatgaccgccacgccgcccgggtccgtcgaagcattcccacaaagcaatgccgtaatacaggacgaggaaagggatattcctgagcgctcttggaactcaggatacgagtggatcactgactttcccggcaaaacagtgtggttcgttccatccattaagagtggcaatgatatcgctaactgtctccgaaagaatgggaaaagagtgatacagctgagccggaagacctttgacaccgaatatcagaaaactaagaacaacgattgggactacgtcgtgacaaccgacatttcggagatgggagcgaatttcagggccgatcgcgttatcgaccctcgtagatgccttaaacccgtgatcctaaaggatggtccagaacgggtcattctggcaggcccgatgcctgtgacagtagcttctgccgcacaaaggcgcgggcgaatcggaagaaaccataataaggagggcgaccagtacatttatatgggtcagcccttgaacaatgatgaggaccacgcccactggactgaagctaaaatgttactggataacataaatacgccagaggggatcattcccgccctcttcgaacctgagcgggaaaagtccgcggcaatcgacggcgagtacaggctgcgcggagaggccagaaaaacctttgtggaacttatgaggcggggcgatctgccagtttggctcagctataaggtcgcttcagaggggttccagtacagtgaccgtcgctggtgctttgatggagaacgaaacaatcaagtgttggaggaaaacatggacgtggagatctggacaaaagagggtgaaagaaagaaactgaggccccggtggctagatgcccgcacttattctgaccctctggctctcagagagttcaaggaatttgcagccggcaggcggtccgtcagcggggaccttattctggagataggaaagttaccgcagcatttgacccagcgagctcagaatgccctggataacctcgttatgctgcacaattcagaacaaggcggtagagcataccgccatgcgatggaggagcttccagacacaatcgaaaccctgatgctcttggccctgattgctgtgttaactgggggcgtaacgctattctttctgagtggaaggggcctcgggaaaaccagcatcggacttctgtgtgtgatggcctcctctgtcttgctgtggatggcaagcgtggagccccactggattgctgcctccatcatactcgagttctttctgatggttcttctcatccctgagcccgatcggcagcgtacaccacaggacaaccagctggcatatgtggtcattggtttgctgttcatcattttaactgtagccgctaatgagatgggcctactggaaaccacaaagaaagatctcgggatcggacacgtggcggttgagaaccatcaccatgccaccatgcttgacgtggatctgcaccctgcatcagcttggactttgtacgccgtcgccacaacgataattacccccatgatgagacatactatcgaaaacacaaccgcaaatatttctctgaccgctatcgccaaccaagcggctatactcatgggcctggacaagggttggccaatcagtaaaatggatattggggtgcctcttttagccctgggctgctactcgcaggtcaatccgctcacattgactgcagccgtgctgatgctagttgctcactatgcaatcattggacccggcctgcaggccaaggcgacgagggaggctcaaaagcgcaccgccgcagggatcatgaaaaacccaacagtggacggaatagtagccattgatctcgaccctgtggtctacgatgctaagtttgaaaaacagcttggccagatcatgctgttgatcctgtgtactagccagattctcctgatgcggaccacatgggccttatgcgagtccatcacccttgcaactggtcccctgacgacactctgggaggggtctccaggaaagttctggaataccactatagctgtttcaatggccaacatttttcgaggcagctatctagcgggtgccggcctggcattctccttgatgaaaagtctagggggaggcagaagggggaccggagctcaaggcgaaacactcggtgagaagtggaagcgccagcttaatcagctgtctaaaagcgagttcaacatctacaagcggtcagggattatggaggtggacagatccgaagccaaagagggattgaagcgtggcgagactaccaggcacgcagtcagtcggggtacagctaaactgcgctggtttgtggaacgaaatctcgtaaagcctgagggcaaggtgatcgacttagggtgtggaagaggcgggtggagctattactgcgccggactgaaaaaggttacggaagtgaaaggctataccaagggtgggcccggacatgaggaaccgataccaatggccacttacggctggaaccttgtcaaactgcactctggcaaggatgtgttctttacacctcccgagaaatgtgacaccctactctgcgatatcggggagtcctcaccaaatcccactattgaagagggaaggacactgcgggtcttgaagatggtggaaccttggctgcgcggtaaccagttctgtatcaagattctcaatccgtacatgcccagcgttgtagagacccttgagcaaatgcagagaaaacatggcgggatgctggtgaggaacccattatcgcgaaattctacgcacgaaatgtattgggtcagttgcggaaccggcaacatcgtgtccgcggttaatatgacaagccggatgctgttgaaccgttttactatggctcacagaaagcctacctacgagcgcgacgtggatctcggtgcagggacaaggcatgtcgccgtggaacccgaggtagctaacctggacattatcggacagcggatagaaaatattaaacacgagcataagtcaacttggcactatgatgaggacaacccttacaaaacctgggcctatcatggctcctacgaagtgaagccatctggcagcgcaagttccatggttaatggggtcgtgaagctacttacaaaaccctgggatgtgatccctatggtcacccagatcgccatgactgacacgacaccattcggacaacagagagtttttaaggagaaagtggatacccgcactcccaaggctaaaaggggtaccgcgcagattatggaagtaacagcccgatggctgtggggcttcctcagccggaacaagaagccgagaatatgtacgagggaggaatttacccgcaaagtgcgttctaatgcagctatcggggccgtcttcgtggacgagaaccaatggaactcagcaaaggaggccgttgaagacgagcggttttgggatctggtgcagaaagaaagagagttgcacaagcagggaaaatgcgctacttgcgtctataacatgatgggcaagagggaaaagaaactgggtgagttcgggaaggccaaaggaagtcgcgcgatttggtacatgtggctcggcgcacgatttcttgagttcgaagccctgggcttcatgaatgaggaccactggttttcccgggaaaacagcttatctggggtggagggagagggtctgcataagttgggctacatcctcagagatatttcgaaaatccctgggggaaatatgtatgctgacgatacagccggctgggacaccaggataactgaagatgacctgcagaacgaggcaaagatcacagatattatggaaccagagcacgctctacttgccacctcaatcttcaaactgacataccaaaataaggtagttcgcgtgcagagacccgctaagaacggtactgtcatggacgtgattagccggagggatcagcgtgggtccggacaggtgggcacctatggcctcaatacgtttaccaacatggaagcccaactgatccgacagatggagagtgaggggatattcttgccttctgaattagagacaccaaacctggcagaacgcgtcctcgactggcttgagaaatacggagttgaaagactgaagcggatggcgattagcggtgatgactgtgtggtaaaacccatcgacgataggtttgccactgctctaaccgccctgaatgacatgggcaaggtgcgcaaagatatcccgcagtgggagccttccaaggggtggaacgactggcagcaagtccccttctgctcacatcactttcaccagctcattatgaaggatggaagagagatagtggttccatgtcggaatcaggacgaattggtgggcagggcacgagtcagtcagggtgctgggtggtctctgcgtgagacagcctgccttggaaaaagctatgcacaaatgtggcagctgatgtacttccatagacgcgatctccggttagccgcgaacgctatctgttccgccgtgcctgtagactgggttcccacttcaaggaccacgtggagcattcacgcacatcaccagtggatgacaaccgaagatatgctgtctgtgtggaatagagtctggatcgaggaaaacccatggatggaggacaagactcatgtgtccagttggggcgatgttccctatttgggcaaacgcgaggaccaatggtgcgggagcctgattggactcacagcccgggctacctgggcctcgaatatccaggtggcaataaaccaggtcaggcgacttatcggtaatgaaaactacctggactacatgacttccatgaagagatttaaaaatgagggcgatcctgaaggggctctatggtga

SEQ ID NO: 13832 - RNA, 9879 nt, synthetic construct
  misc_feature 1..9879: note = derived and/or modified CDS sequence (opt3) from DENV-1__FJ898397__SS-prME
  source 1..9879: mol_type = other RNA
agcgtgaccatgctgctcatgcttatgcccacagccctggctttccacttgactatcagaggcggggagcctcatatgattgtctccaagcaggaaaggggaaaatctttactgtttaagacgtcagcaggtgttaacatgtgcaccctaatagccatggacctcggcgagttctgtgaagatacaatgacttacaaatgcccacggatcaccgaggcggaaccggacgatgtggactgttggtgcaatgctacagatacctgggtaacttatgggacatgtagtcaaaccggagagcaccgccgagacaagcgtagcgtggccctggcaccccatgtcggccttggtctggagacgagaactgaaacctggatgtcctctgagggggcctggaaacagattcagagggtggaaacatgggctttgcggcaccctggatttactgttatcgcactcttcctggcccatgctattggcacctcgatcacacagaagggcataatctttattctgctcatgttagtgaccccatcaatggccatgcgctgcgtcgggatcggaagcagagatttcgtggagggtctgagtggcgcgacgtgggtagacgttgtgcttgagcacgggtcctgtgtcactacaatggcaaaggataaacccaccttggacattgaactgctaaagactgaggtgacaaaccctgccgtgctcaggaaactgtgcatcgaagctaagatatctaataccacgaccgatagccggtgtccaacacaaggagaggccactcttgtcgaagagcaggacgcaaactttgtttgccgccgaaccttcgtggatagaggctggggtaatgggtgtggactgtttggcaaaggctccttgattacatgcgctaagttcaagtgcgtaactaaactcgaggggaagatcgtgcagtacgaaaacctgaaatattcagtcattgtgaccgttcacacaggagaccagcatcaagtgggtaatgagagtaccgaacacggcactacggccacaatcaccccccaggcgcctagcactgagatccagttaaccgactacggggccctgacactcgattgttctccaaggaccggacttgactttaacgaaatggtcctgttgactatgaaggagaaatcctggctagtgcataagcagtggttcctggatctcccgctgccctggacatcaggcgcaagcacgagtcaagagacctggaatcggaaagaccttctggtaacttttaagacagctcacgccaagaaacaggaagttgtggtcttgggttctcaggagggggctatgcacaccgccctcacaggcgcaactgaaattcaaacctccggaacgaccacaatattcgccggccatctgaagtgccgtttaaaaatggataagctgactctaaaagggatgagctatgtgatgtgtaccggatcgttcaagctcgagaaggaagtcgctgagacacagcacggtactgtgctggttcagatcaaatacgagggcaccgacgcgccttgcaagattccattttctacgcaggatgaaaaaggggtgacacaaaacggacgccttatcaccgcaaatcccatagtaactgacaaggagaaacctgtcaacattgaagccgagccacccttcggcgagtcctatatcgtgatcggtgctggggaaaaggccttgaagctgtcatggtttaaaaagggcagtagcattggaaaaatgttcgaggcaacagccagaggcgctaggcggatggccatcctcggggataccgcatgggactttggatccattggtggcgttttcacttctgtggggaagctggtccatcagatatttggaaccgcgtacggcgtgcttttcagcggtgtatcatggacaatgaaaatcgggattggcgtgctgttgacgtggctcggactgaatagtcgatccaccagcttatctatgacttgtatcgctgttggcctggtcacactatacctcggggtgatggtgcaggccgattcaggatgcgtcatcaactggaagggccgcgaactgaagtgtggtagtgggatttttgttaccaatgaggtgcacacatggactgaacagtataaattccaagcagacagcccgaagagactttccgccgctataggaaaagcctgggaggagggcgtgtgcggtatcaggtctgcaacccggttggaaaacattatgtggaagcagatctcgaacgagctgaatcatattctcctggaaaacgacatgaaatttacggtagtcgtgggcgatgttgctgggatcttagcccagggaaagaaaatgatacgccctcagcccatggagtacaagtatagctggaagtcctggggcaaagcgaagatcattggggccgacgtgcaaaatacaaccttcatcattgatggaccaaacactcctgaatgtcccgacgatcagagagcttggaatatctgggaggtcgaggactacggctttggtatattcaccacaaacatttggctgaaacttagggattcatatactcaggtgtgcgaccaccgtttgatgagtgcagccatcaaggattctaaagctgttcacgccgacatggggtactggattgaaagcgagaagaatgaaacctggaagctcgcacgggcgtccttcatcgaggtgaaaacatgtatatggccaaagtcacatacgctgtggagcaacggagtactagaatctgagatgatcattcccaaaatctatggcggtcctatttcccagcacaattaccgaccaggctactttacccaaactgccgggccgtggcatctgggaaagctcgagctggatttcgacctttgcgaaggcacaaccgtcgtggtggatgagcactgcgggaacagaggacccagtttgaggactacaaccgtcacgggcaaaatcatacacgaatggtgttgccgcagctgtactctgcctccattacggtttaagggtgaggacgggtgctggtatggaatggagattagacccgttaaggaaaaagaggaaaatctcgtgaagtctatggtatccgctggctcaggtgaggtggacagtttcagcctgggccttctgtgtatctcgatcatgattgaagaggtcatgaggtcccgctggtctcgaaaaatgttgatgaccgggacactcgccgtgtttttcctgctaatcatgggacagctgacctggaacgatctcattcggctgtgcataatggttggcgcaaatgctagcgaccgtatggggatgggaactacataccttgccttgatggcaacctttaagatgagacctatgttcgccgtgggcctgttatttaggcgcctcacatcacgggaggtcctgcttctgactatcggtctaagtctcgtggcttccgttgaactgccaaactctttggaggaactgggggatggattagcgatgggcattatgatcctcaaactgcttaccgacttccagagccatcaactgtgggccacgttgctctccctgacatttattaagaccactttctcactacactatgcatggaagaccatggctatggtgctgagcatcgtcagtctttttcccctctgtctgtctacaacttcccagaaaaccacgtggttgccggtactgttaggcagcctcgggtgcaagcctctgacaatgttccttatagccgagaataaaatctggggaagaaagtcgtggccactgaacgaaggtattatggccgtgggcatcgtttcaattttgctctctagtctgctaaaaaacgatgtgcccctggctgggcctcttatcgcaggaggcatgctcatagcctgttacgtcatttccggtagctctgcggacctgagcttggagaaggctgccgaggtgtcctgggaagaggaagcagagcattcaggggccagtcacaatatcttagtagaagtgcaggatgacggaaccatgaaaatcaaggatgaggagagggacgatactctgacaattctcctgaaggctacccttctggcagtcagcggcgtttatcccttgtctataccagccactctattcgtgtggtacttttggcagaaaaagaaacaacgatccggcgtgctgtgggacacaccttcacccccagaagtcgagcgcgcggtgctcgatgacgggatctatcggattatgcagagaggactgcttggtaggagtcaggttggcgtaggggtgttccaggaaaacgtctttcataccatgtggcacgtgacgcgtggagctgttttaatgtaccaaggcaagcgcctggagccgagctgggcctccgtgaaaaaggacctcatctcttacggtgggggatggcggttgcagggctcgtggaatactggcgaggaagtccaggtgattgcagtagagcctgggaagaaccccaaaaatgtccagaccgccccaggaacattcaagaccagcgaaggtgaggtgggcgctatcgccctggattttaaacccgggacatcaggatcccctatagttaacagagaaggcaagatcgtgggtctctatgggaatggagtcgtgactaccagtggcacgtacgtttctgcaattgctcaagccaaagcgagccaggagggcccactgcccgagatcgaagacgaggtgttcaggaagcgaaaccttacaattatggatctgcaccctgggtccggaaagactcggcgctatttgccggccatcgtcagagaagcaataaaaaggaagctacggaccctgattctcgctccaacacgagtggtagcctcagagatggctgaagcattaaaaggtatgcccatcagataccagaccactgccgtgaagtctgagcataccggcaaagagatcgttgacctgatgtgccacgccacatttacgatgcgccttctgagccctgtcagggtgccaaattataacatgattatcatggatgaagctcatttcactgaccccagttccatagcggcacgtgggtacattagcacccgggtgggaatgggcgaggccgctgccatctttatgacagcaacccctccgggttctgtcgaagccttcccccaatcaaatgctgtaattcaggatgaggaaagagacatcccagagaggtcctggaacagtgggtatgagtggataactgattttcctggaaagacagtgtggttcgttcccagcattaagtcgggcaatgacatcgcgaactgtctccgcaaaaatggcaagcgagtgatccagttgtctagaaaaaccttcgatacggaataccagaagactaaaaacaacgactgggactacgtcgtgacaaccgatatttccgagatgggggccaattttcgggcagacagggttatcgatccacgccgttgcctgaagcctgtgattctcaaggacggacccgaaagagtcatactggctggtccaatgccggtgaccgtagccagcgcagcccaacggaggggccgcatcgggcgaaaccacaataaagagggagatcagtatatttacatgggccagcctcttaacaatgacgaggatcatgctcactggactgaagccaagatgctactggacaacatcaatacacccgagggtatcattccagcgttgttcgaacccgagagagaaaaatcagcagccatagatggggagtatcggttaaggggcgaggctcgcaagacctttgtggaactgatgagaaggggagacctccctgtttggctgagttacaaagtcgcctctgagggcttccagtattccgatcggcgttggtgctttgacggggaacgcaacaatcaagtgcttgaggaaaacatggatgtggagatctggacaaaggagggagaacgaaaaaagctgagaccaaggtggctcgacgctcggacttacagcgaccccttggcactgcgcgagttcaaggaatttgccgctggtagaaggtcagtcagtggcgatctaattctggagatcgggaaactccctcagcaccttacgcagcgggcccagaatgcactggacaacttagttatgttgcataatagcgaacaaggaggccgagcgtatagacacgccatggaggagctgccggataccattgaaacactcatgctgcttgctctgatcgccgtgctcactggtggggtaaccttgttctttctgtccggccgcggattaggcaagacatctatagggctactgtgtgtgatggcaagctccgtcctcctttggatggcttcagtggagccacattggatcgccgcatctattatcctggaattctttttgatggttctgctcattcccgagcctgacaggcagcggaccccccaggataaccagctggcctacgtggtcatcggacttctcttcatgatactgactgtagctgcgaatgagatgggtttgctggaaacgaccaaaaaggacttaggcattgggcacgtggccgttgagaaccaccatcacgcagctatgctagatgtggacctgcatccagccagtgcctggacactctacgcagtcgctactaccatcattacacctatgatgcgtcacaccatcgaaaacactacagccaatatatcgcttacggcgatcgctaaccaagccgcaattctgatgggattggataaaggctggcccatcagcaagatggacattggtgtgccactgctcgccctggggtgctattcccaggtcaatcctcttaccttaactgctgcagtgctgatgctcgttgcccattacgcgatcataggcccgggattgcaggctaaggccacaagagaggcacaaaaaaggaccgccgctggcattatgaagaaccccaccgtggatgggatcgtagccatcgacctggatccagtggtctatgacgcaaaatttgaaaagcagctaggacagattatgctgctcatcctttgtacatctcagatactgttgatgcgcactacgtgggctctgtgcgagtcaattaccctcgccacaggccctctgactaccttatgggagggtagccccgggaaattctggaatacaaccatcgcggtttccatggccaacattttccggggaagttaccttgcaggcgctggtctggccttttctctcatgaagagcctaggcgggggacgaagaggcactggggcacaaggagaaacgctgggcgagaagtggaaaaggcagttgaatcagctgtcaaagtccgaattcaacacatataaacgcagtggtatcatggaggtggaccggagcgaagctaaggaggggctcaaaagaggagagaccactaagcacgccgtctctcgtggcaccgccaagcttaggtggtttgtggaacggaatctggtaaaaccagagggtaaggtgatagatttgggctgtgggcgcggaggctggtcctactattgcgcggggctgaaaaaggttacagaagtgaaaggatacactaagggcggtcctgggcacgaggaacccatcccgatggctacctacggatggaacctcgtcaaattacattcaggcaaggacgtgttctttattccacctgagaagtgtgatacactgctttgcgacatcggcgagagctcgcccaatccaacgattgaagaggggcgaaccctgagagtcctaaaaatggtggaaccctggctcaggggaaaccagttctgtatcaagattctgaatccttatatgccgtctgttgtagagactttggagcaaatgcagcggaaacacggtggcatgctggtgcgcaaccccctcagtagaaattccacacatgaaatgtactgggtcagctgcgggaccggaaacatcgtgtcagcagttaatatgacttccaggatgcttctgaaccgatttacaatggcccaccggaagccaacctatgagcgtgatgtggacttaggcgctggtacgagacacgtcgccgtggaacctgaggtagcaaacctggatataattgggcagcgcatcgaaaatatcaaacatgagcacaagtctacctggcattacgacgaggataacccctataagacatgggcctaccacggaagctatgaagtgaaacctagtggctccgctagctctatggttaatggcgtcgtgaagttgctcactaaaccatgggacgtgattcccatggtcacccagatagcgatgacagatactacccctttcgggcaacagagggtttttaaggagaaagtggacacacggaccccaaaggccaagagaggaactgcacagatcatggaagtaacggctaaatggctgtggggtttcctatcacgcaacaagaaacccaggatttgtacacgagaggaatttacccggaaggtgagaagtaatgccgcaatcggcgccgtcttcgtggacgagaaccaatggaattccgctaaagaggccgttgaagatgagaggttttgggaccttgtgcatcgcgaacgtgagctgcacaagcaggggaagtgcgcgacttgcgtctacaacatgatgggaaaacgggaaaagaaactcggcgagttcggtaaggcaaaagggagcagagccatttggtacatgtggctgggagctaggttcttggagtttgaagccctgggcttcatgaatgaggatcactggttttctcgcgaaaactcgctctcaggcgtggagggggagggacttcataagctgggttatatcttacgagacataagcaaaatcccgggcgggaatatgtacgcagatgacaccgctggatgggatacacggattacggaagacgatctgcagaacgaggccaagatcaccgacattatggaacctgagcacgctttgctcgccacttccatcttcaagctgacatatcagaataaagtagttagagtgcaaaggccagcaaagaacggcaccgtcatggatgtgataagtcgcagagaccagcggggttctgggcaggtgggaacttacggcctaaatacatttaccaacatggaagcgcagcttattaggcaaatggagagcgagggcatcttctccccctcagaactggagacacctaacctcgccgggcgtgtcctggattggttggaaaaacatggagttgagcgattaaagcgcatggctatcagtggtgacgactgtgtggtaaaaccaattgatgacagatttgccactgcactgaccgctctcaatgatatgggcaaggtgcggaaggacataccccagtgggaaccgtctaaagggtggaacgattggcagcaggtccctttctgcagccaccactttcatcaacttatcatgaaggacggaagggagattgtggttccctgtcgcaatcaggatgagctggtgggcagagcccgggtctcccagggtgcagggtggtcactaagggaaacggcctgcctgggaaaaagctatgcgcagatgtggcaactcatgtacttccaccgacgtgacttgagactggctgccaacgcaatctgttctgccgtgccagtagattgggttcctacctcccgcacaacttggagtattcatgctcaccatcagtggatgaccacagaggacatgcttagcgtgtggaatcgggtctggatcgaagagaacccctggatggaagataagactcacatatcgtcctggggcgacgtgccatatctgggcaaaagggaggaccagtggtgcgggtctctcatcggattaaccgccagagcaacgtgggctacaaatattcaagttgccatcaaccaggtgcgccggctgattggtaatgagaactacttggattacatgacctcaatgaagaggtttaagaatgaaagcgaccccgagggcgcgctgtggtga

SEQ ID NO: 13833 - RNA, 9879 nt, synthetic construct
  misc_feature 1..9879: note = derived and/or modified CDS sequence (opt3) from DENV-1__FJ898398__SS-prME
  source 1..9879: mol_type = other RNA
tccgtgaccatgctgctcatgcttatgcccacagcactggctttccacttgactacgagaggaggggaacctcatatgatcgtctccaagcaggaaagggggaaatctttactgtttaagacctcagccggtgttaacatgtgcacactaattgccatggacctcggcgagttctgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaagacgcaaactttgtttgccgccgaacattcgtggatagaggctggggtaatgggtgtggactgtttggcaaaggctccttgataacttgcgctaagttcaagtgcgtaaccaaactcgaggggaagattgtgcagtacgaaaacctgaaatattcagtcatcgtgacagttcacaccggagaccagcatcaagtgggtaatgagagtactgaacacggcacgacagccaccattactccccaggcgcctagcaccgagatccagttaacagactacggggccctgaccctcgattgttctccaaggactggacttgactttaacgaaatggtcctgttgacaatgaaggagaaatcctggctagtgcataagcagtggttcctggatctcccgctgccctggacgtcaggcgcaagcaccagtcaagagacttggaatcggcaggaccttctggtaacatttaaaaccgctcacgccaagaagcaggaagttgtggtcttgggttctcaagagggggctatgcacacagccctcactggcgcaaccgaaatccagacgtccggaaccacaactattttcgccggccatctgaaatgccgtttaaagatggataaactgaccctaaaggggatgagctatgtgatgtgtacaggatcgttcaaactcgagaaggaagtcgctgagactcagcacggtaccgtgctggttcagataaagtacgagggcacggacgcgccttgcaaaatcccattttctacacaagatgaaaagggggtgacccagaacggacgccttattactgcaaatcccatcgtaacagacaaagagaagcctgtcaacatagaagccgagccacccttcggcgagtcctatattgtgatcggtgctggggaaaaagccttgaagctgtcatggtttaagaaaggcagtagcatcggaaagatgttcgaggcaaccgccagaggcgctaggcggatggccattctcggggatactgcatgggactttggatccatcggtggcgttttcacctctgtggggaaactggtccatcagatttttggaacagcgtacggcgtgcttttcagcggtgtatcatggacgatgaagatagggatcggcgtgctgttgacctggctcggactgaatagtcgatccactagcttatctatgacatgtattgctgttggcctggtcaccctatacctcggggtgatggtgcaggccgattcaggatgcgtcatcaactggaaaggccgcgaactgaagtgtggtagtgggatctttgttacaaatgaggtgcacacttggaccgaacaatataagttccaggcagacagcccgaaaagactttccgccgctattggaaaggcctgggaggagggcgtgtgcggtataaggtctgcaacgcggttggaaaacatcatgtggaaacagatttcgaacgagctgaatcatatcctcctggaaaacgacatgaagttaacagtagtcgtgggcgatgttgctgggattctggcccagggcaagaagatgatccgccctcaacccatggagtacaaatatagctggaagatatggggcaaggcgaaaatcattggggccgacgtgcagaataccacttttatcattgatggaccaaacacccctgaatgtcccgacgatcagagagcttggaatatctgggaggtcgaggactacggcttcggtatatttacaactaacatttggcttaagttgagggattcctatacccaggtgtgcgaccaccgtctcatgtcagcagccatcaaagatagtaaggctgttcacgccgacatggggtactggattgaatctgagaaaaatgaaacatggaagctggcacgggcgagcttcatcgaggtgaagacgtgtatatggccaaaatcccataccctatggtcaaacggagtactggaaagcgagatgatcattcccaagatctatggcggtcctatttctcaacacaattaccgaccaggctacttcactcagacagccgggccgtggcatctcggaaaactggagcttgattttgacttgtgcgaaggcaccactgtcgtggtggatgagcactgcgggaacagaggaccctccctgaggacaaccacggtcactggcaagatcatacacgaatggtgttgccgcagttgtaccttacctccactccggttcaaaggtgaggacgggtgctggtatggaatggagattagacccgttaaggaaaaggaggaaaatctggtgaaaagcatggtatctgctggctccggtgaggtggactcatttagtcttggcctgttgtgtatcagcatcatgattgaagaggtcatgaggtcgcgctggtcccgaaagatgctcatgacagggaccctggccgtgttctttctactgatcatgggacagctcacttggaacgatctgattcggctttgcataatggttggcgcaaatgcttctgaccgtatggggatgggaacaacctacttggccctgatggcaacattcaaaatgagacctatgtttgccgtgggcttactcttcaggcgcctgactagccgggaggtccttctgctaaccatcggtctctcactggtggctagtgttgaattgccaaactccctggaggaattaggggatggactcgcgatgggcattatgatcctgaaacttctgacggactttcaatctcatcagttgtgggccacactcctgagcctaaccttcattagaactaccttttccctgcactatgcatggaaaacaatggctatggtgctttcaatcgtcagcctcttccccctgtgtttgagtactacctctcagaagacgacatggctgccggtattactcggctccctggggtgcaagcctcttaccatgtttctgatagccgagaataaaatctggggaagaaagagctggccattgaacgaaggtattatggccgtgggcatcgtttcgattctcctgtcatctctactgaaaaacgatgtgccccttgctgggcctctcatcgcaggaggcatgctgatagcctgttacgtcattagtggttccagcgcggacttgtctttagagaaggctgccgaggtgagctgggaagaggaagcagagcattccggggcctcacacaatatcctggtagaagtgcaggatgacggaactatgaaaatcaaggatgaggagcgagacgatacactcaccattctgcttaaagctactctgttggcagtcagtggcgtttatcccctaagcataccagccacactgttcgtgtggtacttctggcaaaagaagaaacagcgctctggcgtgctctgggacaccccttcacccccagaagtcgagcgggcggtgctggatgacgggatctatagaattatgcagaggggacttttaggtcgtagccaggttggcgtaggggtgtttcaagaaaacgtcttccatacgatgtggcacgtgactcgcggagctgttctgatgtaccagggcaagcggctcgagccgagttgggccagcgtgaaaaaggacttgatctcctacggtgggggatggagactgcagggctcttggaataccggcgaggaagtccaggtgattgcagtagagcctgggaaaaaccccaagaatgtccaaacagccccaggaacctttaagacatcggaaggtgaggtgggcgctatcgccctcgatttcaaacccgggactagcggatcacctatagttaacagggaaggcaagatcgtgggtctgtatgggaatggagtcgtgaccacgtccggcacatacgttagtgcaattgctcaggccaaagcgtctcaggagggcccacttcccgagatcgaagacgaggtgtttcgaaagcggaacctgactattatggatttgcaccctgggagcggaaaaacccgcagatatctaccggccatcgtcagggaagcaataaagcggcgactgagaacactcattttagctccaacccgcgtggtagcctccgagatggctgaagcactgaagggtatgcccatcaggtaccaaactaccgccgtgaaatcagagcatacaggcaaggagatcgttgaccttatgtgccacgccacgttcactatgcgtctgctctctcctgtccgggtgccaaattataacatgattatcatggatgaagctcattttaccgaccccagcagtatagcggcaagagggtacatttccacaagggtgggaatgggcgaggccgctgccatcttcatgaccgcaactcctccgggtagcgtcgaagcctttccccagtctaatgctgtaattcaggatgaggaacgcgacatcccagagcgatcatggaactccgggtatgagtggataacagatttccctggaaaaaccgtgtggtttgttcccagtattaagagcggcaatgacatcgcgaactgtttgaggaaaaatggcaagcgggtgatccagctgtcgaggaagacgttcgatactgaataccagaaaacaaagaacaacgactgggactacgtcgtgaccaccgatatttctgagatgggggccaatttccgcgcagaccgtgttatcgatccaagacggtgcctcaaacctgtgattctgaaggacggacccgaaagggtcatacttgctggtccaatgccggtgactgtagcctccgcagcccagcgccgaggcagaatcgggcggaaccacaataaagagggagatcagtatatttacatgggccagcctctaaacaatgacgaggatcatgctcactggacagaagccaagatgctgttggacaacatcaatacccccgagggtatcattccagcgttatttgaacccgagagggaaaagagcgcagccatagatggggagtatcgcctgagaggcgaggctaggaaaacattcgtggaactcatgcggcgtggagacctgcctgtttggctttcatacaaggtcgccagtgagggctttcaatattctgatcgccgatggtgcttcgacggggaaagaaacaatcaggtgctggaggaatccatggatgtggagatctggactaaagagggagaaaggaagaaactccggccacgctggttggacgctagaacgtacagcgaccccctggcactaagggagtttaaggagttcgccgctggtcggcgatcagtcagtggcgatctgattctcgagatcgggaaacttcctcagcacctgacccagagagcccaaaacgcattagacaatttggttatgctgcataacagcgaacagggaggccgcgcgtataggcacgccatggaggagctcccggatacaattgaaactctgatgcttctggctctcatcgccgtgttgaccggtggggtaacactgtttttcttatccggccggggactaggcaagacctctatagggctgctctgtgtgatggcaagctccgtccttctgtggatggcttcagtggagccacattggatcgccgcatctattatcttggaatttttcctgatggttctcctgattcccgagcctgaccgtcagagaactccccaggataatcaacttgcctacgtggtcatcggactcctgtttatgatattgacggtagctgcgaacgagatgggtctgttagaaaccacaaagaaagacctaggcattgggcacgtggccgttgagaatcaccatcacgcagctatgctggatgtggacctccatccagccagtgcctggactctttacgcagtcgctaccacaatcattacccctatgatgaggcacactatcgaaaacacaacggccaacatatcgctgaccgcgatcgctaatcaggccgcaattttgatgggactggataagggctggcccatcagcaaaatggacattggtgtgccactcctggcccttgggtgctattcccaggtcaaccctttaactctgacagctgcagtgctcatgttggttgcccattacgcgatcataggcccgggactgcaagctaaggccacccgcgaggcacagaaacggaccgccgctggcattatgaagaatcccacagtggatgggatcgtagccatcgacctagatccagtggtctatgacgcaaagttcgaaaaacagctgggacagattatgctccttatcctgtgtacttctcaaatattgctgatgcgaacgacctgggctctctgcgagtcaattacactggccactggccctttaaccacactttgggagggtagccccgggaagttttggaacaccactatcgcggtttccatggccaatattttcagaggaagttacctggcaggcgctggtctcgccttctctctaatgaaaagcctgggcgggggaaggcgcggcacgggggcacagggagaaacattgggcgagaagtggaaacggcagctgaaccagctctcaaagtccgaatttaatacctataagagaagtggtatcatggaggtggaccgtagcgaagctaaagaggggcttaagaggggagagactaccaaacacgccgtctctcggggcacagccaagctgcgctggttcgtggaacgaaacttggtaaaaccagagggtaaggtgatagatctgggctgtgggagaggaggctggtcctactattgcgcggggctcaagaaagttactgaagtgaagggatacaccaaaggcggtcctgggcacgaggaacccatcccgatggctacatacggatggaatttagtcaagctgcattcaggcaaagacgtgtttttcattccacctgagaagtgtgatacgcttctgtgcgacatcggcgagagctcgcccaacccaaccattgaagaggggaggactctacgggtcctcaaaatggtggaaccctggctgcgcggaaatcaattttgtatcaagattttgaacccttatatgccgtctgttgtagagacactggagcagatgcagagaaagcacggtggcatgctcgtgaggaatccccttagtcgaaactccacccatgaaatgtactgggtcagctgcgggactggaaatatcgtgtcagcagttaacatgacatcccggatgctgttaaatcgtttcaccatggcccacagaaaaccaacgtatgagcgcgatgtggacctgggcgctggtaccaggcacgtcgccgtggaacctgaggtagcaaacttggatataattgggcagcggatcgaaaacatcaagcatgagcacaaatctacatggcattacgacgaggataatccctataagacttgggcctaccacggaagctatgaagtgaaacctagtggctccgctagctctatggttaacggcgtcgtgaagctcctgaccaagccatgggacgtgattcccatggtcacacaaatagcgatgactgataccacaccttttgggcagcagagagttttcaaagagaaggtggacacccgcactccaaaagccaagaggggaacggcacaaatcatggaagtaacagctaaatggctatggggttttctttcacgaaataagaagccccggatttgtaccagagaggagttcactaggaaagtgcgcagtaacgccgcaatcggcgccgtctttgtggacgagaatcagtggaactccgctaaggaggccgttgaagatgagcgtttctgggacctggtgcatcgggaaagagagctccacaaacaggggaagtgcgcgacctgcgtctacaatatgatgggaaaaagggaaaagaagctgggcgagtttggtaaagcaaaggggagccgcgccatttggtacatgtggttgggagctcgattcctggagttcgaagccctcggctttatgaacgaggatcactggttctctcgggaaaattcgctttcaggcgtggagggggagggactgcataaattaggttatatcctgagagacataagcaagatcccgggcgggaacatgtacgcagatgacacagctggatgggatacgaggattaccgaagacgatttgcagaatgaggccaaaatcactgacattatggaacctgagcacgctctcctggccaagtccatctttaaactaacatatcaaaacaaggtagttcgcgtgcagagaccagcaaagaatggcaccgtcatggatgtgataagtcggagggaccagcgtggttctggacaggtgggaacttacggccttaacacattcaccaatatggaagcgcaactgattcgacagatggagagcgagggcatcttttccccctcagaactcgagacacctaacctggccgggcgcgtcttgaactggttagaaaaacatggagttgagagactgaagcggatggctatcagtggtgatgactgtgtggtaaaaccaattgacgataggttcgccactgcactcaccgctcttaatgacatgggcaaggtgcgcaaagatataccccagtgggaaccgtctaaggggtggaacgactggcagcaagtccctttttgcagccaccacttccatcagctgatcatgaaggatggaagagagattgtggttccctgtcggaatcaggacgagctagtgggcagggcccgagtctcccagggtgcagggtggtcactgcgtgaaacggcctgcctcggaaaaagctatgcgcaaatgtggcagttgatgtactttcacagacgcgatctgcggcttgctgccaacgcaatctgttctgccgtgccagtagactgggttcctacctccaggacaacttggagtattcatgctcaccatcagtggatgaccacagaggatatgctgagcgtgtggaatagagtctggatcgaagagaacccctggatggaagacaagactcacgtgtcgtcctggggcgatgttccatatctcggcaaacgcgaggaccaatggtgcgggtctttaataggactgaccgcccgggcaacgtgggctacaaatatccaggtggccattaaccaggtcaggcgattgctgggtaatgagaactacctcgactacatgacctcaatgaagagattcaaaaatgaaagcgatcccgagggcgcgctttggtga

SEQ ID NO: 13834 - RNA, 9879 nt, synthetic construct
  misc_feature 1..9879: note = derived and/or modified CDS sequence (opt3) from DENV-1__FJ898399__SS-prME
  source 1..9879: mol_type = other RNA
agcgtgacaatgctgctcatgcttatgcccacagcactggctttccacttgactacgcgaggcggggaacctcatatgatcgtctccaagcaggaaaggggaaaatctttactgtttaagacatcagccggtgttaacatgtgcacactgattgcaatggacctcggcgagttctgtgaagatactatgacctacaaatgcccgcggattacagaagcggaaccggacgatgtggactgttggtgcaatgctaccgatacttgggtaacatatgggacctgtagtcagacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagggatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaagacgcaaactttgtttgccgccgaacattcgtggatagaggctggggtaatgggtgtggactgtttggcaaaggctccttgataacttgcgctaagttcaagtgcgtaaccaaactcgaggggaagattgtgcagtacgaaaacctgaaatattcagtcatcgtgacagttcacaccggagaccagcatcaagtgggtaatgagagtactgaacacggcacgacagccaccattactccccaggcgcctagcaccgagatccagttaacagactacggggccctgaccctcgattgttctccaaggactggacttgactttaacgaaatggtcctgttgacaatgaaggagaaatcctggctagtgcataagcagtggttcctggatctcccgctgccctggacgtcaggcgcaagcaccagtcaagagacttggaatcggaaagaccttctggtaacatttaagaccgctcacgccaagaaacaggaagttgtggtcttgggttctcaggagggggctatgcacacagccctcactggcgcaaccgaaatccaaacgtccggaaccacaactattttcgccggccatctgaagtgccgtttaaaaatggataagctgaccctaaaagggatgagctatgtgatgtgtacaggatcgttcaagctcgagaaggaagtcgctgagactcagcacggtaccgtgctggttcagataaaatacgagggcacggacgcgccttgcaagatcccattttctacacaggatgaaaaaggggtgacccaaaacggacgccttattactgcaaatcccatcgtaacagacaaggagaaacctgtcaacatagaagccgagccacccttcggcgagtcctatattgtgatcggtgctggggaaaaggccttgaagctgtcatggtttaaaaagggcagtagcatcggaaaaatgttcgaggcaaccgccagaggcgctaggcggatggccattctcggggatactgcatgggactttggatccatcggtggcgttttcacctctgtggggaagctggtccatcagatttttggaacagcgtacggcgtgcttttcagcggtgtatcatggacgatgaaaatagggatcggcgtgctgttgacctggctcggactgaatagtcgatccactagcttatctatgacatgtattgctgttggcctggtcaccctatacctcggggtgatggtgcaggccgattcaggatgcgtcatcaactggaagggccgcgaactgaagtgtggtagtgggatctttgttacaaatgaggtgcacacttggaccgaacagtataaattccaagcagacagcccgaagagactttccgccgctattggaaaagcctgggaggagggcgtgtgcggtataaggtctgcaacgcggttggaaaacatcatgtggaagcagatttcgaacgagctgaatcatatcctcctggaaaacgacatgaaattaacagtagtcgtgggcgatgttgctgggattctgggacagggcaagaaaatgatccgccctcagcccatggagtacaagtatagctggaagtcctgggggaaagccaagataatcggagcggacgcccaaaataccacttttattatcgatggcccaaacacccctgaatgtcccgacgatcagagagcttggaatatttgggaggtggaggactacggtttcgggatctttacaactaacatatggcttaaattgagggattcatatacccaggtctgcgaccaccgtctcatgagtgcagccattaaggattctaaagctgtgcacgccgacatgggatactggatcgaaagcgagaagaatgaaacatggaagctggcacgggcgtccttcattgaggttaaaacgtgtatctggccaaagtcacataccctatggagcaacggcgtgctggaatctgagatgataatccccaaaatttatggtggccctatctcccagcacaattaccgaccagggtacttcactcaaacagccggaccgtggcatctcggcaagctggagcttgattttgacttgtgcgaagggaccactgtagtcgtggatgagcactgcggaaacagaggccccagtctgaggacaaccacggtgactggtaaaattatccacgaatggtgttgccgcagctgtaccttacctccactccggttcaagggggaggacggatgctggtatggcatggagataagacccgtcaaggaaaaagaggaaaatctggttaagtctatggtgtccgctggttcaggcgaggtagacagttttagccttgggctgttgtgtatttcgatcatgatcgaagaggtgatgaggtcccgctggtctcgaaaaatgctcatgacaggaaccctggccgtcttctttctactgattatgggccagctcacttggaacgatctgatccggctttgcattatggtgggggcaaatgctagcgaccgtatgggaatgggcacaacctacttggccctgatggcaacattcaagatgagacctatgtttgccgttggtttactcttcaggcgcctgacttcacgggaggtgcttctgctaaccatagggctcagtctggtcgcttccgtggaattgccaaactctctggaggaattaggagatggcctcgcgatgggcatcatgattctgaaacttctgacggactttcagagccatcaattgtgggccacactcctgtccctaaccttcatcaagactaccttttcactgcactatgcatggaagacaatggctatggttcttagcattgtgagtctcttccccctgtgtttgtctactacctcccagaaaacgacatggctgccggtcttactcgggagcctgggatgcaagcctcttaccatgtttctgatcgccgagaataaaatatggggtagaaagtcgtggccattgaacgaaggcatcatggccgtagggattgtgtcaatcctcctgtctagtctactgaaaaacgatgttccccttgctggacctctcattgcaggcggtatgctgatcgcctgttacgtgatatccgggagctctgcggacttgagcttagagaaggctgccgaggtctcctgggaagaggaagcagagcattcaggagccagtcacaatattctggtggaagtacaggatgacggcactatgaaaatcaaggatgaggagagggacgatacactcaccatcctgcttaaggctactctgttggcagtgagcggcgtctatcccctatctattccagccacactgttcgtttggtacttctggcagaaaaagaaacaacgatccggggtgctctgggacaccccttcacccccagaagtggagcgcgcggtcctggatgacggaatatatcggatcatgcagagaggtcttttaggcaggagtcaggtgggggttggagtatttcaggaaaacgtgttccatacgatgtggcacgtcactcgtggcgctgtgctgatgtaccaaggtaagcgcctcgagccgagctgggcctccgttaaaaaggacttgatttcttacgggggaggctggcggctgcagggctcgtggaataccggggaggaagtgcaggtcatcgcagtggagcctggaaagaaccccaaaaatgtacagacagccccaggtacctttaagacaagcgaaggcgaggtcggggctattgccctcgatttcaaacccggaacttcaggctcccctatcgtgaacagagaaggtaagatagttgggctgtatggaaatggcgtggtcaccacgagtggcacatacgtgtctgcaatcgctcaagccaaagcgagccaggaggggccacttcccgagattgaagacgaggtttttaggaagcgaaacctgactatcatggatttgcaccctggatccggtaagacccggcgctatctaccggccattgtgagagaagcaatcaaaaggaagctgcggacactcatattagctccaacccgagtcgtggcctcagagatggctgaagcactgaaaggcatgcccattagataccagactaccgccgtaaagtctgagcatacagggaaagagatcgtggaccttatgtgccacgccacgttcactatgcgcctgctcagccctgttagggtcccaaattataacatgatcattatggatgaagctcattttaccgaccccagttccatcgcggcacgtggatacataagcacacgggtgggcatgggtgaggccgctgccattttcatgaccgcaactcctccggggtctgtggaagcctttccccaatcaaatgctgtcatccaggatgaggaaagagacattccagagaggtcctggaacagtggatatgagtggatcacagatttccctggcaagaccgtatggtttgtgcccagcataaagtcgggcaatgacattgcgaactgtttgcgcaaaaatgggaagcgagttatccagctgtctagaaaaacgttcgatactgaataccagaagaccaagaataacgactgggactacgtggtcaccaccgatatctccgagatgggagccaatttccgggcagacagggtgattgatccacgccgttgcctcaagcctgttatcctgaaggacggtcccgaaagagtgattcttgctggcccaatgccggtcactgtggccagcgcagcccaacggagggggcgcataggacgaaaccacaataaagagggcgatcagtatatctacatgggtcagcctctaaacaatgacgaggatcatgctcactggacagaagccaagatgctgttggacaacattaatacccccgaggggatcatcccagcgttatttgaacccgagagagaaaaatcagcagccattgatggcgagtatcggctgaggggagaggctcgcaagacattcgtagaactcatgagaaggggcgacctgcctgtgtggcttagttacaaagttgcctctgaggggtttcagtattccgatcggcgttggtgcttcgacggagaacgcaacaatcaagtcctggaggaaaacatggatgtggagatatggactaaggagggtgaaaggaaaaagctcagaccaagatggttggacgctcggacgtacagcgaccccctggcactacgcgagtttaaggagttcgccgctggcagaaggtcagtgagtggggatctgatcctcgagattggaaaacttcctcagcacctgacccagcgggcccagaatgcattagacaacttggtcatgctgcataatagcgaacaaggcggtcgagcgtatagacacgccatggaggagctcccggatacaatcgaaactctgatgcttctggctctcattgccgttttgaccgggggcgtgacactgtttttcttatccggacgcggcctagggaagacctctatcggactgctctgtgtaatggcaagctccgtgcttctgtggatggcttcagtcgagccacattggatagccgcatctatcattttggaatttttcctgatggtgctcctgatccccgagcctgacaggcagcggactccccaggataaccagcttgcctacgttgtgattggtctcctgtttatgatcttgacggtcgctgcgaatgagatgggcctgttagaaaccaccaaaaaggacctagggataggacacgtagccgtggagaaccaccatcacgcagctatgctggatgttgacctccatccagccagtgcctggactctttacgcagtggctaccacaattatcacccctatgatgcgtcacactattgaaaacacaacggccaatatctcgctgaccgcgatagctaaccaagccgcaatcttgatgggcctggataaaggttggcccattagcaagatggacatcggggtcccactcctggcccttggctgctattcccaggtgaatcctttaactctgacagctgcagtcctcatgttggtggcccattacgcgattatcggaccgggcctgcaggctaaggccaccagagaggcacagaaaaggaccgccgctgggataatgaagaaccccacagttgatggaattgtggccatcgacctagatccagtagtgtatgacgcaaaattcgaaaagcagctgggccagatcatgctccttattctgtgtacttctcagatcttgctgatgcgcacgacctgggctctctgcgagtcaataacactggccactggtcctttaaccacactttgggaggggagccccggaaaattttggaataccactattgcggtctccatggccaacatcttccggggcagttacctggccggtgctggcctcgccttctctctaatgaaaagcctagggggaggccgaagagggacgggagcacaaggcgaaacattgggtgagaagtggaaaaggcagctgaatcagctctcaaagtccgaatttaacacctataaacgcagtgggattatggaggttgaccggagcgaagctaaggagggacttaaaagaggcgagactaccaagcacgccgtgtctcgtggtacagccaagctgaggtggttcgtcgaacggaatttggtgaaaccagagggcaaggtaatcgatctggggtgtggacgcggcgggtggtcctactattgcgcgggactcaaaaaggtgactgaagttaaaggctacaccaagggtgggcctggacacgaggaacccataccgatggctacatacggctggaacttagtgaaactgcattcaggcaaggacgtctttttcatcccacctgagaagtgtgatacgcttctgtgcgacattggggagagctcgcccaatccaaccatcgaagagggacgaactctaagagtgctcaaaatggtcgaaccctggctgaggggtaaccagttttgtattaagatcttgaatccttatatgccgtctgtggttgagacactggagcaaatgcagcggcgccacggcgggatgctcgtaagaaacccccttagtagaaattccacccatgaaatgtactgggtgagctgcggaactggcaacattgtctcagcagtgaatatgacatcccgaatgctgttaaaccggttcaccatggcccaccgtaaaccaacgtatgagagagatgttgacctgggtgctgggacccgccacgtggccgtcgaacctgaggtggcaaacttggatatcataggacagaggattgaaaatatcaagcatgagcacaaatctacatggcattacgacgaggataacccctataagacttgggcctaccacggcagctatgaagtaaagcctagtggctccgctagctctatggtgaatggggttgtcaaactcctgaccaagccatgggacgtgatccccatggtgacacagattgcgatgactgataccacaccttttggacaacagcgggtcttcaaagagaaggttgacaccagaactccaaaagccaagcgcggtacggcacagataatggaagtgacagctaagtggctatggggctttctttcaaggaacaaaaagccccgaatctgtacccgggaggagttcactagaaaagtaaggagtaatgccgcaattggggccgtgtttgtcgacgagaaccaatggaactccgctaaggaggccgtggaagatgagcgcttctgggacctggttcatcgtgaacgggagctccacaaacagggaaagtgcgcgacctgcgtgtacaacatgatgggcaagagagagaaaaagctgggtgagtttgggaaagcaaagggaagcagggccatctggtacatgtggttgggcgctcgcttcctggagttcgaagccctcggctttatgaatgaggatcactggttctctcgagaaaactcgctttcaggggtcgagggagagggtctgcataaattaggctatattctgcgggacatcagcaagataccagggggaaatatgtacgcagatgacacagctggctgggatacgagaatcaccgaagacgatttgcagaacgaggccaaaattactgacatcatggaacctgagcacgctctcctggccaagtccatttttaagctaacatatcagaataaagtggtaagggttcaacgcccagcaaagaacggtaccgtgatggatgtcatcagtagacgggaccagagggggtctggacaggtgggcacttacggccttaatacattcaccaacatggaagcgcagctgatacgtcaaatggagagcgaggggatattttccccctcagaactcgagacacctaacctggccggacgagtgttggattggttagaaaaacatggtgtcgagcgcctgaagagaatggctatcagtggcgacgactgtgttgtgaaaccaatcgatgaccggttcgccactgcactcaccgctcttaatgatatggggaaggtaaggaaggacattccccagtgggaaccgtctaaaggatggaacgattggcaacaggtgcctttttgcagccaccacttccatcaactgataatgaaggacggccgcgagatcgtcgtgccctgtagaaatcaggatgagctagttggtcgggccagggtgtcccagggggcaggatggtcactgcgagaaacggcctgcctcggcaaaagctatgcgcagatgtggcaattgatgtactttcaccgtagagacctgcgccttgctgccaacgcaatttgttctgccgtcccagtggattgggtacctacctcccggacaacttggagtatccatgctcaccatcagtggatgaccacagaggacatgctgagcgtttggaatagggtgtggattgaagagaacccctggatggaagataagactcacatctcgtcctggggcgacgtcccatatctcgggaaaagagaggaccagtggtgcggatctttaataggtctgaccgcccgcgcaacgtgggctacaaatatccaagtggccattaaccaggttcggaggttgatcggcaatgagaactacctggattacatgacctcaatgaagcgattcaagaatgaaagcgaccccgagggggcgctctggtga

SEQ ID NO: 13835 - RNA, 9879 nt, synthetic construct
  misc_feature 1..9879: note = derived and/or modified CDS sequence (opt3) from DENV-1__FJ898401__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagttctgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagagcaggacgcaaactttgtttgccgccgaacattcgtggatagaggctggggtaatgggtgtggactgtttggcaaaggctccttgataacttgcgctaagttcaagtgcgtaaccaaactcgaggggaagattgtgcagtacgaaaacctgaaatattcagtcatcgtgacagttcacaccggagaccagcatcaagtgggtaatgagagtactgaacacggcacgacagccaccattactccccaggcgcctagcaccgagatccagttaacagactacggggccctgaccctcgattgttctccaaggactggacttgactttaacgaaatggtcctgttgacaatgaaggagaaatcctggctagtgcataagcagtggttcctggatctcccgctgccctggacgtcaggcgcaagcaccagtcaagagacttggaatcggaaagaccttctggtaacatttaagaccgctcacgccaagaaacaggaagttgtggtcttgggttctcaggagggggctatgcacacagccctcactggcgcaaccgaaatccaaacgtccggaaccacaactattttcgccggccatctgaagtgccgtttaaaaatggataagctgaccctaaaagggatgagctatgtgatgtgtacaggatcgttcaagctcgagaaggaagtcgctgagactcagcacggtaccgtgctggttcagataaaatacgagggcacggacgcgccttgcaagatcccattttctacacaggatgaaaaaggggtgacccaaaacggacgccttattactgcaaatcccatcgtaacagacaaggagaaacctgtcaacatagaagccgagccacccttcggcgagtcctatattgtgatcggtgctggggaaaaggccttgaagctgtcatggtttaaaaagggcagtagcatcggaaaaatgttcgaggcaaccgccagaggcgctaggcggatggccattctcggggatactgcatgggactttggatccatcggtggcgttttcacctctgtggggaagctggtccatcagatttttggaacagcgtacggcgtgcttttcagcggtgtatcatggacgatgaaaatagggatcggcgtgctgttgacctggctcggactgaatagtcgatccactagcttatctatgacatgtattgctgttggcctggtcaccctatacctcggggtgatggtgcaggccgattcaggatgcgtcatcaactggaagggccgcgaactgaagtgtggtagtgggatctttgttacaaatgaggtgcacacttggaccgaacagtataaattccaagcagacagcccgaagagactttccgccgctattggaaaagcctgggaggagggcgtgtgcggtataaggtctgcaacgcggttggaaaacatcatgtggaagcagatttcgaacgagctgaatcatatcctcctggaaaacgacatgaaatttacagtagtcgtgggcgatgttgctgggattttagcccagggaaagaaaatgatccgccctcagcccatggagtacaagtatagctggaagtcctggggcaaagcgaagataatcggggccgacgtgcaaaataccactttcattatcgatggaccaaacacccctgaatgtcccgacgatcagagagcttggaatatttgggaggtcgaggactacggctttggtatcttcacaactaacatatggctgaaacttagggattcatatacccaggtgtgcgaccaccgtttgatgagtgcagccattaaggattctaaagctgttcacgccgacatggggtactggatcgaaagcgagaagaatgaaacatggaagctcgcacgggcgtccttcattgaggtgaaaacgtgtatctggccaaagtcacataccctgtggagcaacggagtactagaatctgagatgataatccccaaaatttatggcggtcctatctcccagcacaattaccgaccaggctactttactcaaacagccgggccgtggcatctgggaaagctcgagctggatttcgacctttgcgaaggcaccactgtcgtggtggatgggcactgcggaaacagaggccccagtttgaggacaaccacggtcactggtaaaattatccacgagtggtgttgccgcagctgtaccctgcctccattacggtttaagggggaagacggatgctggtatggcatggagataagacccgttaaggagaaagaagagaatctcgtgaagtctatggtatccgctggttcaggcgaagtggacagtttcagcctggggcttctgtgtatttcgatcatgatcgaggaagtcatgaggtcccgctggtctcgaaaaatgttgatgacaggaaccctcgccgtgtttttcctgctaattatgggccagctgacttggaacgatctcatccggctgtgcattatggttggggcaaatgctagcgaccgtatgggaatgggcacaacctaccttgccttgatggcaacatttaagatgagacctatgttcgccgtgggtctgttatttaggcgcctcacttcacgggaggtcctgcttctgaccatagggctaagtctcgtggcttccgttgagctgccaaactctttggaagagctgggagatggcttagcgatgggcatcatgattctcaaactgcttacggacttccagagccatcaactgtgggccacattgctctccctgacctttatcaagactaccttctcactacactatgcatggaagacaatggctatggtgctgagcattgtcagtctttttcccctctgtctgtctactacctcccagaaaacgacatggttgccggtactgttagggagcctcggatgcaagcctctgaccatgttccttatcgccgaaaataaaatatggggtagaaagtcgtggccactgaacgagggcatcatggccgtggggattgtttcaatcttgctctctagtctgctaaaaaacgatgtgcccctggctggacctcttattgcaggcggtatgctcatcgcctgttacgtcatatccgggagctctgcggacctgagcttggaaaaggctgccgaggtgtcctgggagaaagaagcagagcattcaggagccagtcacaatattttagtagaagtgcaggatgacggcactatgaagatcaaggatgaggaaagggacgatacactgaccatcctcctgaaagctactcttctggcagtcagcggcgtttatcccttgtctattccagccacactattcgtgtggcatttttggcagaagaaaaagcaacgatccggggtgctgtgggacaccccttcacccccagaggtcgagcgcgcggtgctcgatgacggaatataccggatcatgcagagaggtctgcttggcaggagtcaggttggggtaggagtgttccaggaaaacgtctttcacacgatgtggcacgtgactcgtggcgctgttttaatgtatcaaggtaaacgcctggagccgagctgggcctccgtgaagaaggacctcatttcttacgggggaggctggcggttgcagggctcgtggaataccggggaagaggtccaggtgatcgcagtagagcctggaaaaaaccccaagaatgtccagacagccccaggtaccttcaaaacaagcgaaggcgaggtgggggctattgccctggattttaagcccggaacttcaggctcccctatcgttaacagagaaggtaaaatagtggggctctacggaaatggcgtcgtgaccacgagtggcacatatgtttctgcaatcgctcaagccaaggcgagccaggaggggccactgcccgaaattgaggacgaggtgttcaggaagcgaaaccttactatcatggatctgcatcctggatccggtaaaacccggcgctacttgccggccattgtcagagaagcaatcaagaggaaactacggacactgatactcgctccaacccgagtggtagcctcagagatggctgaagcattaaagggcatgcccattagatatcagactaccgccgtgaaatctgagcacacagggaaggaaatcgttgacctgatgtgccatgccacgtttactatgcgccttctgagccctgtcagggtgccaaattacaacatgatcattatggatgaggctcacttcaccgaccccagttccatcgcggcacgtggatatataagcacacgggtgggcatgggtgaggccgctgccatttttatgaccgcaactcctccggggtctgtcgaagccttcccccaatcaaatgctgtaatccaggatgaggaaagagacattccagagaggtcctggaacagtggatacgaatggatcacagattttcctggcaagaccgtgtggttcgttcccagcataaaatcgggcaatgacattgcgaactgtctccgcaagaatgggaaacgagtgatccagttgtctagaaagacgttcgatactgagtatcagaaaacaaagaacaacgactgggactacgtcgtgaccaccgatatctccgagatgggagccaattttcgggcagacagggttattgatccacgccgttgcctgaagcctgtgatcctcaaagacggtcccgaaagagtcattctggctggcccaatgccggtgactgtagccagcgcagcccaacggagggggcgcataggacgaaaccataataaggagggcgatcagtacatctatatgggtcagcctcttaacaatgacgaagatcacgctcactggacagaggccaaaatgctactggacaacattaatacccccgaggggatcatcccagcgttgttcgaacccgagagagaaaagtcagcagccattgatggcgagtaccggttaaggggagaagctcgcaaaacatttgtggagctgatgagaaggggcgacctccctgtttggctgagttataaggtcgcctctgaggggttccagtactccgatcggcgttggtgctttgacggagaacgcaacaatcaagtgcttgaggaaaacatggatgtggagatatggactaaagaaggtgagcgaaagaagctgagaccaaggtggctcgacgctcggacgtatagcgaccccttggcactgcgcgagttcaaagaatttgccgctggcagaaggtcagtcagtggggatctaatcctggagattggaaagctccctcagcatcttacccagcgggcccagaatgcactggacaacttagttatgttgcacaatagcgaacaaggcggtcgagcgtacagacatgccatggaggaactgccggatacaatcgagactctcatgctgcttgctctgattgccgtgctcaccgggggcgtaacattgttctttctgtccggacgcggcttagggaaaacctctatcggactactgtgtgtgatggcaagctccgtcctcctttggatggcttcagtggagccacactggatagccgcatctatcattctggaattctttttgatggttctgctcatccccgagcctgacaggcagcggactccccaggataaccagctggcctatgtggtcattggtcttctcttcatgatcctgacggtagctgcgaatgaaatgggcttgctggagaccacaaagaaagacttagggataggacacgtggccgttgagaaccatcaccatgcagctatgctagatgtggacctgcacccagccagtgcctggactctctacgcagtcgctaccacaattatcacccctatgatgcgtcatactattgaaaacacaacggccaatatctcgcttaccgcgatagctaaccaagccgcaatcctgatgggcttggataagggttggcccattagcaagatggacatcggggtgccactgctcgccctgggctgctactcccaggtcaatcctcttactttaacagctgcagtgctgatgctcgttgcccactatgcgattatcggaccgggcttgcaggctaaagccaccagagaggcacaaaagaggaccgccgctgggataatgaaaaaccccacagtggatggaattgtagccatcgacctggatccagtggtctacgacgcaaagtttgaaaaacagctaggccagatcatgctgctcattctttgtacttctcagatcctgttgatgcgcacgacctgggctctgtgcgagtcaataacactcgccactggtcctctgaccacattatgggaagggagccccggaaagttctggaataccactattgcggtttccatggccaacatcttccggggcagttatcttgcaggtgctggcctggccttttctctcatgaagagcctagggggaggccgaagagggacgggagcacacggcgagacactgggtgagaaatggaagaggcaattgaatcagctgtcaaaatccgaattcaacacctacaagcgcagtgggattatggaggtggaccggagcgaagctaaagagggactcaagagaggcgaaactaccaagcatgccgtctctcgtggtacagccaaacttaggtggtttgtggagcggaatctggtaaagccagagggcaaagtgatcgatttggggtgtggacgcggcgggtggtcctattactgcgcgggactgaagaaagttactgaagtgaagggctataccaaaggtgggcctggacacgaggaacccataccgatggctacatacggctggaacctcgtcaagttacattcaggcaaggacgtgttctttatcccacctgagaaatgtgatacgctgctttgcgacattggggaaagctcgcccaatccaaccatcgaggagggacgaactctgagagtcctaaagatggtggaaccctggctcaggggtaaccagttctgtattaaaatcctgaatccttacatgccgtctgttgtagagacattggaacagatgcaacggaagcacggcgggatgctggtgcgcaaccccctcagtagaaattccacccacgagatgtattgggtcagctgcggaactggcaacattgtgtcagcagttaatatgacatccaggatgcttctgaaccgatttaccatggcccatcggaaaccaacgtacgagcgtgatgtggacttaggtgctgggaccagacacgtcgccgtggaacctgaggtagcaaacctggatatcataggacagcgcattgaaaatatcaagcatgagcacaagtctacatggcattatgacgaagataacccctacaaaacttgggcctatcacggcagctacgaggtgaagcctagtggctccgctagctctatggttaatggggtcgtgaaattgctcaccaagccatgggacgtgatccccatggtcacacagattgcgatgactgataccacacctttcggacagcaaagggtttttaaagagaaggtggacacccggactccaaaggccaaaagaggtacggcacagataatggaagtaacagctaagtggctgtggggcttcctatcacgcaacaaaaagcccaggatctgtacccgagaggaatttactcggaaagtgagaagtaatgccgcaattggggccgtcttcgtggacgagaaccagtggaattccgctaaggaagccgttgaggatgagaggttttgggaccttgtgcaccgcgaacgtgagctgcataagcaaggaaaatgcgcgacctgcgtctataacatgatgggcaagcgggaaaaaaagctcggtgagttcgggaaagcaaagggaagcagagccatctggtacatgtggctgggcgctaggttcttggaatttgaggccctgggcttcatgaatgaggatcactggttttctcgcgaaaactcgctctcaggggtggagggagaaggtcttcataaactgggctacattttacgagacatcagcaagataccggggggaaatatgtatgcagatgacacagctggctgggatacgcggatcaccgaggacgatctgcagaacgaggccaagattactgacatcatggaacctgagcacgctttgctcgccaaatccattttcaagctgacataccagaataaagtagttagagtgcagaggccagcaaagaacggtaccgtcatggatgtgatcagtcgcagagaccaacgggggtctggacaggtgggcacttatggcctaaatacatttaccaacatggaagcgcagcttataaggcagatggagagcgaagggattttctccccctcagagctggagacacctaacctcgccggacgtgtcctggattggttggaaaaacacggtgttgagcgattaaagcgcatggctatcagtggcgacgactgtgtggtaaagccaatcgatgacagatttgccactgcactgaccgctctcaatgatatggggaaagtgcggaaggacattccccaatgggaaccgtctaaaggatggaacgattggcagcaggtccctttctgcagccatcactttcatcagcttataatgaaggacggcagggagatcgtggttccctgtcgcaatcaagatgaactggtgggtagagcccgggtctcccagggggcaggatggtcactaagggagacggcctgcctgggcaaaagctacgcgcagatgtggcagctcatgtatttccaccgacgtgacttgagactggctgccaacgcaatttgttctgccgtgccagtagattgggttcctacctcccgcacaacttggagtatccatgctcaccaccaatggatgaccacagaggacatgcttagcgtgtggaatcgggtctggattgaagagaacccctggatggaagataagactcatatctcgtcctggggcgacgtgccatacctggggaagagggaggaccagtggtgcggatctctcataggtttaaccgccagagcaacgtgggctacaaatatccaggttgccattaaccaagtgcgccggctgatcggcaatgaaaactatttggattacatgacctcaatgaaaaggtttaagaatgagagcgaccccgagggggcgctgtggtga

SEQ ID NO: 13836 - RNA, 9879 nt, synthetic construct
  misc_feature 1..9879: note = derived and/or modified CDS sequence (opt3) from DENV-1__FJ898402__SS-prME
  source 1..9879: mol_type = other RNA
agcgtgacaatgctgctaatgcttatgcccacagcactggctttccacttgactacgcgaggcggggaacctcatatgatcgtctccaagcaggaaagggggaaatctttactgtttaagacctcagccggtgttaacatgtgcacactaattgcaatggacctcggcgagttctgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaagacgcaaactttgtttgccgccgaacattcgtggatagaggctggggtaatgggtgtggactgtttggcaaaggctccttgataacttgcgctaagttcaagtgcgtaaccaaactcgaggggaagattgtgcagtacgaaaacctgaaatattcagtcatcgtgacagttcacaccggagaccagcatcaagtgggtaatgagagtactgaacacggcacgacagccaccattactccccaggcgcctagcaccgagatccagttaacagactacggggccctgaccctcgattgttctccaaggactggacttgactttaacgaaatggtcctgttgacaatgaaggagaaatcctggctagtgcataagcagtggttcctggatctcccgctgccctggacgtcaggcgcaagcaccagtcaagagacttggaatcggaaagaccttctggtaacatttaagaccgctcacgccaagaaacaggaagttgtggtcttgggttctcaggagggggctatgcacacagccctcactggcgcaaccgaaatccaaacgtccggaaccacaactattttcgccggccatctgaagtgccgtttaaaaatggataagctgaccctaaaagggatgagctatgtgatgtgtacaggatcgttcaagctcgagaaggaagtcgctgagactcagcacggtaccgtgctggttcagataaaatacgagggcacggacgcgccttgcaagatcccattttctacacaggatgaaaaaggggtgacccaaaacggacgccttattactgcaaatcccatcgtaacagacaaggagaaacctgtcaacatagaagccgagccacccttcggcgagtcctatattgtgatcggtgctggggaaaaggccttgaagctgtcatggtttaaaaagggcagtagcatcggaaaaatgttcgaggcaaccgccagaggcgctaggcggatggccattctcggggatactgcatgggactttggatccatcggtggcgttttcacctctgtggggaagctggtccatcagatttttggaacagcgtacggcgtgcttttcagcggtgtatcatggacgatgaaaatagggatcggcgtgctgttgacctggctcggactgaatagtcgatccactagcttatctatgacatgtattgctgttggcctggtcaccctatacctcggggtgatggtgcaggccgattcaggatgcgtcatcaactggaagggccgcgaactgaagtgtggtagtgggatctttgttacaaatgaggtgcacacttggaccgaacagtataaattccaagcagacagcccgaagagactttccgccgctattggaaaagcctgggaggagggcgtgtgcggtataaggtctgcaacgcggttggaaaacatcatgtggaagcagatttcgaacgagctgaattacatcctcctggaaaacgacatgaaatttacagtagtcgtgggcgatgttgctgggattttagcccagggaaagaaaatgatccgccctcagcccatggagtataagtacagctggaagtcctggggcaaagcgaagataatcggggccgacgtgcaaaataccactttcattatcgatggaccaaacacccctgaatgtcccgacgatcagagagcttggaatatttgggaggtcgaggactatggctttggtatcttcacaactaacatatggctgaaacttagggattcatacacccaggtgtgcgaccatcgtttgatgagtgcagccattaaggattctaaagctgttcacgccgacatggggtattggatcgaaagcgagaagaatgaaacatggaagctcgcacgggcgtccttcattgaggtgaaaacgtgtatctggccaaagtcacacaccctgtggagcaacggagtactagaatctgagatgataatccccaaaatttacggcggtcctatctcccagcataattaccgaccaggctattttactcaaacagccgggccgtggcacctgggaaagctcgagctggatttcgacctttgcgaaggcaccactgtcgtggtggatgagcattgcgggaacagaggacccagtttgaggacaaccacggtcactggcaaaattatccacgaatggtgttgccgcagctgtaccctgcctccattacggtttaagggtgaggacgggtgctggtacggaatggagataagacccgttaaggaaaaagaggaaaatctcgtgaagtctatggtatccgctggctcaggtgaggtggacagtttcagcctgggccttctgtgtatttcgatcatgatcgaagaggtcatgaggtcccgctggtctcgaaaaatgttgatgacagggaccctcgccgtgtttttcctgctaattatgggacagctgacttggaacgatctcatccggctgtgcattatggttggcgcaaatgctagcgaccgtatggggatgggaacaacctatcttgccttgatggcaacatttaagatgagacctatgttcgccgtgggcctgttatttaggcgcctcacttcacgggaggtcctgcttctgaccataggtctaagtctcgtggcttccgttgaactgccaaactctttggaggaactgggggatggattagcgatgggcatcatgattctcaaactgcttacggacttccagagccaccaactgtgggccacattgctctccctgacctttatcaagactaccttctcactacattacgcatggaagacaatggctatggtgctgagcattgtcagtctttttcccctctgtctgtctactacctcccagaaaacgacatggttgccggtactgttaggcagcctcgggtgcaagcctctgaccatgttccttatcgccgagaataaaatatggggaagaaagtcgtggccactgaacgaaggtatcatggccgtgggcattgtttcaatcttgctctctagtctgctcaagaatgatgtgcccctggctgggcctcttattgcaggaggcatgctcatcgcctgttatgtcatatccggtagctctgcggacctgagcttggagaaggctgccgaggtgtcctgggaagaggaagcagagcactcaggggccagtcataatattttagtagaagtgcaggatgacggaactatgaaaatcaaggatgaggagagggacgatacactgaccatcctcctgaaggctactcttctggcagtcagcggcgtttaccccttgtctattccagccacactattcgtgtggtatttttggcagaaaaagaaacaacgatccggcgtgctgtgggacaccccttcacccccagaagtcgagcgcgcggtgctcgatgacgggatataccggatcatgcagagaggactgcttggtaggagtcaggttggcgtaggggtgttccaggaaaacgtctttcacacgatgtggcatgtgactcgtggagctgttttaatgtaccaaggcaagcgcctggagccgagctgggcctccgtgaaaaaggacctcatttcttatggtgggggatggcggttgcagggctcgtggaataccggcgaggaagtccaggtgatcgcagtagagcctgggaagaaccccaaaaatgtccagacagccccaggaaccttcaagacaagcgaaggtgaggtgggcgctattgccctggattttaaacccgggacttcaggatcccctatcgttaacagagaaggcaagatagtgggtctctacgggaatggagtcgtgaccacgagtggcacatatgtttctgcaatcgctcaagccaaagcgagccaggagggcccactgcccgagattgaagacgaggtgttcaggaagcgaaaccttactatcatggatctgcaccctgggtccggaaagacccggcgctacttgccggccattgtcagagaagcaatcaaaaggaagctacggacactgatactcgctccaacccgagtggtagcctcagagatggctgaagcattaaaaggtatgcccattagatatcagactaccgccgtgaagtctgagcacacaggcaaagagatcgttgacctgatgtgccatgccacgtttactatgcgccttctgagccctgtcagggtgccaaattacaacatgatcattatggatgaagctcacttcaccgaccccagttccatcgcggcacgtgggtatataagcacacgggtgggaatgggcgaggccgctgccatttttatgaccgcaactcctccgggttctgtcgaagccttcccccaatcaaatgctgtaatccaggatgaggaaagagacattccagagaggtcctggaacagtgggtacgagtggatcacagattttcctggaaagaccgtgtggttcgttcccagcataaagtcgggcaatgacattgcgaactgtctccgcaaaaatggcaagcgagtgatccagttgtctagaaaaacgttcgatactgaataccagaagaccaagaacaacgactgggactatgtcgtgaccaccgatatctccgagatgggggccaattttcgggcagacagggttattgatccacgccgttgcctgaagcctgtgatcctcaaggacggacccgaaagagtcattctggctggtccaatgccggtgactgtagccagcgcagcccaacggaggggccgcatagggcgaaaccataataaagagggagatcagtacatctatatgggccagcctcttaacaatgacgaggatcacgctcattggacagaagccaagatgctactggacaacattaatacccccgagggtatcatcccagcgttgttcgaacccgagagagaaaaatcagcagccattgatggggagtaccggttaaggggcgaggctcgcaagacatttgtggaactgatgagaaggggagacctccctgtttggctgagttataaagtcgcctctgagggcttccagtactccgatcggcgttggtgctttgacggggaacgcaacaatcaagtgcttgaggaaaacatggatgtggagatatggactaaggagggagaaaggaaaaagctgagaccaagatggctcgacgctcggacgtatagcgaccccttggcactgcgcgagttcaaggaatttgccgctggtagaaggtcagtcagtggcgatctaatcctggagattgggaaactccctcagcaccttacccagcgggcccagaatgcactggacaacttagttatgttgcacaatagcgaacaaggaggccgagcgtacagacatgccatggaggagctgccggatacaatcgaaactctcatgctgcttgctctgattgccgtgctcaccggtggggtaacattgttctttctgtccggccgcggattaggcaagacctctatcgggctactgtgtgtgatggcaagctccgtcctcctttggactgcttcagtggagccacactggatagccgcatctatcattctggagttctttttgatggttctgctcatccccgagcctgacaggcagcggacgccccaggataaccagctggcctacgtggtcattggacttctcttcatgatcctgaccgtagctgcgaatgagatgggtttgctggaaacaactaaaaaggacttaggcatagggcatgtggccgttgagaaccaccaccatgcagctatgctagatgtggacctgcacccagccagtgcctggaccctctatgcagtcgctacaaccattatcactcctatgatgcgtcatacaattgaaaacacgaccgccaatatctcgcttactgcgatagctaaccaagccgcaatcctgatgggattggataaaggctggcccattagcaagatggacatcggtgtgccactgctcgccctggggtgctactcccaggtcaatcctcttacattaaccgctgcagtgctgatgctcgttgcccactatgcgattatcggcccgggattgcaggctaaggccaccagagaggcacagaaaaggacagccgctggcataatgaagaaccccactgtggatgggattgtagccatcgacctggatccagtggtctacgacgcaaaatttgaaaagcagctaggacagatcatgctgctcattctttgtacgtctcagatcctgttgatgcgcaccacatgggctctgtgcgagtcaataactctcgccaccggccctctgacaaccttatgggagggtagccccgggaaattctggaatactacgattgcggtttccatggccaacatcttccggggaagttatcttgcaggcgctggtctggccttttctctcatgaaaagcctaggcgggggacgaagaggcacaggggcacaaggagaaaccctgggcgagaagtggaaaaggcagttgaatcagctgtcaaagtccgagttcaacacttacaaacgcagtggtattatggaggtggaccggagcgaagctaaggaggggctcaaaagaggagagaccacaaagcatgccgtctctcgtggcactgccaaacttaggtggtttgtggaacggaatctggtaaaaccagagggtaaggtgatcgatttgggctgtgggcgcggaggctggtcctattactgcgcggggctgaaaaaggttaccgaagtgaaaggatacacaaagggcggtcctgggcacgaggaacccataccgatggctacgtatggatggaacctcgtcaaattacactcaggcaaggacgtgttctttatcccacctgagaagtgtgataccctgctttgcgacattggcgagagctcgcccaatccaactatcgaagaggggcgaacactgagagtcctaaaaatggtggaaccctggctcaggggaaaccagttctgtattaagatcctgaatccttacatgccgtctgttgtagagaccttggagcaaatgcagcggaaacatggtggcatgctggtgcgcaaccccctcagtagaaattccactcacgaaatgtattgggtcagctgcgggacaggaaacattgtgtcagcagttaatatgacctccaggatgcttctgaaccgatttacgatggcccatcggaagccaacctacgagcgtgatgtggacttaggcgctggtacaagacacgtcgccgtggaacctgaggtagcaaacctggatatcatagggcagcgcattgaaaatatcaaacacgagcataagtctacttggcactatgacgaggataacccctacaagacctgggcctatcatggaagctacgaagtgaaacctagtggctccgctagctctatggttaatggcgtcgtgaagttgctcacaaaaccatgggacgtgatccccatggtcactcagattgcgatgaccgatacaacccctttcgggcaacagagggtttttaaggagaaagtggacactcggacgccaaaggccaagagaggaacagcacagataatggaagtaaccgctaaatggctgtggggtttcctatcacgcaacaagaaacccaggatctgtactcgagaggaatttacccggaaggtgagaagtaatgccgcaattggcgccgtcttcgtggacgagaaccaatggaactccgctaaagaggccgttgaagatgagaggttttgggaccttgtgcaccgcgaacgtgagctgcataagcaggggaagtgcgcgacatgcgtctacaacatgatgggaaaacgggaaaagaaactcggcgagttcggtaaggcaaaagggagcagagccatctggtatatgtggctgggagctaggttcttggagtttgaagccctgggcttcatgaatgaggatcactggttttctcgcgaaaactcgctctcaggcgtggagggggagggacttcacaagctgggttacattttacgagacatcagcaaaataccgggcgggaatatgtatgcagatgacacggctggatgggatacccggatcactgaagacgatctgcagaacgaggccaagattacagacatcatggaacctgagcatgctttgctcgccaagtccattttcaaactgacctaccagaataaggtagttagagtgcaaaggccagccaaaaacggcactgtcatggatgtgatcagtcgcagagaccagcggggttctggacaggtgggaacatatggcctaaatacctttacaaacatggaagcgcagcttataaggcaaatggagagcgagggcattttctccccctcagaactggagactcctaacctcgccgggcgtgtcctggattggttggaaaagcacggagttgagcgattaaaacgcatggctatcagtggtgacgactgtgtggtaaagccaatcgatgacagatttgccaccgcactgacggctctcaatgatatgggcaaggtgcggaaagacattccccagtgggaaccgtctaaggggtggaacgattggcagcaggtccctttctgcagccatcactttcaccaacttataatgaaagacggaagggagatcgtggttccctgtcgcaatcaggatgagctggtgggcagagcccgggtctcccagggtgcagggtggtcactaagggaaaccgcctgcctgggaaagagctacgcgcagatgtggcaactcatgtatttccatcgacgtgacttgagactggctgccaacgcaatttgttctgccgtgccagtagattgggttcctacatcccgcactacctggagtatccacgctcatcaccagtggatgacaactgaggacatgcttagcgtgtggaatcgggtctggattgaagagaacccctggatggaagataaaacccatatctcgtcctggggcgacgtgccatacctgggcaagagggaggaccagtggtgcgggtctctcataggattaacggccagagcaacatgggctaccaatatccaagttgccattaaccaggtgcgccggctgatcggtaatgagaactacttggattatatgacttcaatgaagaggtttaaaaatgaaagcgaccccgagggcgcgctgtggtga

SEQ ID NO: 13837 - RNA, 9879 nt, synthetic construct
  misc_feature 1..9879: note = derived and/or modified CDS sequence (opt3) from DENV-1__FJ898403__SS-prME
  source 1..9879: mol_type = other RNA
agcgtgacaatgctgctaatgcttatgcccacagcactggctttccacttgactacgcgaggcggggaacctcatatgatcgtctccaagcaggaaagggggaaatctttactgtttaagacatcagccggtgttaacatgtgcacactaattgcaatggacctcggcgagttctgtgaagatactatgacctacaaatgcccacggataacagaggcggaaccggacgatgtggactgttggtgcaatgctaccgatacttgggtaacatatgggacctgtagtcagacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaagacgcaaactttgtttgccgccgaacattcgtggatagaggctggggtaatgggtgtggactgtttggcaaaggctccttgataacttgcgctaagttcaagtgcgtaaccaaactcgaggggaagattgtgcagtacgaaaacctgaaatattcagtcatcgtgacagttcacaccggagaccagcatcaagtgggtaatgagagtactgaacacggcacgacagccaccattactccccaggcgcctagcaccgagatccagttaacagactacggggccctgaccctcgattgttctccaaggactggacttgactttaacgaaatggtcctgttgacaatgaaggagaaatcctggctagtgcataagcagtggttcctggatctcccgctgccctggacgtcaggcgcaagcaccagtcaagagacttggaatcggaaagaccttctggtaacatttaagaccgctcacgccaagaaacaggaagttgtggtcttgggttctcaggagggggctatgcacacagccctcactggcgcaaccgaaatccaaacgtccggaaccacaactattttcgccggccatctgaagtgccgtttaaaaatggataagctgaccctaaaagggatgagctatgtgatgtgtacaggatcgttcaagctcgagaaggaagtcgctgagactcagcacggtaccgtgctggttcagataaaatacgagggcacggacgcgccttgcaagatcccattttctacacaggatgaaaaaggggtgacccaaaacggacgccttattactgcaaatcccatcgtaacagacaaggagaaacctgtcaacatagaagccgagccacccttcggcgagtcctatattgtgatcggtgctggggaaaaggccttgaagctgtcatggtttaaaaagggcagtagcatcggaaaaatgttcgaggcaaccgccagaggcgctaggcggatggccattctcggggatactgcatgggactttggatccatcggtggcgttttcacctctgtggggaagctggtccatcagatttttggaacagcgtacggcgtgcttttcagcggtgtatcatggacgatgaaaatagggatcggcgtgctgttgacctggctcggactgaatagtcgatccactagcttatctatgacatgtattgctgttggcctggtcaccctatacctcggggtgatggtgcaggccgattcaggatgcgtcatcaactggaagggccgcgaactgaagtgtggtagtgggatctttgttacaaatgaggtgcacacttggaccgaacagtataaattccaagcagacagcccgaagagactttccgccgctattggaaaagcctgggaggagggcgtgtgcggtataaggtctgcaacgcggttggaaaacatcatgtggaagcagatttcgaacgagctgaatcatatcctcctggaaaacgacatgaaatttacagtagtcgtgggcgatgttgctgggattttagcccagggaaagaaaatgatccgccctcagcccatggagtacaagtatagctggaagtcctggggcaaagcgaagataatcggggccgacgtgcaaaataccactttcattatcgatggaccaaacacccctgaatgtcccgacgatcagagagcttggaatatttgggaggtcgaggactacggctttggtatcttcacaactaacatatggctgaaacttagggattcatatacccaggtgtgcgaccaccgtttgatgagtgcagccattaaggattctaaagctgttcacgccgacatggggtactggatcgaaagcgagaagaatgaaacatggaagctcgcacgggcgtccttcattgaggtgaaaacgtgtatctggccaaagtcacataccctgtggagcaacggagtactagaatctgagatgataatccccaaaatttatggcggtcctatctcccagcacaattaccgaccaggctactttactcaaacagccgggccgtggcatctgggaaagctcgagctggatttcgacctttgcgaaggcaccactgtcgtggtggatgagcactgcgggaacagaggacccagtttgaggacaaccacggtcactggcaaaattatccacgaatggtgttgccgcagctgtaccctgcctccattacggtttaagggtgaggacgggtgctggtatggaatggagataagacccgttaaggaaaaagaggaaaatctcgtgaagtctatggtatccgctggctcaggtgaggtggacagtttcagcctgggccttctgtgtatttcgatcatgatcgaagaggtcatgaggtcccgctggtctcgaaaaatgttgatgacagggaccctcgccgtgtttttcctgctaattatgggacagctgacttggaacgatctcatccggctgtgcattatggttggcgcaaatgctagcgaccgtatggggatgggaacaacctaccttgccttgatggcaacatttaagatgagacctatgttcgccgtgggcctgttatttaggcgcctcacttcacgggaggtcctgcttctgaccataggtctaagtctcgtggcttccgttgaactgccaaactctttggaggaactgggggatggattagcgatgggcatcatgattctcaaactgcttacggacttccagagccatcaactgtgggccacattgctctccctgacctttatcaagactaccttctcactacactatgcatggaagacaatggctatggtgctgagcattgtcagtctttttcccctctgtctgtctactacctcccagaaaacgacatggttgccggtactgttaggcagcctcgggtgcaagcctctgaccatgttccttatcgccgagaataaaatatggggaagaaagtcgtggccactgaacgaaggtatcatggccgtgggcattgtttcaatcttgctctctagtctgctcaagaatgatgtgcccctggctgggcctcttattgcaggaggcatgctcatcgcctgttacgtcatatccggtagctctgcggacctgagcttggagaaggctgccgaggtgtcctgggaagaggaagcagagcattcaggggccagtcacaatattttagtagaagtgcaggatgacggaactatgaaaatcaaggatgaggagagggacgatacactgaccatcctcctgaaggctactcttctggcagtcagcggcgtttatcccttgtctattccagccacactattcgtgtggtacttttggcagaaaaagaaacaacgatccggcgtgctgtgggacaccccttcacccccagaagtcgagcgcgcggtgctcgatgacgggatatatcggatcatgcagagaggactgcttggtaggagtcaggttggcgtaggggtgttccaggaaaacgtctttcatacgatgtggcacgtgactcgtggagctgttttaatgtaccaaggcaagcgcctggagccgagctgggcctccgtgaaaaaggacctcatttcttacggtgggggatggcggttgcagggctcgtggaataccggcgaggaagtccaggtgatcgcagtagagcctgggaagaaccccaaaaatgtccagacagccccaggaaccttcaagacaagcgaaggtgaggtgggcgctattgccctggattttaaacccgggacttcaggatcccctatcgttaacagagaaggcaagatagtgggtctctatgggaatggagtcgtgaccacgagtggcacatacgtttctgcaatcgctcaagccaaagcgagccaggagggcccactgcccgagattgaagacgaggtgttcaggaagcgaaaccttactatcatggatctgcaccctgggtccggaaagacccggcgctatttgccggccattgtcagagaagcaatcaaaaggaagctacggacactgatactcgctccaacccgagtggtagcctcagagatggctgaagcattaaaaggtatgcccattagataccagactaccgccgtgaagtctgagcatacaggcaaagagatcgttgacctgatgtgccacgccacgtttactatgcgccttctgagccctgtcagggtgccaaattataacatgatcattatggatgaagctcatttcaccgaccccagttccatcgcggcacgtgggtacataagcacacgggtgggaatgggcgaggccgctgccatttttatgaccgcaactcctccgggttctgtcgaagccttcccccaatcaaatgctgtaatccaggatgaggaaagagacattccagagaggtcctggaacagtgggtatgagtggatcacagattttcctggaaagaccgtgtggttcgttcccagcataaagtcgggcaatgacattgcgaactgtctccgcaaaaatggcaagcgagtgatccagttgtctagaaaaacgttcgatactgaataccagaagaccaagaacaacgactgggactacgtcgtgaccaccgatatctccgagatgggggccaattttcgggcagacagggttattgatccacgccgttgcctgaagcctgtgatcctcaaggacggacccgaaagagtcattctggctggtccaatgccggtgactgtagccagcgcagcccaacggaggggccgcatagggcgaaaccacaataaagagggagatcagtatatctacatgggccagcctcttaacaatgacgaggatcatgctcactggacagaagccaagatgctactggacaacattaatacccccgagggtatcatcccagcgttgttcgaacccgagagagaaaaatcagcagccattgatggggagtatcggttaaggggcgaggctcgcaagacatttgtggaactgatgagaaggggagacctccctgtttggctgagttacaaagtcgcctctgagggcttccagtattccgatcggcgttggtgctttgacggggaacgcaacaatcaagtgcttgaggaaaacatggatgtggagatatggactaaggagggagaaaggaaaaagctgagaccaagatggctcgacgctcggacgtacagcgaccccttggcactgcgcgagttcaaggaatttgccgctggtagaaggtcagtcagtggcgatctaatcctggagattgggaaactccctcagcaccttacccagcgggcccagaatgcactggacaacttagttatgttgcataatagcgaacaaggaggccgagcgtatagacacgccatggaggagctgccggatacaatcgaaactctcatgctgcttgctctgattgccgtgctcaccggtggggtaacattgttctttctgtccggccgcggattaggcaagacctctatcgggctactgtgtgtgatggcaagctccgtcctcctttggatggcttcagtggagccacattggatagccgcatctatcattctggagttctttttgatggttctgctcatccccgagcctgacaggcagcggactccccaggataaccagctggcctacgtggtcattggacttctcttcatgatcctgacggtagctgcgaatgagatgggtttgctggaaaccaccaaaaaggacttaggcatagggcacgtggccgttgagaaccaccatcacgcagctatgctagatgtggacctgcatccagccagtgcctggactctctacgcagtcgctaccacaattatcacccctatgatgcgtcacactattgaaaacacaacggccaatatctcgcttaccgcgatagctaaccaagccgcaatcctgatgggattggataaaggctggcccattagcaagatggacatcggtgtgccactgctcgccctggggtgctattcccaggtcaatcctcttactttaacagctgcagtgctgatgctcgttgcccattacgcgattatcggcccgggattgcaggctaaggccaccagagaggcacagaaaaggaccgccgctggcataatgaagaaccccacagtggatgggattgtagccatcgacctggatccagtggtctatgacgcaaaatttgaaaagcagctaggacagatcatgctgctcattctttgtacttctcagatcctgttgatgcgcacgacctgggctctgtgcgagtcaataacactcgccactggccctctgaccacattatgggagggtagccccgggaaattctggaataccactattgcggtttccatggccaacatcttccggggaagttaccttgcaggcgctggtctggccttttctctcatgaaaagcctaggcgggggacgaagaggcacgggggcacaaggagaaacactgggcgagaagtggaaaaggcagttgaatcagctgtcaaagtccgagttcaacacctataaacgcagtggtattatggaggtggaccggagcgaagctaaggaggggctcaaaagaggagagactaccaagcacgccgtctctcgtggcacagccaaacttaggtggtttgtggaacggaatctggtaaaaccagagggtaaggtgatcgatttgggctgtgggcgcggaggctggtcctactattgcgcggggctgaaaaaggttactgaagtgaaaggatacaccaagggcggtcctgggcacgaggaacccataccgatggctacatacggatggaacctcgtcaaattacattcaggcaaggacgtgttctttatcccacctgagaagtgtgatacgctgctttgcgacattggcgagagctcgcccaatccaaccatcgaagaggggcgaactctgagagtcctaaaaatggtggaaccctggctcaggggaaaccagttctgtattaagatcctgaatccttatatgccgtctgttgtagagacattggagcaaatgcagcggaaacacggtggcatgctggtgcgcaaccccctcagtagaaattccacccatgaaatgtactgggtcagctgcgggactggaaacattgtgtcagcagttaatatgacatccaggatgcttctgaaccgatttaccatggcccaccggaagccaacgtatgagcgtgatgtggacttaggcgctggtaccagacacgtcgccgtggaacctgaggtagcaaacctggatatcatagggcagcgcattgaaaatatcaaacatgagcacaagtctacatggcattacgacgaggataacccctataagacttgggcctaccacggaagctatgaagtgaaacctagtggctccgctagctctatggttaatggcgtcgtgaagttgctcaccaaaccatgggacgtgatccccatggtcacacagattgcgatgactgataccacacctttcgggcaacagagggtttttaaggagaaagtggacacccggactccaaaggccaagagaggaacggcacagataatggaagtaacagctaaatggctgtggggtttcctatcacgcaacaagaaacccaggatctgtacccgagaggaatttactcggaaggtgagaagtaatgccgcaattggcgccgtcttcgtggacgagaaccaatggaactccgctaaagaggccgttgaagatgagaggttttgggaccttgtgcatcgcgaacgtgagctgcacaagcaggggaagtgcgcgacctgcgtctacaacatgatgggaaaacgggaaaagaaactcggcgagttcggtaaggcaaaagggagcagagccatctggtacatgtggctgggagctaggttcttggagtttgaagccctgggcttcatgaatgaggatcactggttttctcgcgaaaactcgctctcaggcgtggagggggagggacttcataagctgggttatattttacgagacatcagcaaaataccgggcgggaatatgtacgcagatgacacagctggatgggatacgcggatcaccgaagacgatctgcagaacgaggccaagattactgacatcatggaacctgagcacgctttgctcgccaagtccattttcaaactgacatatcagaataaggtagttagagtgcaaaggccagccaaaaacggcaccgtcatggatgtgatcagtcgcagagaccagcggggttctggacaggtgggaacttacggcctaaatacatttaccaacatggaagcgcagcttataaggcaaatggagagcgagggcattttctccccctcagaactggagacacctaacctcgccgggcgtgtcctggattggttggaaaagcatggagttgagcgattaaaacgcatggctatcagtggtgacgactgtgtggtaaagccaatcgatgacagatttgccactgcactgaccgctctcaatgatatgggcaaggtgcggaaagacgtcccccagtgggaaccgtctaaggggtggaacgattggcaacaggtgcctttctgcagccaccactttcatcaacttattatgaaagacggaagggagatagttgtgccctgtcgcaatcaggatgagctggtcggcagagcccgggtgtcccagggtgcagggtggtcactaagggaaacggcctgcctgggaaagagctatgcgcagatgtggcaactcatgtacttccaccgacgtgacttgagactggctgccaacgcaatctgttctgccgtaccagttgattgggtgcctacctcccgcacaacttggagtattcatgctcaccatcagtggatgaccacagaggacatgcttagcgtctggaatcgggtgtggatcgaagagaacccctggatggaagataaaactcacatttcgtcctggggcgacgttccatatctgggcaagagggaggaccagtggtgcgggtctctcatcggattaaccgccagagcaacgtgggctacaaatatacaagtggccatcaaccaggtccgccggctgattggtaatgagaactacttggattacatgacctcaatgaagaggtttaaaaatgaaagcgaccccgagggcgcgctgtggtga

SEQ ID NO: 13838 - RNA, 9879 nt, synthetic construct
  misc_feature 1..9879: note = derived and/or modified CDS sequence (opt3) from DENV-1__FJ898404__SS-prME
  source 1..9879: mol_type = other RNA
agcgtgaccatgctgctcatgcttatgcccaccgcactggctttccacttgactacgagaggaggggagcctcatatgatcgtcaccaagcaggaaaggggaaaatccttactgtttaagacatctgccggtgttaatatgtgcactctaattgccatggacctcggcgagctgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggtagcttcaaactggagaaggaagtggctgagacccagcacggaacggtccttgtgcagataaagtacgagggcacagacgcgccttgcaaaatcccattctcgacccaagatgaaaagggggttactcagaacggacgcttgattacagcaaatcccatcgtgaccgacaaagagaagcctgtaaacatagaagccgagccaccctttggcgagtcttatattgtcatcggtgctggggaaaaagccctgaagctctcctggttcaagaaaggctcaagtatcggaaagatgtttgaggcaactgccagaggcgctaggcggatggccattctgggggataccgcatgggacttcggaagcgtgggtggcgtttttacatccgtggggaaacttgtccatcagatcttcggaacggcgtacggcgtgctgttttctggtgtaagctggaccatgaagattgggataggcgtgttgctcacttggctgggattaaattcacgaagtacatccctgagcatgacctgtatcgctgttggcctagtcacactctacctgggggtgatggtgcaggccgattctggatgcgtcattaactggaaaggccgcgaacttaagtgtggttcagggatcttcgttactaatgaggtgcacacctggacggaacaatataagtttcaggcagacagtccgaaaagattgagcgccgctatcggaaaggcctgggaggagggcgtgtgcggtattaggtccgcaacacggctggaaaacataatgtggaaacagatctctaacgagctcaatcatattctgttagaaaacgacatgaagttcaccgtagtcgtgggcgatgttgtggggatcctggctcagggcaaaaagatgattcgccctcaacccatggagcacaaatactcgtggaaaagctggggcaaggccaagatcataggggcggacgtccagaatactacctttatcattgatggaccaaacacacctgaatgtcccgacgatcagagagcctggaatatctgggaggtggaggactatggcttcggtatttttactaccaacatctggcttaagttgagggattcctacacacaggtttgcgaccaccgtctcatgtcagctgcaataaaagatagtaaggccgtgcatgctgacatggggtattggattgaatctgagaaaaatgaaacgtggaagctggcccgggcatccttcatcgaggtaaagacctgtatttggccaaaatcccacactctatggtcaaacggagtcctggaaagcgagatgatcatacccaagatctacggcggtcctatttctcaacataattatcgaccaggctacttcacacagaccgcggggccgtggcacctcggaaaactggagcttgattttgacttgtgcgaaggcactacagtggtggtcgatgagcactgcgggaacagaggaccctccctgaggaccacgactgttaccggcaagatcattcatgaatggtgttgccgcagttgtacattacctccactccggttcaaaggtgaggacgggtgctggtacggaatggagatcagacccgtgaaggaaaaggaggaaaatctggtaaaaagcatggtgtctgccggctccggtgaggtcgactcatttagtcttggcctgttgtgtataagcattatgatcgaagaggtgatgaggtcgcgctggtcccgaaagatgctcatgaccgggactctggctgttttcctactgctcatcatgggacagctgacatggaacgatcttattcggttgtgcatcatggtgggcgccaatgcatctgaccgtatggggatgggaaccacatatctggctttaatggccacttttaaaatgagacctatgttcgcagtcggcctcctgtttaggcgccttaccagccgggaggtgctgctactcacgattggtctgtcattggttgccagtgtggaactgccaaactccttagaggaactcggggatggactggctatgggcataatgatccttaagctgttgacagacttccaatctcaccagctctgggcgaccctgctaagcctgacttttattaaaaccacactttccctccattacgcctggaagactatggcaatggtcctgtcaatcgctagcttgttccccctgtgtttaagtaccacgtctcagaagacaacctggctcccggtactgcttggctccctggggtgcaaacctttgactatgtttctcattacagagaccaagatctggggaagaaaaagctggccactgaatgaaggtataatggccgtgggcgttgtgtcgatcctactgtcatctcttctcaagaacgatgtccccctggccgggcctttgattgctggaggcatgttaatcgcatgttatgtgattagtggttccagcgccgacctgtctctcgagaaagcggctgaggtaagctgggaagaggaagccgagcactccggggcatcacataacatcctggtggtcgttcaggatgacggaactatgaagataaaagatgaagagagggacgatacacttaccattctgttgaaggccacgctactggctgtgagtggcgtgtaccccctcagcatcccagcaactctgttcgtctggtatttttggcaaaagaaaaagcagcgatctggcgtgctttgggacaccccttcacccccagaggttgaacgcgccgtattagatgacgggatctaccggattatgcagagaggactgctcggtaggagccaggtgggcgtcggggtgttccaagagaatgttttccacacaatgtggcacgtgacccgtggagcggtcttgatgtatcagggcaaacgcctggaaccgagttgggctagcgtgaagaaagacctcatatcctacggtgggggatggcggctgcagggctcttggaacacaggcgaggaggtacaggtcatcgccgtggaacctgggaagaatcccaagaacgttcaaactgcaccaggaacctttaaaacgcccgagggtgaagtgggcgccattgctcttgatttcaagcctgggacatcgggaagcccaatcgtcaatagagagggcaaaattgtgggtctgtacgggaacggagttgtgactacctcaggcacatatgtctccgccatcgcacaggctaaggccagtcaggaaggccccttgcctgagatagaggacgaagtgtttaggaaacgaaatctaaccatcatggatctgcatccggggtctggaaagactcggcgctacctcccagcgattgtaagagaggccatcaagaggaaattacggaccctgattcttgcacccacacgagtggttgctagcgaaatggccgaggctctgaagggtatgcctatcagatatcaaacgactgcagtcaaatccgaacacaccggcaaggagatagtggacctcatgtgccatgccacattcaccatgcgcttgctgtcaccagtgagggtccccaactacaatatgattatcatggatgaggcccactttactgacccttctagcatcgctgcgcgtgggtatattagtacacgggtaggaatgggcgaagcagccgctatcttcatgaccgccacgccgcccggttccgtggaggcatttccacagagcaacgccgttatacaggatgaagagagagacattcctgaaaggtcttggaactcagggtacgagtggatcactgatttccccggaaaaacagtgtggtttgtcccatccattaagagtggcaacgacatcgctaattgtctccgcaagaacggcaaacgagtgatacagctgagcagaaagaccttcgataccgagtatcagaaaactaagaataacgactgggactacgttgtgacaaccgatatttcggaaatgggggcgaactttcgggccgacagggtcatcgatcctcgccgttgccttaaacccgtgatcctaaaggacggaccagagagagtaattctggcaggtccgatgcctgtgacagttgcttctgccgcacagcggaggggccgcatcgggcgaaatcataacaaggaaggagatcagtacatttatatgggccagcccttgaataacgacgaggatcacgcccactggactgaggctaaaatgttactggacaatataaacacgccagaaggtatcattcccgccctcttcgagcctgaaagagagaagtccgcggcaatcgatggggaataccggctgaggggcgaggcccgcaaaaccttcgtcgagcttatgagaaggggagacctgccagtgtggctcagctataaggtggcttcagaaggctttcaatacagtgatcggcgttggtgcttcgacggggagcgcaataaccaggtcttggaagagaatatggatgttgaaatctggacaaaagagggagagcgaaagaaactgagacccaggtggctagacgcccggacttattctgaccctctggctctccgcgaatttaaggagttcgcagccggtagaaggtccgtgagcggcgatcttattctggaaatagggaagttaccgcagcatttgacccagcgggctcaaaacgccctggacaatctcgtaatgctgcacaactcagagcagggaggccgagcatacagacatgcgatggaggaacttccagatacaatcgagaccctgatgctcttggccctgattgctgtgttaactggtggggtcacgctatttttcctgagtggccgcggactcggcaaaaccagcatcgggcttctgtgtgtgatggcctcctctgttttgctgtggatggcaagcgtggaaccccactggattgctgcctccatcatactcgagtttttcctgatggtccttctcatccctgaacccgacaggcagcggacaccacaggataatcaactggcatatgtagtgattggattgctgtttatgatcttaactgttgccgctaacgagatgggtctactggagaccacaaagaaagacctcggcattgggcacgtggcggtcgaaaatcatcaccatgccaccatgcttgatgtggacctgcaccctgcatcagcttggactttgtacgccgtcgccacaacgatcataacccccatgatgcgtcatactattgagaacacaaccgcaaacatctctctgaccgctattgccaatcaggcggctatcctcatgggactggataagggctggccaataagtaaaatggacatcggtgtgcctcttttagccctggggtgctactcgcaggttaacccgctcacattgactgcagccgtgctgatgctagtagctcactatgcaattatcggccccggactgcaagccaaggcgacgagagaagctcagaagaggaccgccgcaggcattatgaaaaatccaacagtggatgggatcgtcgccatagacctcgatcctgttgtgtacgacgctaagttcgagaaacagcttggacagattatgctgttgatcctgtgtactagccaaatcctcctgatgcgcaccacatgggccttatgcgaatccattacccttgcaactggccccctgacgacactctgggagggttctccagggaagttttggaacaccactatcgctgtctcaatggccaatatattccggggaagctatctagcgggcgccggtctggcattttccttgatgaaaagtctgggcgggggacgaagaggcaccggggctcagggagagacactcggcgaaaagtggaagaggcagcttaaccagctgtctaaaagcgagttcaatatttacaagcgctcaggtatcatggaagtggaccggtccgaggccaaagaagggttgaagagaggagagactacccgtcacgcagtaagtaggggcacagctaaactgcggtggttcgtggagcgcaacctcgttaagcctgaaggtaaggtgattgatttaggctgtgggcgaggaggctggagctattactgcgccgggctgaaaaaggtcacggaggtgaaaggatataccaagggcggtcccgggcatgaggagccgatcccaatggccacttacggatggaatcttgtcaaactgcactctggcaaggacgtgtttttcacacctcccgaaaaatgtgataccctactctgcgacataggcgagtcctcaccaaaccccactatcgaggaagggagaacactgagggttttgaagatggtagagccttggctgcggggaaatcaattttgtattaagatcctcaacccgtacatgcccagcgtggtcgaaacccttgagcagatgcagcgcaaacatggtggcatgctggtgagaaatccattatcgaggaactctacgcacgagatgtattgggttagttgcgggaccggaaatattgtgtccgcggtcaacatgacaagccgaatgctgttgaatcggttcactatggctcaccgtaagcctacctacgaaagagatgtggacctcggcgcaggtacacgccatgtagccgtggagcccgaagttgctaacctggatatcattgggcagaggatcgagaacataaaacacgaacataagtcaacttggcactatgacgaggataatccttacaaaacctgggcctatcatggatcctacgaggtcaagccatctggcagcgcaagttccatggtgaacggcgtggtcaagctacttacaaaaccctgggacgttattcctatggtgacccaaatcgccatgactgatacgacaccatttgggcagcagcgggtattcaaggaaaaagtggacaccagaactcccaaggctaaacgcggaaccgcgcaaatcatggaggtcacagccaggtggctgtggggttttctcagccgaaataagaagccgcggatttgtacgagagaagagttcaccaggaaagtgcgctctaacgcagctataggcgccgtttttgtggacgaaaatcagtggaactcagcaaaggaggccgtcgaggatgaacgtttctgggacctggtgcagaaagagcgggaattgcacaagcaggggaaatgcgctacttgcgtatataatatgatgggaaagagagagaagaaactgggcgaatttggtaaggccaaagggagtagggcgatctggtacatgtggctcggagcacgcttccttgagtttgaggccctgggcttcatgaacgaagatcactggttctcccgagagaatagcttatctggcgttgaaggggagggactgcataagttgggttacattctccgggacatctcgaaaattcctggcgggaacatgtatgctgatgacacagccggatgggataccagaatcactgaggacgatctgcaaaatgaagcaaagataacagacatcatggagccagaacacgctctacttgccacctcaatttttaaactgacataccagaacaaggtggtcagggtgcagcgccccgctaagaatggcactgtgatggatgtcatcagcagacgggaccagaggggttccgggcaagttggaacctatggcctcaacacgttcaccaatatggaggcccagctgattcgtcagatggaaagtgagggcatctttttgccttctgagttagaaacaccaaacctggcagagcgagtgctcgattggcttgaaaaatacggggtagagcgcctgaagagaatggcgataagcggagacgactgtgtggtcaaacccattgatgaccggttcgccactgctctaaccgccctgaacgatatgggtaaggtgaggaaagacatcccgcagtgggaaccttccaagggctggaatgattggcaacaggttcccttttgctcacatcacttccaccagctcatcatgaaggacgggcgcgagattgtggtcccatgtagaaaccaggatgagttggtgggacgggcaagggtaagtcaaggcgctggttggtctctgcgagaaacagcctgccttgggaaaagctatgcacagatgtggcagctgatgtactttcatcgtagagacctccgcttagccgcgaatgctatatgttccgccgttcctgtggattgggtccccacttcacggaccacgtggagcatccacgcacatcaccaatggatgacaaccgaggacatgctgtctgtgtggaacagggtttggattgaagagaatccatggatggaagataagactcatgtgtccagttggggagacgtcccctatttgggcaaaagagaggaccagtggtgcggcagcctgatcgggctcacagcccgcgctacctgggcctcgaacattcaggtggcaatcaatcaggtacggaggcttataggaaacgagaattacctggattacatgacttccatgaagcgattcaaaaacgaaggtgaccctgagggcgctctatggtga

SEQ ID NO: 13839 - RNA, 9879 nt, synthetic construct
  misc_feature 1..9879: note = derived and/or modified CDS sequence (opt3) from DENV-1__GQ199840__SS-prME
  source 1..9879: mol_type = other RNA
agcgtgaccatgctgctcatgcttatgcccacagcactggctttccacttgactacgagaggaggggaacctcatatgatcgtctccaagcaggaaagggggaaatctttactgtttaagacctcagccggtgttaatatgtgcacactaattgccatggacctcggcgagttctgtgaagatactatgacctacaaatgcccacggataacagaagcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaagacgcaaactttgtttgccgccgaacattcgtggatagaggctggggtaatgggtgtggactgtttggcaaaggctccttgataacttgcgctaagttcaagtgcgtaaccaaactcgaggggaagattgtgcagtacgaaaacctgaaatattcagtcatcgtgacagttcacaccggagaccagcatcaagtgggtaatgagagtactgaacacggcacgacagccaccattactccccaggcgcctagcaccgagatccagttaacagactacggggccctgaccctcgattgttctccaaggactggacttgactttaacgaaatggtcctgttgacaatgaaggagaaatcctggctagtgcataagcagtggttcctggatctcccgctgccctggacgtcaggcgcaagcaccagtcaagagacttggaatcggcaggaccttctggtaacatttaaaaccgctcacgccaagaagcaggaagttgtggtcttgggttctcaagagggggctatgcacacagccctcactggcgcaaccgaaatccagacgtccggaaccacaactattttcgccggccatctgaaatgccgtttaaagatggataaactgaccctaaaggggatgagctatgtgatgtgtacaggatcgttcaaactcgagaaggaagtcgctgagactcagcacggtaccgtgctggttcagataaagtacgagggcacggacgcgccttgcaaaatcccattttctacacaagatgaaaagggggtgacccagaacggacgccttattactgcaaatcccatcgtaacagacaaagagaagcctgtcaacatagaagccgagccacccttcggcgagtcctatattgtgatcggtgctggggaaaaagccttgaagctgtcatggtttaagaaaggcagtagcatcggaaagatgttcgaggcaaccgccagaggcgctaggcggatggccattctcggggatactgcatgggactttggatccatcggtggcgttttcacctctgtggggaaactggtccatcagatttttggaacagcgtacggcgtgcttttcagcggtgtatcatggacgatgaagatagggatcggcgtgctgttgacctggctcggactgaatagtcgatccactagcttatctatgacatgtattgctgttggcctggtcaccctatacctcggggtgatggtgcaggccgattcaggatgcgtcatcaactggaaaggccgcgaactgaagtgtggtagtgggatctttgttacaaatgaggtgcacacttggaccgaacaatataagttccaggcagacagcccgaaaagactttccgccgctattggaaaggcctgggaggagggcgtgtgcggtataaggtctgcaacgcggttggaaaacatcatgtggaaacagatttcgaacgagctgaatcatatcctcctggaaaacgacatgaagtttacagtagtcgtgggcgatgttgctgggattttagcccagggcaagaagatgatccgccctcaacccatggagtacaaatatagctggaagtcctggggcaaggcgaaaataatcggggccgacgtgcagaataccactttcattatcgatggaccaaacacccctgaatgtcccgacgatcagagagcttggaatatttgggaggtcgaggactacggctttggtatcttcacaactaacatatggctgaaacttagggattcatatacccaggtgtgcgaccaccgtttgatgagtgcagccattaaagattctaaggctgttcacgccgacatggggtactggatcgaaagcgagaaaaatgaaacatggaagctcgcacgggcgtccttcattgaggtgaagacgtgtatctggccaaaatcacataccctgtggagcaacggagtactagaatctgagatgataatccccaagatttatggcggtcctatctcccaacacaattaccgaccaggctactttactcagacagccgggccgtggcatctgggaaaactcgagctggatttcgacctttgcgaaggcaccactgtcgtggtggatgagcactgcgggaacagaggacccagtttgaggacaaccacggtcactggcaagattatccacgaatggtgttgccgcagctgtaccctgcctccattacggtttaaaggtgaggacgggtgctggtatggaatggagataagacccgttaaggaaaaggaggaaaatctcgtgaaatctatggtatccgctggctcaggtgaggtggacagtttcagcctgggccttctgtgtatttcgatcatgatcgaagaggtcatgaggtcccgctggtctcgaaagatgttgatgacagggaccctcgccgtgtttttcctgctaattactggacagctgacatggaacgatctcatccggctgtgcattatggttggcgcaaatgctagcgaccgtatggggatgggaaccacataccttgccttgatggcaacttttaaaatgagacctatgttcgccgtgggcctgttatttaggcgcctcacctcacgggaggtcctgcttctgacgataggtctaagtctcgtggcttccgttgaactgccaaactctttggaggaactgggggatggattagcgatgggcatcatgattctcaagctgcttacagacttccaaagccatcagctgtgggccaccttgctctccctgacttttatcaaaaccacattctcactacactatgcatggaagactatggctatggtgctgagcattgtcagtctttttcccctctgtctgtctaccacgtcccagaagacaacctggttgccggtactgttaggcagcctcgggtgcaaacctctgactatgttccttatcgccgagaataagatatggggaagaaaatcgtggccactgaacgaaggtatcatggccgtgggcattgtttcaatcttgctctctagtctgctaaagaacgatgtgcccctggctgggcctcttattgcaggaggcatgctcatcgcctgttacgtcatatccggtagctctgcggacctgagcttggagaaagctgccgaggtgtcctgggaagaggaagcagagcattcaggggccagtcacaatattttagtagaagtgcaggatgacggaacaatgaagatcaaagatgaggagagggacgataccctgactatcctcctgaaggctacacttctggcagtcagcggcgtttatcccttgtctattccagccaccctattcgtgtggtacttttggcaaaagaaaaagcagcgatccggcgtgctgtgggacataccttcacccccagaagtcgagcgcgcggtgctcgatgacgggatctatcggattatgcagagaggactgcttggtaggagtcaggttggcgtaggggtgttccaagaaaacgtctttcatacgatgtggcacgtgactcgtggagctgttttaatgtaccagggcaaacgcctggagccgagctgggcctccgtgaagaaagacctcatctcttacggtgggggatggcggttgcagggctcgtggaataccggcgaggaagtccaggtgattgcagtagagcctgggaagaaccccaagaatgtccaaacagccccaggaaccttcaaaacaagcgaaggtgaggtgggcgctatcgccctggattttaagcccgggacttcaggatcccctatagttaacagagaaggcaaaatcgtgggtctctatgggaatggagtcgtgaccacgagtggcacatacgtttctgcaattgctcaggccaaggcgagccaggagggcccactgcccgagatcgaagacgaggtgttcaggaaacgaaaccttactattatggatctgcaccctgggtccggaaagacccggcgctatttgccggccatcgtcagagaagcaataaagaggaaactacggacactgattctcgctccaacccgagtggtagcctcagagatggctgaagcattaaagggtatgcccatcagataccaaactaccgccgtgaaatctgagcatacaggcaaggagatcgttgacctgatgtgccacgccacgtttactatgcgccttctgagccctgtcagggtgccaaattataacatgattatcatggatgaagctcatttcaccgaccccagttccatagcggcacgtgggtacattagcacacgggtgggaatgggcgaggccgctgccatctttatgaccgcaactcctccgggttctgtcgaagccttcccccagtcaaatgctgtaattcaggatgaggaaagagacatcccagagaggtcctggaacagtgggtatgagtggataacagattttcctggaaaaaccgtgtggttcgttcccagcattaagtcgggcaatgacatcgcgaactgtctccgcaagaatggcaaacgagtgatccagttgtctagaaagacgttcgatactgaataccagaagacaaagaacaacgactgggactacgtcgtgaccaccgatatttccgagatgggggccaattttcgggcagacagggttatcgatccacgccgttgcctgaaacctgtgattctcaaggacggacccgaaagagtcatactggctggtccaatgccggtgactgtagccagcgcagcccagcggaggggccgcatcgggcgaaaccacaataaggagggagatcagtatatttacatgggccagcctcttaacaatgacgaggatcatgctcactggacagaagccaaaatgctactggacaacatcaatacccccgagggtatcattccagcgttgttcgaacccgagagagaaaagtcagcagccatagatggggagtatcggttaaggggcgaggctcgcaaaacatttgtggaactgatgagaaggggagacctccctgtttggctgagttacaaggtcgcctctgagggcttccaatattccgatcggcgttggtgctttgacggggaacgcaacaatcaggtgcttgaggaaaacatggatgtggagatctggactaaagagggagaacgaaagaaactgagaccaaggtggctcgacgctcggacgtacagcgaccccttggcactgcgcgagttcaaggaatttgccgctggtagaaggtcagtcagtggcgatctaattctggagatcgggaagctccctcagcaccttacccagcgggcccaaaatgcactggacaacttagttatgttgcataatagcgaacagggaggccgagcgtatagacacgccatggaggagctgccggatacaattgaaactctcatgctgcttgctctgatcgccgtgctcaccggtggggtaacattgttctttctgtccggccgcggattaggcaaaacctctatagggctactgtgtgtgatggcaagctccgtcctcctttggatggcttcagtggagccacattggatcgccgcatctattatcctggagttctttttgatggttctgctcattcccgagcctgacaggcagcggactccccaggataaccaactggcctacgtggtcatcggacttctcttcatgatactgacggtagctgcgaatgagatgggtttgctggaaaccacaaagaaagacttaggcattgggcacgtggccgcagagaaccaccatcacgctgccatgctagatgttgacctgcatccagccagtgcatggactctctacgctgtggccaccacaatcattacccctatgatgcgtcacactatcgaaaacacaacggcgaatatatcgcttaccgctatcgccaaccaggcagccattctgatgggattggataagggctggcccatcagcaaaatggacattggtgtcccactgctcgctctggggtgctattcccaggtgaatcctcttactttaacagcagccgtcctgatgctcgtggcgcattacgctatcataggcccgggattgcaagccaaggcaaccagagaggcccagaagaggaccgctgccggcattatgaaaaaccccacagttgatgggatcgtggcaatcgacctggatccagtagtgtatgacgctaagtttgaaaaacagctaggacagattatgctgctcatcctttgtacttctcaaatactgttgatgcgcacgacctgggccctgtgcgagtcaattacactcgcgactggccctctgaccacattatgggagggtagccccgggaagttctggaataccactatcgccgtctccatggcaaacattttccggggaagttaccttgctggcgccggtctggcattttctctcatgaaaagcctaggcgggggacgaagaggcacgggggctcagggagaaacactgggcgagaagtggaagaggcagttgaatcagctgtcaaaatccgagttcaacacctataagcgcagtggtatcatggaggttgaccggagcgaagccaaagaggggctcaagagaggagagactaccaaacacgccgtgtctcgtggcacagcgaaacttaggtggtttgtcgaacggaatctggtgaagccagagggtaaagtaatagatttgggctgtgggcgcggaggctggtcctactattgcgctgggctgaagaaagtgactgaagttaagggatacaccaaaggcggtcctgggcacgaggaacccatcccgatggcaacatacggatggaacctcgtgaagttacattcaggcaaagacgtcttctttattccacctgagaagtgtgatacgctgctttgcgacatcggcgagagctcgcccaatccaaccattgaagaggggcgaactctgagagtgctaaagatggtcgaaccctggctcaggggaaaccaattctgtatcaaaattctgaatccttatatgccgtctgtggttgagacattggagcagatgcagcggaagcacggtggcatgctggtacgcaaccccctcagtagaaattccacccatgaaatgtactgggtgagctgcgggactggaaacatcgtctcagccgtgaatatgacatccaggatgcttctgaaccgatttaccatggctcaccggaaaccaacgtatgagcgtgatgttgacttaggcgccggtaccagacacgtggcagtcgaacctgaggtggccaacctggatataattgggcagcgcatcgaaaatatcaagcatgagcacaaatctacatggcattacgacgaggataacccctataagacttgggcttaccacggaagctatgaagtaaagcctagtggctccgcgagctctatggtgaatggcgttgtcaaattgctcaccaagccatgggacgtgattcccatggtgacacaaatagccatgactgataccacacctttcgggcagcagagggtctttaaagagaaggttgacacccggactccaaaagcaaagagaggaacggctcaaatcatggaagtgacagccaagtggctgtggggtttcctatcacgcaacaaaaagcccaggatttgtacccgagaggaatttactcggaaagtaagaagtaatgcagccatcggcgctgtgttcgtcgacgagaaccagtggaactccgccaaggaggcggtggaagatgagaggttttgggaccttgttcatcgcgaacgtgagctgcacaaacaggggaagtgcgcaacctgcgtgtacaacatgatgggaaagcgggagaaaaagctcggcgagttcggtaaagccaaggggagcagagctatttggtacatgtggctgggagccaggttcttggagtttgaagcactgggcttcatgaatgaggatcactggttttctcgcgaaaactcgctctcaggcgtcgagggggagggacttcataaactgggttatatcttacgagacataagcaagatcccgggcgggaatatgtacgctgatgacacagccggatgggatacgcggattaccgaagacgatctgcagaacgaggctaaaatcactgacattatggaacctgagcacgccttgctcgcaaagtccatcttcaagctgacatatcaaaataaagtggtaagagttcagaggccagcgaagaacggcaccgtgatggatgtcataagtcgcagagaccagcggggttctggacaggtgggaacttacggcctaaatacatttaccaacatggaagcccaacttattaggcagatggagagcgagggcatcttctccccctcagaactggagacacctaacctcgctgggcgtgtgctggattggttggaaaaatatggagtcgagcgattaaagcgcatggccatcagtggtgacgactgtgttgtgaaaccaattgatgacagatttgcaactgctctgaccgccctcaatgatatgggcaaggtacggaaggacataccccagtgggaaccgtctaaagggtggaacgattggcagcaagtgcctttctgcagccatcactttcaccagcttatcatgaaggacggaagggagattgtcgtgccctgtcgcaatcaggatgagctggttggcagagcacgggtgtcccagggtgccgggtggtcactaagggaaacggcgtgcctgggaaaaagctacgctcaaatgtggcagctcatgtatttccatcgacgtgacttgagactggccgcaaacgccatctgttctgctgtcccagtggattgggtacctacctcccgcacaacttggagtattcacgcccatcaccagtggatgaccacagaggacatgcttagcgtttggaatcgggtgtggatcgaagagaacccctggatggaagataagactcatatatcgtcctggggcgacgtcccatacctgggcaaaagggaggaccaatggtgcgggtctctcatcggattaaccgcaagagctacgtgggccacaaatattcaggtggcgatcaaccaggttcgccggctgattggtaatgagaactacttggattatatgacctcaatgaagaggtttaagaatgaaagcgaccccgagggcgctctgtggtga

SEQ ID NO: 13840 - RNA, 9879 nt, synthetic construct
  misc_feature 1..9879: note = derived and/or modified CDS sequence (opt3) from DENV-1__FJ898405__SS-prME
  source 1..9879: mol_type = other RNA
agcgtgaccatgctgctcatgcttatgcccacagccctggctttccacttgactacgagaggcggggagcctcatatgatcgtcaccaagcaggaaaggggaaaatccttactgtttaagacatctgcaggtgttaacatgtgcactctaattgccatggacctcggcgagctgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagagcaggacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattaccccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggaagcttcaaactggagaaggaagtggctgagacccagcacggtacggtccttgtgcagataaagtacgagggcacagacgcgccttgcaaaatcccattctcgacccaagatgaaaagggggttactcagaacggacgcttgattacagcaaatcccatcgtgaccgacaaagagaagcctgtaaacatagaagccgagccaccctttggcgagtcttatattgtcatcggtgctggggaaaaagccctgaagctctcctggttcaagaaaggctcaaatatcggaaagatgtttgaggcaactgccagaggcgctaggcggatggccattctgggggataccgcatgggacttcggaagtatcggtggcgtgtttacaagcgttgggaaacttgtgcatcagattttcggaacggcgtacggcgtcctgttttccggtgtgtcttggaccatgaagatagggatcggcgtattgctcacttggctgggattaaacagccgatcaacaagtctgtccatgacctgtattgctgtgggcctagttacactctacctgggggtcatggtgcaggccgatagcggatgcgtgatcaattggaaaggccgcgaacttaagtgtggttctgggatcttcgtcactaacgaggttcacacctggacggaacaatataagtttcaggcagactcaccgaaaagattgagtgccgctattggaaaggcctgggaggagggcgtgtgcggtataaggagcgcaacacggctggaaaacatcatgtggaaacagatttccaatgagctcaaccatatcctgttagaaaatgacatgaagttcaccgtggtagtcggcgatgtggttgggattctggctcagggaaaaaagatgatccgccctcaacccatggagcacaaatactcttggaagtcgtggggcaaggccaaaataatcggggcggacgtgcagaacactacctttattatcgatggaccaaatacacctgaatgtcccgacgatcagagagcctggaacatttgggaggtcgaggactatggcttcggtatctttactaccaatatatggcttaagttgagggatagctacacacaggtgtgcgaccaccgtctcatgtccgctgcaattaaagattcaaaggccgttcatgctgacatggggtattggatcgaaagtgagaaaaacgaaacgtggaagctggcccgggcatctttcattgaggtgaagacctgtatctggccaaaaagccacactctatggtccaatggagtactggaatcagagatgataatccccaagatttacggcggtcctatcagccaacataactatcgaccaggctacttcacacagaccgcggggccgtggcacctcggaaaactggagcttgattttgacttgtgcgaaggcactacagtcgtggtggatgagcactgcgggaatagaggaccctctctgaggaccacgactgtcaccggcaagattatccatgaatggtgttgccgctcctgtacattacctccactccggttcaaaggtgaggacgggtgctggtacggaatggagataagacccgttaaggaaaaggaggaaaacctggtgaaaagtatggtaagcgccggctctggtgaggtggactccttttcacttggcctgttgtgtattagtatcatgatcgaagaggtcatgaggagccgctggtcgcgaaagatgctcatgaccgggactctggctgtgttcctactgctcattatgggacagctgacatggaatgatcttatccggttgtgcattatggttggcgccaacgcatccgaccgtatggggatgggaaccacatatctggctttaatggccacttttaaaatgagacctatgttcgcagtgggcctcctgtttaggcgccttacctctcgggaggtcctgctactcacgataggtctgagcttggtggcctcagttgaactgccaaatagtttagaggaactcggggatggactggctatgggcatcatgattcttaagctgttgacagacttccaatcccaccagctctgggcgaccctgctatctctgacttttatcaaaaccacacttagcctccattacgcctggaagactatggcaatggtgctgtccattgtctcattgttccccctgtgtttaagcaccacgagtcagaagacaacctggctcccggtactgcttggctctctggggtgcaaacctttgactatgtttctcatcgctgagaacaagatatggggaagaaaatcctggccactgaacgaaggtatcatggccgtgggcgttgtgagcattctactgtcgtcacttctcaagaatgatgtccccctggccgggcctttgatcgctggaggcatgttaattgcatgttatgtgatctctggtagttccgccgacctgagcctcgagaaagcggctgaggtatcttgggaagaggaagccgagcacagcggggcatcccataacatactggtggaagtccaggatgacggaacaatgaagattaaagatgaggagagggacgatacccttactatcctgttgaaggccacactactggctgtttcaggcgtgtaccccctcagtatcccagcaaccctgttcgtgtggtatttttggcaaaagaaaaagcagcgaagcggcgtcctttgggacacgccttctcccccagaagtggagcgcgccgttttagatgacgggatttaccggataatgcagagaggactgctcggtaggtcccaggtaggcgtgggggtcttccaagaaaatgtgttccacactatgtggcacgttacccgtggagcggtgttgatgtatcagggcaaacgcctggagccgtcatgggctagtgtcaagaaagacctcatcagctacggtgggggatggcggctgcagggctcctggaacacaggcgaggaagtgcaggtaattgccgtcgagcctgggaagaatcccaagaacgtgcaaaccgcaccaggaacatttaaaactcccgaaggtgaggttggcgccatcgctcttgatttcaagcctgggacctctggatcgccaattgtgaatagagaaggcaaaatcgtcggtctgtacgggaacggagtggttacgacaagcggcacttatgtgtcagccatagcacaggctaaggcctcccaggagggccccttgcctgagatcgaagacgaggtctttaggaaacgaaatctaaccattatggatctgcatccggggagtggaaagacacggcgctacctcccagcgatcgtgagagaagccattaagaggaaattacggaccctgatccttgcacccactcgagtagtggcttctgagatggccgaagctctgaagggtatgcctataagatatcaaaccacagcagttaaaagcgagcacacgggcaaggagattgtcgacctcatgtgccatgccactttcaccatgcgcttgctgtccccagtgagggtgcccaactacaatatgatcatcatggatgaagcccactttacagacccttcatctattgctgcgcgtgggtatatcagcacccgggtcggaatgggcgaggcagccgctatattcatgactgccacaccgcccggtagtgtagaagcatttccacagtccaacgccgtgattcaggatgaggaaagagacatccctgagaggagctggaattctgggtacgagtggattaccgatttccccggaaaaacggtttggtttgtgccatcaatcaagtccggcaacgacatagctaattgtctccgcaagaacggcaaacgagtcattcagctgagtagaaagactttcgatacagaatatcaaaaaaccaagaacaatgactgggactacgtggttaccactgatatcagcgagatgggggcgaactttcgggccgacagggtgatcgatcctcgccgttgccttaaacccgtcattctaaaggacggaccagaaagagtgatcctggcaggtccgatgcctgtaacagtggcttcggccgcacagcggaggggccgcattgggcgaaatcataacaaggagggagatcagtacatatatatgggccagcccttgaataacgacgaggatcacgcccactggaccgaagctaaaatgttactggacaatatcaacacaccagagggtattatccccgccctcttcgaacctgagagagaaaagtctgcggcaatcgatggggagtaccggctgaggggcgaggcccgcaaaactttcgttgaacttatgagaaggggagacctgccagtctggctctcctataaggtggctagcgagggctttcaatactcagatcggcgttggtgcttcgacggggaacgcaataaccaggtgttggaggaaaatatggatgtcgagatttggacgaaagagggagaacgaaagaaactgagacccaggtggctagacgcccggacctatagtgaccctctggctctccgcgagtttaaggaattcgcagccggtagaaggtctgtttccggcgatcttatactggagatcgggaagttaccgcagcatttgacacagcgggctcaaaacgccctggacaatctcgtgatgctgcacaacagcgaacagggaggccgagcatacagacatgcgatggaggagcttccagatactattgaaaccctgatgctcttggccctgatcgctgtattaacaggtggggtgaccctatttttcctgtcaggccgcggactcggcaaaactagtattgggcttctgtgtgtcatggccagctccgtgttgctgtggatggcatctgttgagccccactggatcgctgccagcataatcctcgaatttttcctgatggtgcttctcattcctgagcccgacaggcagcggacgccacaggataatcaactggcatatgtcgtaatcggattgctgtttatgattttaaccgtggccgctaacgagatgggtctactggaaacaactaagaaagacctcggcatcgggcacgttgcggtggagaaccatcaccatgccaccatgcttgatgtcgacctgcaccctgcatccgcttggacattgtacgccgtggccaccactataattacacccatgatgcgtcatacgatcgaaaataccactgcaaacatttcactgacagctatcgccaatcaggcggctatactcatgggactggataagggctggccaatctctaaaatggacattggtgtccctcttttagccctggggtgctacagtcaggtgaacccgctcaccttgaccgcagccgttctgatgctagtggctcactatgcaatcattggccccggactgcaagccaaggcgacaagagaggctcagaagaggactgccgcaggcatcatgaaaaatccaacggtagatgggatagtggccattgacctcgatcctgtcgtttacgacgctaagttcgaaaaacagcttggacagatcatgctgttgatcctgtgtacctcgcaaattctcctgatgcgcacaacttgggccttatgcgagagcatcacccttgcaacaggccccctgaccactctctgggagggttccccagggaagttttggaacacgacaatagctgtgtctatggccaatattttccggggatcatatctagcgggcgccggtctggcatttagcttgatgaaatccctgggcgggggacgaagaggcaccggggctcagggagaaactctcggcgagaagtggaagaggcagcttaaccagctgagtaaatctgaattcaatatctacaagcgcagcggtattatggaggtcgaccggtcagaagccaaagaggggttgaagagaggagagaccacacgtcacgcagtgtccaggggcactgctaaactgcggtggttcgtagaacgcaacctcgtgaagcctgagggtaaggttatcgatttaggctgtgggcgaggaggctggagttattactgcgccgggctgaaaaaggtgaccgaagtcaaaggatatacaaagggcggtcccgggcatgaggaaccgataccaatggccacgtacggatggaatcttgtgaaactgcacagcggcaaggacgtctttttcacccctcccgagaaatgtgatactctactctgcgacatcggcgagtcttccccaaaccccacaattgaagaggggagaaccctgagggtgttgaagatggttgaaccttggctgcggggaaatcaattttgtatcaagattctcaacccgtacatgccctcagtagtggagactcttgagcagatgcagcgcaaacatggtggcatgctggtcagaaatccattaagcaggaactcgacacacgaaatgtattgggtgtcttgcgggaccggaaatatcgttagtgcggtgaacatgacgtcccgaatgctgttgaaccggttcaccatggctcaccgtaagcctacatacgagagagatgtcgacctcggcgcaggtactcgccatgtggccgtagaacccgaggtggctaatctggatattatcgggcagaggatagaaaacattaaacacgagcataagagcacctggcactatgacgaggataatccttacaaaacatgggcctatcatggatcatacgaagttaagccatccggctctgcaagcagtatggtcaacggcgtggtgaagctacttactaaaccctgggacgtcatccctatggttacccaaatcgccatgacagataccactccatttgggcagcagcgggtgttcaaggagaaagtagacacgagaacacccaaggctaaacgcggaaccgcgcaaattatggaagtgactgccaggtggctgtggggttttctctcccgaaataagaagccgcggatatgtaccagagaggaattcacaaggaaagtccgcagcaacgcagctatcggcgccgtgtttgttgacgagaatcagtggaactctgcaaaggaggccgtggaagatgagcgtttctgggacctggtccagaaagaacgggagttgcacaagcaggggaaatgcgctacgtgcgtgtataatatgatgggaaagagagaaaagaaactgggcgagtttggtaaggccaaagggtcaagggcgatttggtacatgtggctcggagcacgcttccttgagtttgaagccctgggcttcatgaacgaggatcactggttcagtcgagaaaattccttaagcggcgtagagggggagggactgcataagttgggttacatcctccgggacatttctaaaatccctggcgggaacatgtatgctgatgacaccgccggatgggatactagaataacagaagacgatctgcaaaatgaggcaaagatcaccgacattatggaaccagagcacgctctacttgccacttcgatctttaaactgacataccagaacaaggttgtgagggtccagcgccccgctaagaatggcaccgtgatggatgtgatttcaagacgggaccagaggggtagcgggcaagtcggaacatatggcctcaacactttcaccaacatggaagcccagctgatccgtcagatggagtccgagggcatatttagtccttctgaattggagattccaaatttagcagaacgagttctggattggctcgagaaatacggggtggaacgccttaagagaatggcgatcagcggagacgactgtgtagtgaaacccatcgatgaccggttcgccacggctctgaccgccctaaacgatatgggtaaggtcaggaaagacgtgccgcagtgggagccttccaagggctggaatgattggcaacaggttcccttttgctcacatcacttccaccagctgattatgaaggacgggcgcgagatagtggtcccatgtagaaaccaggatgaactcgtgggacgggcaagggtaagtcaaggcgctggttggtctttgcgagagacagcctgcctggggaaaagctatgcacagatgtggcagcttatgtactttcatcgtagagacctgcgcctcgccgcgaatgctatctgttccgccgttcctgtggattgggtccccacttcacggaccacatggagcattcacgcacatcaccaatggatgactaccgaagacatgttatctgtgtggaacagggtttggatcgaggaaaatccatggatggaggataagacgcatgtgtccagttggggagacgtcccctatctgggcaaaagagaggaccagtggtgcggcagcttgattgggctgacagcccgcgctacctgggcctcgaacatccaggtggcaataaatcaggtacggaggctcatcggaaacgaaaattaccttgattacatgacttccatgaagcgattcaaaaacgagggtgaccctgaaggcgctctgtggtga

SEQ ID NO: 13841 - RNA, 9879 nt, synthetic construct
  misc_feature 1..9879: note = derived and/or modified CDS sequence (opt3) from DENV-1__FJ898406__SS-prME
  source 1..9879: mol_type = other RNA
agcgtgaccatgctgctcatgcttatgcccacagccctggctttccacttgactacgagaggcggggagcctcatatgatcgtcaccaagcaggaaaggggaaaatccttactgtttaagacatctgcaggtgttaacatgtgcactctaattgccatggacctcggcgagctgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagagcaggacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattaccccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggaagcttcaaactggagaaggaagtggctgagacccagcacggtacggtccttgtgcagataaagtacgagggcacagacgcgccttgcaaaatcccattctcgacccaagatgaaaagggggttactcagaacggacgcttgattacagcaaatcccatcgtgaccgacaaagagaagcctgtaaacatagaagccgagccaccctttggcgagtcttatattgtcatcggtgctggggaaaaagccctgaagctctcctggttcaagaaaggctcaaatatcggaaagatgtttgaggcaactgccagaggcgctaggcggatggccattctgggggataccgcatgggacttcggaagtatcggtggcgtgtttacaagcgttgggaaacttgtgcatcagattttcggaacggcgtacggcgtcctgttttccggtgtgtcttggaccatgaagatagggatcggcgtattgctcacttggctgggattaaacagccgatcaacaagtctgtccatgacctgtattgctgtgggcctagttacactctacctgggggtcatggtgcaggccgatagcggatgcgtgatcaattggaaaggccgcgaacttaagtgtggttctgggatcttcgtcactaacgaggttcacacctggacggaacaatataagtttcaggcagactcaccgaaaagattgagtgccgctattggaaaggcctgggaggagggcgtgtgcggtataaggagcgcaacacggctggaaaacatcatgtggaaacagatttccaatgagctcaaccatatcctgttagaaaatgacatgaagttcaccgtggtagtcggcgatgtggttgggattctggctcagggaaaaaagatgatccgccctcaacccatggagcacaaatactcttggaagtcgtggggcaaggccaaaataatcggggcggacgtgcagaacactacctttattatcgatggaccaaatacacctgaatgtcccgacgatcagagagcctggaacatttgggaggtcgaggactatggcttcggtatctttactaccaatatatggcttaagttgagggatagctacacacaggtgtgcgaccaccgtctcatgtccgctgcaattaaagattcaaaggccgttcatgctgacatggggtattggatcgaaagtgagaaaaacgaaacgtggaagctggcccgggcatctttcattgaggtgaagacctgtatctggccaaaaagccacactctatggtccaatggagtactggaatcagagatgataatccccaagatttacggcggtcctatcagccaacataactatcgaccaggctacttcacacagaccgcggggccgtggcacctcggaaaactggagcttgattttgacttgtgcgaaggcactacagtcgtggtggatgagcactgcgggaatagaggaccctctctgaggaccacgactgtcaccggcaagattatccatgaatggtgttgccgctcctgtacattacctccactccggttcaaaggtgaggacgggtgctggtacggaatggagataagacccgttaaggaaaaggaggaaaacctggtgaaaagtatggtaagcgccggctctggtgaggtggactccttttcacttggcctgttgtgtattagtatcatgatcgaagaggtcatgaggagccgctggtcgcgaaagatgctcatgaccgggactctggctgtgttcctactgctcattatgggacagctgacatggaatgatcttatccggttgtgcattatggttggcgccaacgcatccgaccgtatggggatgggaaccacatatctggctttaatggccacttttaaaatgagacctatgttcgcagtgggcctcctgtttaggcgccttacctctcgggaggtcctgctactcacgataggtctgagcttggtggcctcagttgaactgccaaatagtttagaggaactcggggatggactggctatgggcatcatgattcttaagctgttgacagacttccaatcccaccagctctgggcgaccctgctatctctgacttttatcaaaaccacacttagcctccattacgcctggaagactatggcaatggtgctgtccattgtctcattgttccccctgtgtttaagcaccacgagtcagaagacaacctggctcccggtactgcttggctctctggggtgcaaacctttgactatgtttctcatcgctgagaacaagatatggggaagaaaatcctggccactgaacgaaggtatcatggccgtgggcgttgtgagcattctactgtcgtcacttctcaagaatgatgtccccctggccgggcctttgatcgctggaggcatgttaattgcatgttatgtgatctctggtagttccgccgacctgagcctcgagaaagcggctgaggtatcttgggaagaggaagccgagcacagcggggcatcccataacatactggtggaagtccaggatgacggaacaatgaagattaaagatgaggagagggacgatacccttactatcctgttgaaggccacactactggctgtttcaggcgtgtaccccctcagtatcccagcaaccctgttcgtgtggtatttttggcaaaagaaaaagcagcgaagcggcgtcctttgggacacgccttctcccccagaagtggagcgcgccgttttagatgacgggatttaccggataatgcagagaggactgctcggtaggtcccaggtaggcgtgggggtcttccaagaaaatgtgttccacactatgtggcacgttacccgtggagcggtgttgatgtatcagggcaaacgcctggagccgtcatgggctagtgtcaagaaagacctcatcagctacggtgggggatggcggctgcagggctcctggaacacaggcgaggaagtgcaggtaattgccgtcgagcctgggaagaatcccaagaacgtgcaaaccgcaccaggaacatttaaaactcccgaaggtgaggttggcgccatcgctcttgatttcaagcctgggacctctggatcgccaattgtgaatagagaaggcaaaatcgtcggtctgtacgggaacggagtggttacgacaagcggcacttatgtgtcagccatagcacaggctaaggcctcccaggagggccccttgcctgagatcgaagacgaggtctttaggaaacgaaatctaaccattatggatctgcatccggggagtggaaagacacggcgctacctcccagcgatcgtgagagaagccattaagaggaaattacggaccctgatccttgcacccactcgagtagtggcttctgagatggccgaagctctgaagggtatgcctataagatatcaaaccacagcagttaaaagcgagcacacgggcaaggagattgtcgacctcatgtgccatgccactttcaccatgcgcttgctgtccccagtgagggtgcccaactacaatatgatcatcatggatgaagcccactttacagacccttcatctattgctgcgcgtgggtatatcagcacccgggtcggaatgggcgaggcagccgctatattcatgactgccacaccgcccggtagtgtagaagcatttccacagtccaacgccgtgattcaggatgaggaaagagacatccctgagaggagctggaattctgggtacgagtggattaccgatttccccggaaaaacggtttggtttgtgccatcaatcaagtccggcaacgacatagctaattgtctccgcaagaacggcaaacgagtcattcagctgagtagaaagactttcgatacagaatatcaaaaaaccaagaacaatgactgggactacgtggttaccactgatatcagcgagatgggggcgaactttcgggccgacagggtgatcgatcctcgccgttgccttaaacccgtcattctaaaggacggaccagaaagagtgatcctggcaggtccgatgcctgtaacagtggcttcggccgcacagcggaggggccgcattgggcgaaatcataacaaggagggagatcagtacatatatatgggccagcccttgaataacgacgaggatcacgcccactggaccgaagctaaaatgttactggacaatatcaacacaccagagggtattatccccgccctcttcgaacctgagagagaaaagtctgcggcaatcgatggggagtaccggctgaggggcgaggcccgcaaaactttcgttgaacttatgagaaggggagacctgccagtctggctctcctataaggtggctagcgagggctttcaatactcagatcggcgttggtgcttcgacggggaacgcaataaccaggtgttggaggaaaatatggatgtcgagatttggacgaaagagggagaacgaaagaaactgagacccaggtggctagacgcccggacctatagtgaccctctggctctccgcgagtttaaggaattcgcagccggtagaaggtctgtttccggcgatcttatactggagatcgggaagttaccgcagcatttgacacagcgggctcaaaacgccctggacaatctcgtgatgctgcacaacagcgaacagggaggccgagcatacagacatgcgatggaggagcttccagatactattgaaaccctgatgctcttggccctgatcgctgtattaacaggtggggtgaccctatttttcctgtcaggccgcggactcggcaaaactagtattgggcttctgtgtgtcatggccagctccgtgttgctgtggatggcatctgttgagccccactggatcgctgccagcataatcctcgaatttttcctgatggtgcttctcattcctgagcccgacaggcagcggacgccacaggataatcaactggcatatgtcgtaatcggattgctgtttatgattttaaccgtggccgctaacgagatgggtctactggaaacaactaagaaagacctcggcatcgggcacgttgcggtggagaaccatcaccatgccaccatgcttgatgtcgacctgcaccctgcatccgcttggacattgtacgccgtggccaccactataattacacccatgatgcgtcatacgatcgaaaataccactgcaaacatttcactgacagctatcgccaatcaggcggctatactcatgggactggataagggctggccaatctctaaaatggacattggtgtccctcttttagccctggggtgctacagtcaggtgaacccgctcaccttgaccgcagccgttctgatgctagtggctcactatgcaatcattggccccggactgcaagccaaggcgacaagagaggctcagaagaggactgccgcaggcatcatgaaaaatccaacggtagatgggatagtggccattgacctcgatcctgtcgtttacgacgctaagttcgaaaaacagcttggacagatcatgctgttgatcctgtgtacctcgcaaattctcctgatgcgcacaacttgggccttatgcgagagcatcacccttgcaacaggccccctgaccactctctgggagggttccccagggaagttttggaacacgacaatagctgtgtctatggccaatattttccggggatcatatctagcgggcgccggtctggcatttagcttgatgaaatccctgggcgggggacgaagaggcaccggggctcagggagaaactctcggcgagaagtggaagaggcagcttaaccagctgagtaaatctgaattcaatatctacaagcgcagcggtattatggaggtcgaccggtcagaagccaaagaggggttgaagagaggagagaccacacgtcacgcagtgtccaggggcactgctaaactgcggtggttcgtagaacgcaacctcgtgaagcctgagggtaaggttatcgatttaggctgtgggcgaggaggctggagttattactgcgccgggctgaaaaaggtgaccgaagtcaaaggatatacaaagggcggtcccgggcatgaggaaccgataccaatggccacgtacggatggaatcttgtgaaactgcacagcggcaaggacgtctttttcacccctcccgagaaatgtgatactctactctgcgacatcggcgagtcttccccaaaccccacaattgaagaggggagaaccctgagggtgttgaagatggttgaaccttggctgcggggaaatcaattttgtatcaagattctcaacccgtacatgccctcagtagtggagactcttgagcagatgcagcgcaaacatggtggcatgctggtcagaaatccattaagcaggaactcgacacacgaaatgtattgggtgtcttgcgggaccggaaatatcgttagtgcggtgaacatgacgtcccgaatgctgttgaaccggttcaccatggctcaccgtaagcctacatacgagagagatgtcgacctcggcgcaggtactcgccatgtggccgtagaacccgaggtggctaatctggatattatcgggcagaggatagaaaacattaaacacgagcataagagcacctggcactatgacgaggataatccttacaaaacatgggcctatcatggatcatacgaagttaagccatccggctctgcaagcagtatggtcaacggcgtggtgaagctacttactaaaccctgggacgtcatccctatggttacccaaatcgccatgacagataccactccatttgggcagcagcgggtgttcaaggagaaagtagacacgagaacacccaaggctaaacgcggaaccgcgcaaattatggaagtgactgccaggtggctgtggggttttctctcccgaaataagaagccgcggatatgtaccagagaggaattcacaaggaaagtccgcagcaacgcagctatcggcgccgtgtttgttgacgagaatcagtggaactctgcaaaggaggccgtggaagatgagcgtttctgggacctggtccagaaagaacgggagttgcacaagcaggggaaatgcgctacgtgcgtgtataatatgatgggaaagagagaaaagaaactgggcgagtttggtaaggccaaagggtcaagggcgatttggtacatgtggctcggagcacgcttccttgagtttgaagccctgggcttcatgaacgaggatcactggttcagtcgagaaaattccttaagcggcgtagagggggagggactgcataagttgggttacatcctccgggacatttctaaaatccctggcgggaacatgtatgctgatgacaccgccggatgggatactagaataacagaagacgatctgcaaaatgaggcaaagatcaccgacattatggaaccagagcacgctctacttgccacttcgatctttaaactgacataccagaacaaggttgtgagggtccagcgccccgctaagaatggcaccgtgatggatgtgatttcaagacgggaccagaggggtagcgggcaagtcggaacatatggcctcaacactttcaccaacatggaagcccagctgatccgtcagatggagtccgagggcatatttagtccttctgaattggagattccaaatttagcagaacgagttctggattggctcgagaaatacggggtggaacgccttaagagaatggcgatcagcggagacgactgtgtagtgaaacccatcgatgaccggttcgccacggctctgaccgccctaaacgatatgggtaaggtcaggaaagacgtgccgcagtgggagccttccaagggctggaatgattggcaacaggttcccttttgctcacatcacttccaccagctgattatgaaggacgggcgcgagatagtggtcccatgtagaaaccaggatgaactcgtgggacgggcaagggtaagtcaaggcgctggttggtctttgcgagagacagcctgcctggggaaaagctatgcacagatgtggcagcttatgtactttcatcgtagagacctgcgcctcgccgcgaatgctatctgttccgccgttcctgtggattgggtccccacttcacggaccacatggagcattcacgcacatcaccaatggatgactaccgaagacatgttatctgtgtggaacagggtttggatcgaggaaaatccatggatggaggataagacgcatgtgtccagttggggagacgtcccctatctgggcaaaagagaggaccagtggtgcggcagcttgattgggctgacagcccgcgctacctgggcctcgaacatccaggtggcaataaatcaggtacggaggctcatcggaaacgaaaattaccttgattacatggcttccatgaagcgattcaaaaacgagggtgaccctgaaggcgccctgtggtga

SEQ ID NO: 13842 - RNA, 9879 nt, synthetic construct
  misc_feature 1..9879: note = derived and/or modified CDS sequence (opt3) from DENV-1__GQ199841__SS-prME
  source 1..9879: mol_type = other RNA
agcgtgaccatgctgctaatgcttatgcccaccgcactggctttccacttgactacgagaggcggggaacctcatatgatcgtctccaagcaggaaagggggaagtctttactgtttaagacctcagccggtgttaacatgtgcacactaattgccatggacctcggcgagttctgtgaagatactatgacctacaaatgcccacggataacagaggcggaaccggacgatgtggactgttggtgcaatgctaccgatacttgggtaacatatgggacctgtagtcagacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaagacgcaaactttgtttgccgccgaacattcgtggatagaggctggggtaatgggtgtggactgtttggcaaaggctccttgataacttgcgctaagttcaagtgcgtaaccaaactcgaggggaagacagtgcagtacgaaaacctgaaatattcagtcattgtgaccgttcacactggagaccagcatcaagtgggtaatgagagtacggaacacggcacaaccgccactatcacaccccaggcgcctagcacagagattcagttaaccgactacggggccctgactctcgattgttctccaaggacaggacttgactttaacgaaatggtcctgttgacgatgaaggagaaatcctggctagtgcataagcagtggttcctggatctcccgctgccctggacctcaggcgcaagcacaagtcaagagacatggaatcggaaagaccttctggtaacctttaagacagctcacgccaagaaacaggaagttgtggtcttgggttctcaggagggggctatgcacactgccctcaccggcgcaacggaaatccaaacctccggaacaactaccatcttcgccggccatctgaagtgccgtttaaaaatggataagctgacactaaaagggatgagctatgtgatgtgtactggatcgttcaagctcgagaaggaagtcgctgagacccagcacggtacggtgctggttcagattaaatacgagggcacagacgcgccttgcaagataccattttctacccaggatgaaaaaggggtgactcaaaacggacgccttatcacagcaaatcccattgtaaccgacaaggagaaacctgtcaacatcgaagccgagccacccttcggcgagtcctatatagtgattggtgctggggaaaaggccttgaagctgtcatggtttaaaaagggcagtagcatcggaaaaatgttcgaggcaactgccagaggcgctaggcggatggccatcctcggggataccgcatgggactttggatccattggtggcgttttcacatctgtggggaagctggtccatcagatctttggaacggcgtacggcgtgcttttcagcggtgtatcatggaccatgaaaattgggataggcgtgctgttgacttggctcggactgaatagtcgatccactagcttatctatgacctgtatcgctgttggcctggtcacactatacctcggggtgatggtgcaggccgattcaggatgcgtcattaactggaagggccgcgaactgaagtgtggtagtgggatctttgttactaatgaggtgcacacctggacggaacagtataaattccaagcagacagcccgaagagactttccgccgctatcggaaaagcctgggaggagggcgtgtgcggtattaggtctgcaacacggttggaaaacataatgtggaagcagatctcgaacgagctgaatcatattctcctggaaaacgacatgaaatttaccgtagtcgtgggcgatgttgctgggatcttagcccagggaaagaaaatgattcgccctcagcccatggagtacaagtatagctggaagtcctggggcaaagcgaagatcataggggccgacgtgcaaaatactaccttcatcattgatggaccaaacacacctgaatgtcccgacgatcagagagcttggaatatctgggaggtcgaggactacggctttggtattttcactaccaacatctggctgaaacttagggattcatatacacaggtgtgcgaccaccgtttgatgagtgcagccataaaggattctaaagctgttcacgccgacatggggtactggattgaaagcgagaagaatgaaacgtggaagctcgcacgggcgtccttcatcgaggtgaaaacctgtatttggccaaagtcacatactctgtggagcaacggagtactagaatctgagatgatcatacccaaaatctatggcggtcctatttcccagcacaattaccgaccaggctactttacacaaaccgccgggccgtggcatctgggaaagctcgagctggatttcgacctttgcgaaggcactacagtcgtggtggatgagcactgcgggaacagaggacccagtttgaggaccacgactgtcaccggcaaaatcattcacgaatggtgttgccgcagctgtacactgcctccattacggtttaagggtgaggacgggtgctggtatggaatggagatcagacccgttaaggaaaaagaggaaaatctcgtgaagtctatggtatccgctggctcaggtgaggtggacagtttcagcctgggccttctgtgtatatcgattatgatcgaagaggtcatgaggtcccgctggtctcgaaaaatgttgatgaccgggactctcgccgtgtttttcctgctaatcatgggacagctgacatggaacgatctcattcggctgtgcatcatggttggcgcaaatgctagcgaccgtatggggatgggaaccacataccttgccttgatggcaacttttaagatgagacctatgttcgccgtgggcctgttatttaggcgcctcacctcacgggaggtcctgcttctgacgattggtctaagtctcgtggcttccgttgaactgccaaactctttggaggaactgggggatggattagcgatgggcataatgatcctcaaactgcttacagacttccagagccatcaactgtgggccaccttgctctccctgacttttattaagaccacattctcactacactatgcatggaagactatggctatggtgctgagcatcgtcagtctttttcccctctgtctgtctaccacgtcccagaaaacaacctggttgccggtactgttaggcagcctcgggtgcaagcctctgactatgttccttattgccgagaataaaatctggggaagaaagtcgtggccactgaacgaaggtataatggccgtgggcatcgtttcaattttgctctctagtctgctcaagaatgatgtgcccctggctgggcctcttatcgcaggaggcatgctcattgcctgttacgtcatctccggtagctctgcggacctgagcttggagaaggctgccgaggtgtcctgggaagaggaagcagagcattcaggggccagtcacaatatattagtagaagtgcaggatgacggaacaatgaaaattaaggatgaggagagggacgataccctgactatcctcctgaaggctacacttctggcagtcagcggcgtttatcccttgtctatcccagccaccctattcgtgtggtacttttggcagaaaaagaaacaacgatccggcgtgctgtgggacacgccttcacccccagaagtcgagcgcgcggtgctcgatgacgggatttatcggataatgcagagaggactgcttggtaggagtcaggttggcgtaggggtgttccaggaaaacgtctttcatactatgtggcacgtgacccgtggagctgttttaatgtaccaaggcaagcgcctggagccgagctgggcctccgtgaaaaaggacctcatctcttacggtgggggatggcggttgcagggctcgtggaatacaggcgaggaagtccaggtgattgcagtagagcctgggaagaaccccaaaaatgtccagaccgccccaggaacattcaagactagcgaaggtgaggtgggcgctatcgccctggattttaaacccgggacctcaggatcccctattgttaacagagaaggcaagatcgtgggtctctatgggaatggagtcgtgacgacaagtggcacttacgtttctgcaatagctcaagccaaagcgagccaggagggcccactgcccgagatcgaagacgaggtgttcaggaagcgaaaccttaccattatggatctgcaccctgggtccggaaagacacggcgctatttgccggccatcgtcagagaagcaattaaaaggaagctacggaccctgatcctcgctccaactcgagtggtagcctcagagatggctgaagcattaaaaggtatgcccataagataccagaccacagccgtgaagtctgagcatacgggcaaagagattgttgacctgatgtgccacgccacttttaccatgcgccttctgagccctgtcagggtgccaaattataacatgatcatcatggatgaagctcatttcacagaccccagttccattgcggcacgtgggtacatcagcacccgggtgggaatgggcgaggccgctgccatatttatgactgcaacacctccgggttctgtcgaagccttcccccaatcaaatgctgtaattcaggatgaggaaagagacatcccagagaggtcctggaacagtgggtatgagtggattaccgattttcctggaaagacggtgtggttcgttcccagcatcaagtcgggcaatgacatagcgaactgtctccgcaaaaatggcaagcgagtgattcagttgtctagaaaaactttcgatacagaataccagaagaccaaaaacaacgactgggactacgtcgtgaccactgatatctccgagatgggggccaattttcgggcagacagggttatcgatccacgccgttgcctgaagcctgtgattctcaaggacggacccgaaagagtcatcctggctggtccaatgccggtgacagtagccagcgcagcccaacggaggggccgcattgggcgaaaccacaataaagagggagatcagtatatatacatgggccagcctcttaacaatgacgaggatcatgctcactggaccgaagccaagatgctactggacaacatcaatacacccgagggtattatcccagcgttgttcgaacccgagagagaaaaatcagcagccatcgatggggagtatcggttaaggggcgaggctcgcaagacttttgtggaactgatgagaaggggagacctccctgtttggctgagttacaaagtcgcctctgagggcttccagtattccgatcggcgttggtgctttgacggggaacgcaacaatcaagtgcttgaggaaaacatggatgtggagatttggacgaaggagggagaacgaaagaaactgagaccaaggtggctcgacgctcggacctacagcgaccccttggcactgcgcgagttcaaagaatttgccgctggtagaaggtcagtcagtggcgatctaatactggagatcgggaaactccctcagcaccttacacagcgggcccagaatgcactggacaacttagttatgttgcataatagcgaacaaggaggccgagcgtatagacacgccatggaggagctgccggatactattgaaaccctcatgctgcttgctctgatcgccgtgctcacaggtggggtaaccttgttctttctgtccggccgcggattaggcaagacttctattgggctactgtgtgtgatggcaagctccgctctcctttggatggcctcagtcgagccacattggatcgcagcctctataatcctggagttctttttgatggtgctgctcattcccgagcctgacaggcagcggacgccccaggataaccagctggcttacgttgtgatcggacttctcttcatgattctgaccgtcgcggccaatgagatgggtttgctggaaacaactaaaaaggacttaggcatcgggcacgtagcagtggagaaccaccatcacgctgccatgctagatgttgacctgcatccagccagtgcatggaccctctacgctgtggccacaaccataattactcctatgatgcgtcacacaatcgaaaacacgaccgcgaatatttcgcttactgctatcgccaaccaagcagccatactgatgggattggataaaggctggcccatcagcaagatggacattggtgtcccactgctcgctctggggtgctattcccaggtgaatcctcttacattaaccgcagccgtcctgatgctcgtggcgcattacgctatcattggcccgggattgcaggccaaggcaaccagagaggcccagaagaggacagctgccggcatcatgaagaaccccactgttgatgggatagtggcaattgacctggatccagtagtgtatgacgctaaatttgaaaagcagctaggacagatcatgctgctcatcctttgtacgtctcagattctgttgatgcgcaccacatgggccctgtgcgagtcaatcactctcgcgaccggccctctgacaaccttatgggagggtagccccgggaaattctggaatactacgatagccgtctccatggcaaacattttccggggaagttaccttgctggcgccggtctggcattttctctcatgaaaagcctaggcgggggacgaagaggcacaggggctcaaggagaaaccctgggcgagaagtggaaaaggcagttgaatcagctgtcaaagtccgagttcaacacttataaacgcagtggtatcatggaggttgaccggagcgaagccaaggaggggctcaaaagaggagagaccacaaagcacgccgtgtctcgtggcactgcgaaacttaggtggtttgtcgaacggaatctggtgaaaccagagggtaaggtaattgatttgggctgtgggcgcggaggctggtcctactattgcgctgggctgaaaaaggtgaccgaagttaaaggatacacaaagggcggtcctgggcacgaggaacccatcccgatggcaacgtacggatggaacctcgtgaaattacattcaggcaaggacgtcttctttataccacctgagaagtgtgataccctgctttgcgacatcggcgagagctcgcccaatccaactattgaagaggggcgaacactgagagtgctaaaaatggtcgaaccctggctcaggggaaaccagttctgtatcaagattctgaatccttatatgccgtctgtggttgagaccttggagcaaatgcagcggaaacacggtggcatgctggtacgcaaccccctcagtagaaattccactcatgaaatgtactgggtgagctgcgggacaggaaacatcgtctcagccgtgaatatgacctccaggatgcttctgaaccgatttacgatggctcaccggaagccaacctatgagcgtgatgttgacttaggcgccggtacaagacacgtggcagtcgaacctgaggtggccaacctggatattatcgggcagcgcatagaaaatattaaacatgagcacaagtctacttggcattacgacgaggataacccctataagacctgggcttaccacggaagctatgaagtaaaacctagtggctccgcgagctctatggtgaatggcgttgtcaagttgctcacaaaaccatgggacgtgatccccatggtgactcagatcgccatgaccgatacaacccctttcgggcaacagagggtctttaaggagaaagttgacactcggacgccaaaggcaaagagaggaacagctcagattatggaagtgaccgccaaatggctgtggggtttcctatcacgcaacaagaaacccaggatatgtactcgagaggaatttacccggaaggtaagaagtaatgcagccatcggcgctgtgttcgtcgacgagaaccaatggaactccgccaaagaggcggtggaagatgagaggttttgggaccttgttcatcgcgaacgtgagctgcacaagcaggggaagtgcgcaacatgcgtgtacaacatgatgggaaaacgggaaaagaaactcggcgagttcggtaaggccaaagggagcagagctatttggtacatgtggctgggagccaggttcttggagtttgaagcactgggcttcatgaatgaggatcactggttttctcgcgaaaactcgctctcaggcgtcgagggggagggacttcataagctgggttatatcttacgagacattagcaaaatcccgggcgggaatatgtacgctgatgacacggccggatgggatacccggataactgaagacgatctgcagaacgaggctaagatcacagacattatggaacctgagcacgccttgctcgcaaagtccatcttcaaactgacctatcagaataaggtggtaagagttcaaaggccagcgaaaaacggcactgtgatggatgtcattagtcgcagagaccagcggggttctggacaggtgggaacatacggcctaaatacctttacaaacatggaagcccagcttatcaggcaaatggagagcgagggcatattctccccctcagaactggagactcctaacctcgctgggcgtgtgctggattggttggaaaagcatggagtcgagcgattaaaacgcatggccattagtggtgacgactgtgttgtgaagccaatcgatgacagatttgcaaccgctctgacggccctcaatgatatgggcaaggtacggaaagacatcccccagtgggaaccgtctaaggggtggaacgattggcaacaggtgcctttctgcagccaccactttcatcaacttattatgaaagacggaagggagatagtcgtgccctgtcgcaatcaggatgagctggttggcagagcacgggtgtcccagggtgccgggtggtcactaagggaaaccgcgtgcctgggaaagagctatgctcagatgtggcaactcatgtacttccaccgacgtgacttgagactggccgcaaacgccatctgttctgctgtcccagtggattgggtacctacatcccgcactacctggagtattcatgcccaccatcagtggatgacaactgaggacatgcttagcgtttggaatcgggtgtggatcgaagagaacccctggatggaagataaaacccacatttcgtcctggggcgacgtcccatatctgggcaagagggaggaccagtggtgcgggtctctcatcggattaacggcaagagctacatgggccaccaatatacaagtggcgatcaaccaggttcgccggctgattggtaatgagaactacttggattacatgacttcaatgaagaggtttaaaaatgaaagcgaccccgagggcgctctgtggtga

SEQ ID NO: 13843 - RNA, 9879 nt, synthetic construct
  misc_feature 1..9879: note = derived and/or modified CDS sequence (opt3) from DENV-1__FJ898407__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagctgtgtgaagatactatgacctacaaatgcccacggataacagaggtggaaccggacgatgtagactgttggtgcaataccactgatacatgggtgacctatgggacgtgtagtcaaactggagagcaccgccgagacaagcgtagcgtcgcgcttgctccccatgtgggcctgggtttggagaccagagccgaaacatggatgtcctctgagggggcatggaaacagatccagaaggttgaaacttgggccctcaggcaccctggattcaccgtgattgctctgtttctggcacatgccatcggcacatcgattacccagaagggcatcatattcatcctcttaatgctggtcacgccatcaatggctatgcggtgcgtggggattggaagccgcgattttgtagagggtcttagtggcgccacttgggttgacgtggtcttggagcacgggtcctgtgtgacaaccatggcgaaagataagcccactctggacatcgaactactcaaaacagaggtgaccaaccctgcagtcctgagaaagctttgcattgaagccaaaatctctaatacgaccacagatagcaggtgtccaactcaaggagaggctaccctggttgaagagcaggacgccaacttcgtgtgccggcgcacatttgtagatcgaggctggggtaatgggtgtggattgttcggcaagggctccctcataacttgcgcaaagtttaaatgcgtgaccaagctggaggggaaaattgtccagtacgaaaacttaaagtattcagtgatcgttacagtgcacaccggagaccagcatcaagtcggtaatgagagtactgaacacggcacgacagctaccattactccccaggcccctaccagcgagatccagctgacagactacggggcgctcacccttgattgttctccaagaactggactggacttcaacgaaatggtgttgctaacaatgaaagagaagtcctggctggtacataaacagtggtttctcgatctgccgcttccctggacgtcaggcgccagcaccagtcaagagacttggaataggcaggacctgttggttacattcaagaccgcacacgctaagaaacaggaagtggtcgtgctcggttctcaagagggggccatgcacacagctctgactggcgccaccgaaatccagacgtccggaaccacaactatttttgcaggccatttaaagtgccggctgaaaatggataagctaaccctcaaagggatgagctatgtcatgtgtacaggatcgttcaagctggagaaggaagtggccgagactcagcacggtaccgttcttgtgcagataaaatacgagggcacggacgctccttgcaagatcccattctctacacaagatgaaaaaggggtaacccagaacggacgtttgattactgcgaatcccatcgtcacagacaaggagaaacctgtgaacatagaagcagagccaccctttggcgagtcctatattgttatcggtgccggggaaaaggctctgaagctctcatggttcaaaaagggcagtagcatcggaaaaatgtttgaggccaccgcacgcggcgccagaaggatggctattctgggggatactgcctgggacttcggatccatcggtggcgtgtttacctctgtcgggaagcttgtgcatcagattttcggaacagcatacggcgtactgtttagcggtgtgtcatggacgatgaaaatagggatcggcgttttgctcacctggctgggattaaatagtcggtccactagcctgtctatgacatgtattgcggtcggcctagtgaccctctacctgggggtgatggtccaggctgattcaggatgcgttatcaactggaagggccgagaacttaagtgtggtagtgggatcttcgtgacaaatgaggtgcacacttggaccgaacaatataaatttcaggccgacagcccgaagcgcttgtccgcagccattggaaaagcttgggaggagggcgtatgcggtataagatctgccacgaggctggaaaacatcatgtggcggcagatttcgaacgagctcaatcatatcctgttagaaaacgacatgaagttcacagtcgtggttggcgatgtggtcgggattctggcacagggaaaaaagatgatccgccctcaacccatggagcacaaatacagctggaagtcctggggcaaggctaaaataatcggggccgacgtgcagaataccacttttattatcgatggaccaaacacccctgaatgtcccgacgatcagagagcgtggaatatttgggaggttgaggactatggcttcggtatctttacaactaacatatggcttaagttgagggattcatacacccaggtgtgcgaccaccgtctcatgagtgccgctattaaagattctaaggcagtacatgccgacatggggtattggatcgaaagcgagaaaaatgaaacatggaagctggctcgggcctccttcattgaggtcaagacgtgtatctggccaaaatcacacaccctatggagcaacggagtgctggaatctgagatgataatccccaagatttacggcggtcctatctcccaacataattatcgaccaggctacttcactcagacagcagggccgtggcacctcggaaaactggagcttgattttgacttgtgcgaaggcaccactgtggtcgttgatgagcactgcgggaacagaggacccagtctgaggacaaccacggtgactggcaagattatccatgaatggtgttgccgcagctgtaccttacctccactccggttcaaaggtgaggacgggtgctggtacggaatggagataagacccgtaaaggaaaaggaggaaaatctggtgaaatctatggtctccgcgggctcaggtgaggtggacagttttagccttggcctgttgtgtatttcgatcatgatcgaagaggttatgaggtcccgctggtctcgaaagatgctcatgacagggaccctggccgtgttctttctactgattatgggacagctcacttggaacgatctgatccggagctgcattatggtcggcgctaatgcctcagaccgtatggggatgggaacaacctatcttgcattgatggctacattcaaaatgagacctatgtttgccgtgggcctgttattcaggcgcctcactagtcgggaggttctgcttctgaccataggtctatccctcgtggcatctgtcgaactgccaaacagcttggaggaactgggggatggattagccatgggcatcatgattctcaagctgcttacggactttcaatcctaccagctgtgggctacattgctctcactgaccttcatcaaaactacctttagcctacactatgcgtggaagacaatggccatggtactgagtattgtgtctcttctccccctgtgtttgtccactaccagccagaagacgacatggctgccggttttactcggctcgctggggtgcaaacctcttaccatgttcctgatcgcagagaataagatatggggaagaaaatcatggccattgaacgaaggtatcatggctgtgggcattgtctctatcctcctgagttccctactgaagaacgatgtgccccttgccgggcctctcattgccggaggcatgctgatcgcttgttacgtaataagcggttctagcgcagacttgtccttagagaaagccgcggaggtgtcatgggaagaggaagctgagcatagtggggccagccacaatattctggtcgaagttcaggatgacggaactatgaagatcaaagatgaggagagggacgatacactcaccatcctgcttaaggcaactctgttggccgtgtctggcgtgtatcccctatccattccagctacactgtttgtctggtacttctggcaaaagaaaaagcagcgatcaggcgtgctctgggacacccctagtcccccagaagttgagcgcgcagtactggatgacgggatatatcggatcatgcagagaggacttttaggtaggagccaggtgggcgtcggggtgttccaagaaaacgtttttcatacgatgtggcacgtgactcgtggagccgtcctgatgtaccagggcaaacgcctcgagccgtcctgggcgtctgtgaagaaagacttgatttcgtacggtgggggatggcggctgcagggcagctggaataccggcgaggaagtacaggtcatcgctgtggagcctgggaagaaccccaagaatgttcaaacagccccaggaaccttcaaaacacccgaaggtgaggtgggcgcaattgccctcgattttaagcctgggacttcaggatccccaatcgtcaacagagaaggcaaaatagtgggtctgtatgggaatggagttgtgaccacgagtggcacatacgtctctgctatcgcccagactaaggcaagccaggagggcccccttcctgagattgaagacgaggtgttcaggaaacgaaacctgaccatcatggatttgcacccggggtccggaaagacacggcgctatctaccagctattgtaagagaagccatcaagaggaaactgcggaccctcatattagcgcccactcgagtggttgcctcagagatggcagaagctctgaagggtatgcctattagataccaaaccacagccgtcaaatctgagcatacgggccgcgagatcgtggaccttatgtgccacgctacttttaccatgaggctgctcagcccagtgcgtgtccccaattataacatgatcattatggatgaagcacatttcacagaccctagttccatcgccgcccgggggtacataagcaccagagtaggaatgggcgaggctgcggcaatttttatgactgccacaccgcccggttctgtggaagctttcccacagtcaaatgccgttatccaggatgaggaaagggacattcctgagcgctcctggaacagtgggtatgagtggatcaccgattttcccggaaagacggtgtggttcgtcccaagcataaaatcgggcaatgacattgcaaactgtttgcgaaagaatggcaagagagtgatccagctgtctcggaaaacttttgatacagaataccaaaagaccaaaaacaacgactgggactacgttgtgaccactgatatctccgagatgggggccaatttcagggctgaccgcgtcattgatcctcgtagatgcctcaagcccgtgatcctgaaagacggaccagaacgggtaattcttgcgggtccgatgcctgtgacagttgccagcgcagctcagaggcgcggccgaatagggagaaaccacaataaggagggagatcagtatatctacatgggccagcccctaaacaatgacgaggatcatgcccactggaccgaagcaaagatgctgttggacaacattaatacaccagagggtatcatccccgccttattcgaacctgagcgggaaaaatcagctgccattgatggggagtataggctgcgcggcgaggcgagaaagacttttgtcgaactcatgaggcggggagacctgccagtgtggcttagttacaaagtggcatctgagggcttccaatattccgatcgtcgctggtgctttgacggggaacgaaacaatcaggtcctggaggaaaacatggatgttgagatatggacgaaggagggagaaagaaaaaagctcaggccccggtggttggacgcccgcacctacagcgaccctctggctctaagagagttcaaagaatttgccgctggtaggcggtcagtgagtggcgatctgatcctcgagattgggaagcttccgcagcacctgacacagcgagcacaaaatgccttagacaacttggtaatgctgcataatagcgaacagggaggcagagcttatcgccacgccatggaggagctcccagatactatcgaaaccctgatgcttctggcactcattgcggtgttgacaggtggggtcaccctgttctttttatccggcaggggactaggcaagacttctatcgggctgctctgtgtgatggccagctccgctcttctgtggatggcctcagttgagccccattggatagcagcttctatcattttggaattctttctgatggtgctcctgatccctgagcccgaccggcagcgtacgccacaggataaccaacttgcctacgtcgtaattggactcctgttcatgatcttgaccgtggcagccaatgagatgggtctgttagaaacaactaaaaaggacctaggcatagggcacgttgctgtggagaaccaccatcacgcgaccatgctggatgtcgacctccatcctgccagtgcatggacactttacgctgtggccaccactattatcacacccatgatgagacacacgattgaaaacaccactgccaatatctcgctgacagcaatagctaaccaggccgcgatcttgatgggactggataaaggctggccaattagcaagatggacatcggtgtccctctcctggctcttgggtgctattcccaggtgaatccgttaaccctgaccgccgcagttctcatgttggtggcccattacgctattatcggccccggactgcaagcaaaagccacaagggaggcgcagaagcgcactgctgccggcataatgaagaacccaacggtagatgggattgtggcaatcgacctagatcctgtcgtttatgacgccaaatttgaaaagcagctgggacagatcatgctccttattctgtgtacctctcaaatcttgctgatgcggacaacttgggctctctgcgagtcaataaccctggccacaggccccttaaccactctttgggagggtagcccagggaaattctggaatacgacaattgcagtgtccatggctaacatctttcgaggaagttacctggccggcgcgggtctcgccttctctctaatgaagagcctgggcgggggaagaaggggcaccggggcacagggagaaactttgggcgagaaatggaagcgccagctgaatcagctctcaaagtccgaattcaacacctataaacggagtggtattatggaggtcgacagaagcgaagctaaggaggggcttcgtaggggagagacaactaaacacgccgtgtctcggggcaccgcaaagctgcgctggtttgtagaacgaaatttggtgaaacctgagggtaaggttatcgatctgggctgtgggagaggaggctggtcctactattgcgctgggctcaagaaagtgacagaagtcaagggatacacgaaaggcggtcccgggcacgaggaaccgataccaatggccacctacggatggaacttagtgaagctgcattcaggcaaagacgtcttctttatccctcccgagaagtgtgatactcttctgtgcgacattggcgagagctcgccaaatcccacaatcgaagaggggaggaccctacgggtgctcaaaatggttgaaccttggctgcgcggaaaccaattctgtattaagatcttgaatccgtatatgccctctgtagtggagactctggagcagatgcagagaaagcacggtggcatgctcgtcaggaacccacttagtcgaaattccacacatgaaatgtactgggtgagctgcgggaccggaaacattgtttcagccgtgaatatgacgtcccggatgctgttaaaccgttttaccatggcgcacagaaaacctacatatgagcgcgatgtcgacctgggcgctggtactaggcacgtggcagtagaacccgaggtggccaacttggatatcatagggcagcggattgaaaatatcaagcatgagcacaaatctacctggcattacgacgaggataacccttataagacatgggcttaccacggaagctatgaagttaaaccaagtggctccgccagctctatggtcaatggcgtggtgaagctcctgactaagccctgggacgtcatccctatggttacccaaattgcaatgacagataccactccattcgggcagcagagagtgtttaaagagaaggtagacacgcgcacacccaaagccaagaggggaaccgctcaaataatggaagtgactgcgcgatggctatggggtttcctttcacggaacaaaaagccgagaatctgtaccagggaggaatttacacgcaaggtccgtagtaatgccgcaattggcgctgtgttcgttgacgagaaccagtggaattccgccaaagaggcagtggaagatgagcggttttgggacctggtccatagagaaagggagctccacaagcaggggaaatgcgccacgtgcgtgtacaacatgatgggaaagcgcgaaaaaaagctgggcgagttcggtaaggctaaagggagccgagccatctggtacatgtggttgggagcgcggtttctggagttcgaagcactcggcttcatgaatgaggatcactggttttctagagaaaactcgctttcaggcgtagagggggagggactgcataagttaggttatattctgagggacatcagcaaaatacctggcgggaatatgtacgccgatgacaccgctggatgggatactcgcatcacagaagacgatttgcagaacgaggccaagattaccgacatcatggaaccagagcacgcactcctggctacttccattttcaaactaacatatcaaaataaggttgtgagagtccagcggcccgccaggaacggcaccgtgatggatgtgatcagtcgtcgagaccagcgcggttctgggcaggtcggaacatacggccttaatacttttaccaacatggaagctcaactgataagacagatggagagcgagggcattttctccccttcagaactcgagacgccaaacctggccgaacgggttttggattggttagagaaacatggggtggaaaggctgaagcgcatggcaatcagtggagacgactgtgtagtgaagcccatcgatgacagatttgcgaccgccctctctgctcttaatgatatgggtaaagtccggaaggacattccgcagtgggagcctagcaaaggctggaacgattggcagcaagtgcccttctgctcccaccactttcatcagctgataatgaaggacgggagggagatcgttgtgccatgtcgaaatcaggatgaactagtcggacgtgccagagtgtcacagggcgcaggttggagcctgcgcgagacagcttgcctcgggaaatcttatgcccaaatgtggcagttgatgtacttccaccggagggacctgagacttgcagccaacgcgatttgttccgctgtacctgttgattgggtgcccactagtcgcaccacatggagcatccatgcccaccatcagtggatgactaccgaagacatgctgtcggtctggaatcgggtgtggattgaggaaaacccatggatggaggataagacgcacatctcctcttggggagacgttccctatctcggcaagagggaggaccaatggtgcggctcattaatagggctgacagcacgagccacctgggctactaatatccaggtggccattaaccaggtcagacggttgatcggaaatgaaaactacctggattacatgacaagcatgaaaaggtttaagaatgagagtgaccctgaaggtgcactctggtga

SEQ ID NO: 13844 - RNA, 9879 nt, synthetic construct
  misc_feature 1..9879: note = derived and/or modified CDS sequence (opt3) from DENV-1__FJ898408__SS-prME
  source 1..9879: mol_type = other RNA
agcgtgaccatgctgctcatgcttatgcccaccgcactggctttccacttgactacgaggggaggggaacctcatatgatcgtcaccaagcaggaaaggggaaaatccttactgtttaagacatctgccggtgttaatatgtgcactctgattgccatggacctcggcgaactgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaaccgccactattacaccccaggcgcctacaagtgagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaatccagacctctggaacaactaccatttttgccggccatttaaaatgccgtctgaagatggataaactaacactcaaggggatgtcctatgtcatgtgtactggatcgttcaaactggagaaggaagtggctgagacccagcacggtacggtccttgtgcagataaagtacgagggcacagacgcgccttgcaaaatcccattctcgacccaagatgaaaagggggttactcagaacggacgcttgattacagcaaatcccatcgtgaccgacaaagagaagcctgtaaacatagaagccgagccaccctttggcgagtcttatattgtcatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtgtttacatccgttgggaaacttgtgcatcagattttcggaacggcgtacggcgtcctgttttctggtgtgagctggaccatgaagatagggatcggcgtattgctcacttggctgggattaaattcacgaagtacatccctgagcatgacctgtattgctgtgggcctagttacactctacctgggggtcatggtgcaggccgattctggatgcgtgatcaactggaaaggccgcgaacttaagtgtggttcagggatcttcgtcactaatgaggttcacacctggacggaacaatataagtttcaggcagacagtccgaaaagattgagcgccgctattggaaaggcctgggaggagggcgtgtgcggtataaggtccgcaacacggctggaaaacatcatgtggaaacagatttctaacgagctcaatcatatcctgttagaaaacggcatgaagttcaccgtggtagtcggggacgtggttggcattctggctcagggcaaaaagatgatccgccctcaacccatggagcacaaatactcgtggaaaagctgggggaaggccaagataatcggagcggatgtgcagaatactacctttattatcgacggcccaaacacacctgaatgtcccgatgaccagagagcctggaatatttgggaggtcgaggattatggtttcgggatctttactaccaacatatggcttaagttgagggactcctacacacaggtgtgcgatcaccgtctcatgtcagctgcaattaaagacagtaaggccgttcatgctgatatgggatattggatcgaatctgagaaaaatgaaacgtggaagctggcccgggcatccttcattgaggtgaagacctgtatctggccaaaatcccacactctatggtcaaacggcgtactggaaagcgagatgataatccccaagatttacggtggccctatctctcaacataattatcgaccagggtacttcacacagaccgcgggaccgtggcacctcggcaaactggagcttgactttgatttgtgcgaagggactacagtcgtggtggacgagcactgcggaaacagaggcccctccctgaggaccacgactgtcaccggtaagattatccatgaatggtgttgccgcagttgtacattacctccactccggttcaaaggggaggatggatgctggtacggcatggagataagacccgttaaggaaaaggaggaaaatctggtgaaaagcatggtatctgccggttccggcgaggtggactcatttagtcttgggctgttgtgtaccagcattatgatcgaagaggtcatgaggtcgcgctggtcccgaaagatgctcatgactggaacactggctgtgttcctactgctcatcatgggccagctgacctggaacgaccttattcggttgtgcatcatggttggggccaatgcatctgatcgtatgggaatgggcacaacttatctggctttaatggccacctttaaaatgagacctatgttcgcagtgggtctcctgtttaggcgccttacgagccgggaggtcctgctactcacaattgggctgtcattggtggccagtgttgaactgccaaactccttagaggaactcggagacggcctggctatgggcataatgatccttaagctgttgaccgatttccaatctcaccagctctgggcgactctgctaagcctgacctttattaaaacaactctttccctccattacgcctggaagaccatggcaatggtgctgtcaatcgtcagcttgttccccctgtgtttaagtacgacatctcagaagaccacttggctcccggtactgcttgggtccctgggatgcaaacctttgacaatgtttctcattgctgagaataagatctggggtagaaaaagctggccactgaacgaaggcataatggccgtgggggttgtgtcgatcctactgtcatctcttctcaagaacgacgtccccctggccggacctttgattgctggcggtatgttaatcgcatgttatgtgattagtgggtccagcgccgatctgtctctcgagaaagcggctgaggtaagctgggaagaggaagccgagcactccggagcatcacataatatcctggtggaagtccaggacgatggcaccatgaagataaaagacgaggagagggatgacactcttacaattctgttgaaggccaccctactggctgttagtggcgtgtaccccctcagcatcccagcaacgctgttcgtgtggtatttttggcaaaagaaaaagcagcgatctggggtcctttgggatactccttcacccccagaagtggagcgcgccgttttagacgatggaatctaccggattatgcagagaggtctgctcggcaggagccaggtaggggtgggagtcttccaagaaaacgtgttccacaccatgtggcacgttacacgtggcgcggtgttgatgtatcagggtaaacgcctggagccgagttgggctagcgtcaagaaagacctcatatcctacgggggaggctggcggctgcagggctcttggaataccggggaggaagtgcaggtaatcgccgtcgagcctggaaagaaccccaagaatgtgcaaacagcaccaggtacttttaaaacccccgaaggcgaggttggggccattgctcttgacttcaagcctggaacgtcgggcagcccaatcgtgaacagagaaggtaaaattgtcgggctgtacggaaatggcgtggttacaacttcaggcacctatgtgtccgccatcgcacaggctaaggccagtcaggaggggcccttgcctgagatagaagatgaggtctttaggaaacgaaacctaacaatcatggacctgcatccgggatctggtaagacccggcgctacctcccagcgattgtgagagaagccatcaagaggaaattacggactctgattcttgcacccacccgagtagtggctagcgagatggccgaagctctgaagggcatgcctatcagatatcaaacaacggcagttaaatccgagcacactgggaaggagatagtcgatctcatgtgccatgccaccttcacaatgcgcttgctgtcaccagtgagggtgcccaattacaacatgattatcatggacgaagcccactttaccgatccttctagcatcgctgcgcgtggatatattagtactcgggtcggcatgggtgaggcagccgctatcttcatgacagccaccccgcccgggtccgtagaagcatttccacagagcaatgccgtgatacaggacgaggaaagagatattcctgagaggtcttggaactcaggatacgagtggatcacggacttccccggcaaaactgtttggtttgtgccatccattaagagtggcaatgatatcgctaactgtctccgcaagaatgggaaacgagtcatacagctgagcagaaagacattcgacaccgaatatcagaaaaccaagaacaacgattgggactacgtggttactacagacatttcggagatgggagcgaattttcgggccgatagggtgatcgaccctcgccgttgccttaaacccgtcatcctaaaggatggtccagaaagagtgattctggcaggcccgatgcctgtaaccgtggcttctgccgcacagcggagggggcgcatcggacgaaaccataataaggagggcgaccagtacatttatatgggtcagcccttgaacaatgatgaggaccacgcccactggacagaagctaaaatgttactggataacataaatactccagaggggatcattcccgccctcttcgaacctgagagagaaaagtccgcggcaatcgacggcgagtaccggctgaggggagaggcccgcaaaacgttcgttgaacttatgagaaggggcgatctgccagtctggctcagctataaggtggcttcagaggggtttcaatacagtgaccggcgttggtgcttcgatggagaacgcaacaatcaggtgttggaggaaaacatggacgtcgagatctggaccaaagagggtgaacgaaagaaactgagacccaggtggctagatgcccggacatattctgaccctctggctctccgcgagtttaaggagttcgcagccggcagaaggtccgttagcggggaccttattctggagataggaaagttaccgcagcatttgactcagcgggctcaaaatgccctggataacctcgtgatgctgcacaattcagaacagggcggtcgagcatacagacatgcgatggaggagcttccagacaccatcgaaacactgatgctcttggccctgattgctgtattaaccgggggcgtgactctatttttcctgagtggacgcggcctcgggaaaacgagcatcggacttctgtgtgtcatggcctcctctgtgttgctgtggatggcaagcgttgagccccactggattgctgcctccatcatactcgaatttttcctgatggtgcttctcatccctgagcccgataggcagcggaccccacaggacaaccaactggcatatgtcgtaattggtttgctgtttatcattttaacagtggccgctaatgagatgggcctactggaaactaccaagaaagatctcgggatcggacacgttgcggtggagaaccatcaccatgccacaatgcttgacgtcgatctgcaccctgcatcagcttggaccttgtacgccgtggccactacaataattacgcccatgatgcgtcataccatcgaaaacactacagcaaatatttctctgaccgctatcgccaaccaggcggctatactcatgggcctggacaagggttggccaatcagtaaaatggatattggggtccctcttttagccctgggctgctacagccaggtgaatccgctcaccttgacagcagccgttctgatgctagtggctcactatgcaatcattggacccggcctgcaagccaaggcgactagagaggctcagaagaggacggccgcagggatcatgaaaaacccaaccgtagacggaatagtggccattgatctcgaccctgtcgtttacgatgctaagttcgaaaaacagcttggccagatcatgctgttgatcctgtgtacaagccaaattctcctgatgcgcactacctgggccttatgcgagtccatcacacttgcaaccggtcccctgactacgctctgggaggggtctccaggaaagttttggaatacaaccatagctgtgtcaatggccaacattttccggggcagctatctagcgggtgccggcctggcattttccttgatgaaaagtctagggggaggccgaagagggactggagctcagggcgaaaccctcggtgagaagtggaagaggcagcttaatcagctgtctaaaagcgagttcaacatctacaagcgctcagggattatggaggtcgaccggtccgaagccaaagagggattgaagagaggcgagacaactcgtcacgcagtgagtaggggtaccgctaaactgcggtggttcgtagaacgcaatctcgtgaagcctgagggcaaggttatcgacttagggtgtggacgaggcgggtggagctattactgcgccggactgaaaaaggtgacagaagtcaaaggctatacgaagggtgggcccggacatgaggaaccgataccaatggccacctacggctggaaccttgtgaaactgcactctggcaaggatgtctttttcactcctcccgagaaatgtgacacactactctgcgatatcggggagtcctcaccaaatcccaccattgaagagggaagaactctgagggtgttgaagatggttgaaccttggctgcggggtaaccaattttgtatcaagattctcaatccgtacatgcccagcgtagtggagacacttgagcagatgcagcgcaaacatggcgggatgctggtcagaaacccattatcgagaaattctacccacgaaatgtattgggtgagttgcggaacgggcaacatcgtttccgcggtgaatatgaccagccgaatgctgttgaaccggttcacaatggctcaccgtaagcctacttacgagagagacgtcgatctcggtgcagggacccgccatgtggccgtagaacccgaggtggctaacctggacattatcggacagaggatagaaaatattaaacacgagcataagtcaacatggcactatgatgaggacaacccttacaaaacttgggcctatcatggctcctacgaagttaagccatctggcagcgcaagttccatggtcaatggggtggtgaagctacttaccaaaccctgggatgtcatccctatggttacacaaatcgccatgaccgacactacgccatttggacagcagcgggtgttcaaggagaaagtagatacaagaacccccaaggctaaacgcggtactgcgcaaattatggaagtgaccgccaggtggctgtggggctttctcagccgaaacaagaagccgcggatatgtacaagagaggagttcacgaggaaagtccgctctaatgcagctatcggggccgtgtttgttgacgagaaccagtggaactcagcaaaggaggccgtggaagacgagcgtttctgggatctggtccagaaagaacgggagttgcacaagcagggaaaatgcgctacctgcgtgtataacatgatgggcaagagagaaaagaaactgggtgagtttgggaaggccaaaggaagtagggcgatttggtacatgtggctcggcgcacgcttccttgagtttgaagccctgggcttcatgaatgaggaccactggttctcccgagaaaacagcttatctggggtagagggagagggtctgcataagttgggctacatcctccgggatatttcgaaaatccctgggggaaatatgtatgctgacgatactgccggctgggacacaagaataaccgaagatgacctgcaaaacgaggcaaagatcactgatattatggaaccagagcacgctctacttgccacatcaatctttaaactgacctaccagaataaggttgtgagggtccagcgccccgctaagaacggtacagtgatggacgtgattagcagacgggatcagagggggtccggacaagtcggcacttatggcctcaataccttcacgaacatggaagcccagctgatccgtcagatggagagtgaggggatatttttgccttctgaattagagaccccaaacctggcagaacgagttctcgactggcttgagaaatacggagtggaacgcctgaagagaatggcgattagcggtgatgactgtgtagtgaaacccatcgacgatcggttcgccacagctctaactgccctgaatgacatgggcaaggtcaggaaagatatcccgcagtgggagccttccaaggggtggaacgactggcaacaggtgcccttttgctcacatcacttccaccagctcattatgaaggatggacgcgagatagttgtgccatgtagaaatcaggacgaattggtcggccgggcaagggtgagtcaaggtgctgggtggtctctgcgagagaccgcctgccttggaaaaagctatgcacagatgtggcagctgatgtactttcatcgtagagatctccgcttagccgcgaacgctatctgttccgccgaccctggcgattgggtacccacatcacggactacctggagcattcacgcacatcaccaatggatgacgacagaagacatgctgtctgtttggaatagggtgtggatcgaggaaaacccatggatggaggataagacccatgtctccagttggggcgacgtgccctatttggggaaaagagaggaccagtggtgcggaagcctgattggtctcactgcccgcgctacatgggcctcgaatatccaggttgcaataaaccaggtgcggaggcttatcggcaatgaaaactacctggattacatgacctccatgaagcgattcaaaaatgagggggaccctgaaggagctctatggtga

SEQ ID NO: 13845 - RNA, 9879 nt, synthetic construct
  misc_feature 1..9879: note = derived and/or modified CDS sequence (opt3) from DENV-1__GQ199843__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagctgtgtgaagatactatgacctacaaatgcccacggataacagaggtggaaccggacgatgtagactgttggtgcaataccactgatacatgggtgacctatgggacgtgtagtcaaactggagagcaccgccgagacaagcgtagcgtcgcgcttgctccccatgtgggcctgggtttggagaccagagccgaaacatggatgtcctctgagggggcatggaaacagatccagaaggttgaaacttgggccctcaggcaccctggattcaccgtgattgctctgtttctggcacatgccatcggcacatcgattacccagaagggcatcatattcatcctcttaatgctggtcacgccatcaatggctatgcggtgcgtggggattggaagccgcgattttgtagagggtcttagtggcgccacttgggttgacgtggtcttggagcacgggtcctgtgtgacaaccatggcgaaagataagcccactctggacatcgaactactcaaaacagaggtgaccaaccctgcagtcctgagaaagctttgcattgaagccaaaatctctaatacgaccacagatagcaggtgtccaactcaaggagaggctaccctggttgaagagcaggacgccaacttcgtgtgccggcgcacatttgtagatcgaggctggggtaatgggtgtggattgttcggcaagggctccctcataacttgcgcaaagtttaaatgcgtgaccaagctggaggggaaaattgtccagtacgaaaacttaaagtattcagtgatcgttacagtgcacaccggagaccagcatcaagtcggtaatgagagtactgaacacggcacgacagctaccattactccccaggcccctaccagcgagatccagctgacagactacggggcgctcacccttgattgttctccaagaactggactggacttcaacgaaatggtgttgctaacaatgaaagagaagtcctggctggtacataaacagtggtttctcgatctgccgcttccctggacgtcaggcgccagcaccagtcaagagacttggaataggcaggacctgttggttacattcaagaccgcacacgctaagaaacaggaagtggtcgtgctcggttctcaagagggggccatgcacacagctctgactggcgccaccgaaatccagacgtccggaaccacaactatttttgcaggccatttaaagtgccggctgaaaatggataagctaaccctcaaagggatgagctatgtcatgtgtacaggatcgttcaagctggagaaggaagtggccgagactcagcacggtaccgttcttgtgcagataaaatacgagggcacggacgctccttgcaagatcccattctctacacaagatgaaaaaggggtaacccagaacggacgtttgattactgcgaatcccatcgtcacagacaaggagaaacctgtgaacatagaagcagagccaccctttggcgagtcctatattgttatcggtgccggggaaaaggctctgaagctctcatggttcaaaaagggcagtagcatcggaaaaatgtttgaggccaccgcacgcggcgccagaaggatggctattctgggggatactgcctgggacttcggatccatcggtggcgtgtttacctctgtcgggaagcttgtgcatcagattttcggaacagcatacggcgtactgtttagcggtgtgtcatggacgatgaaaatagggatcggcgttttgctcacctggctgggattaaatagtcggtccactagcctgtctatgacatgtattgcggtcggcctagtgaccctctacctgggggtgatggtccaggctgattcaggatgcgttatcaactggaagggccgagaacttaagtgtggtagtgggatcttcgtgacaaatgaggtgcacacttggaccgaacaatataaatttcaggccgacagcccgaagcgcttgtccgcagccattggaaaagcttgggaggagggcgtatgcggtataagatctgccacgaggctggaaaacatcatgtggcggcagatttcgaacgagctcaatcatatcctgttagaaaacgacatgaagttcacagtcgtggttggcgatgtggtcgggattctggcacagggaaaaaagatgatccgccctcaacccatggagcacaaatacagctggaagtcctggggcaaggctaaaataatcggggccgacgtgcagaataccacttttattatcgatggaccaaacacccctgaatgtcccgacgatcagagagcgtggaatatttgggaggttgaggactatggcttcggtatctttacaactaacatatggcttaagttgagggattcatacacccaggtgtgcgaccaccgtctcatgagtgccgctattaaagattctaaggcagtacatgccgacatggggtattggatcgaaagcgagaaaaatgaaacatggaagctggctcgggcctccttcattgaggtcaagacgtgtatctggccaaaatcacacaccctatggagcaacggagtgctggaatctgagatgataatccccaagatttacggcggtcctatctcccaacataattatcgaccaggctacttcactcagacagcagggccgtggcacctcggaaaactggagcttgattttgacttgtgcgaaggcaccactgtggtcgttgatgagcactgcgggaacagaggacccagtctgaggacaaccacggtgactggcaagattatccatgaatggtgttgccgcagctgtaccttacctccactccggttcaaaggtgaggacgggtgctggtacggaatggagataagacccgtaaaggaaaaggaggaaaatctggtgaaatctatggtctccgcgggctcaggtgaggtggacagttttagccttggcctgttgtgtatttcgatcatgatcgaagaggttatgaggtcccgctggtctcgaaagatgctcatgacagggaccctggccgtgttctttctactgattatgggacagctcacttggaacgatctgatccggagctgcattatggtcggcgctaatgcctcagaccgtatggggatgggaacaacctatcttgcattgatggctacattcaaaatgagacctatgtttgccgtgggcctgttattcaggcgcctcactagtcgggaggttctgcttctgaccataggtctatccctcgtggcatctgtcgaactgccaaacagcttggaggaactgggggatggattagccatgggcatcatgattctcaagctgcttacggactttcaatcctaccagctgtgggctacattgctctcactgaccttcatcaaaactacctttagcctacactatgcgtggaagacaatggccatggtactgagtattgtgtctcttctccccctgtgtttgtccactaccagccagaagacgacatggctgccggttttactcggctcgctggggtgcaaacctcttaccatgttcctgatcgcagagaataagatatggggaagaaaatcatggccattgaacgaaggtatcatggctgtgggcattgtctctatcctcctgagttccctactgaagaacgatgtgccccttgccgggcctctcattgccggaggcatgctgatcgcttgttacgtaataagcggttctagcgcagacttgtccttagagaaagccgcggaggtgtcatgggaagaggaagctgagcatagtggggccagccacaatattctggtcgaagttcaggatgacggaactatgaagatcaaagatgaggagagggacgatacactcaccatcctgcttaaggcaactctgttggccgtgtctggcgtgtatcccctatccattccagctacactgtttgtctggtacttctggcaaaagaaaaagcagcgatcaggcgtgctctgggacacccctagtcccccagaagttgagcgcgcagtactggatgacgggatatatcggatcatgcagagaggacttttaggtaggagccaggtgggcgtcggggtgttccaagaaaacgtttttcatacgatgtggcacgtgactcgtggagccgtcctgatgtaccagggcaaacgcctcgagccgtcctgggcgtctgtgaagaaagacttgatttcgtacggtgggggatggcggctgcagggcagctggaataccggcgaggaagtacaggtcatcgctgtggagcctgggaagaaccccaagaatgttcaaacagccccaggaaccttcaaaacacccgaaggtgaggtgggcgcaattgccctcgattttaagcctgggacttcaggatccccaatcgtcaacagagaaggcaaaatagtgggtctgtatgggaatggagttgtgaccacgagtggcacatacgtctctgctatcgcccaggcaaaggctagccaggagggcccccttcctgagattgaagacgaggtgttcaggaaacgaaacctgactatcatggatttgcacccggggtccggaaagacccggcgctatctaccagccattgtaagagaagcgatcaagaggaaactgcggacactcatattagcccccacccgagtggttgcatcagagatggctgaagccctgaagggtatgcctattagataccaaactaccgctgtcaaatctgagcatacaggccgcgagatcgtggaccttatgtgccacgcaacgtttactatgaggctgctcagcccagtgcgtgtccccaattataacatgatcattatggatgaagcccatttcaccgaccctagttccatcgccgctcgggggtacataagcacaagagtaggaatgggcgaggcggcagccatttttatgaccgctactccgcccggttctgtggaagccttcccacagtcaaatgcagttatccaggatgaggaaagggacattcctgagcgctcctggaacagtgggtatgagtggatcacagattttcccggaaagaccgtgtggttcgtcccaagcataaaatcgggcaatgacattgccaactgtttgcgaaagaatggcaagagagtgatccagctgtctcggaaaacgtttgatactgaataccaaaagacaaaaaacaacgactgggactacgttgtgaccaccgatatctccgagatgggggctaatttcagggcggaccgcgtcattgatcctcgtagatgcctcaagcccgtgatcctgaaagacggaccagaacgggtaattcttgccggtccgatgcctgtgactgttgcaagcgctgcccagaggcgcggccgaatagggagaaaccacaataaggagggagatcagtatatctacatgggccagcccctaaacaatgacgaggatcatgcacactggacagaagccaagatgctgttggacaacattaataccccagagggtatcatccccgctttattcgaacctgagcgggaaaaatcagccgcgattgatggggagtataggctgcgcggcgaggcaagaaagacatttgtcgaactcatgaggcggggagacctgccagtgtggcttagttacaaagtggcctctgagggcttccaatattccgatcgtcgctggtgctttgacggggaacgaaacaatcaggtcctggaggaaaacatggatgttgagatatggactaaggagggagaaagaaaaaagctcaggccccggtggttggacgctcgcacgtacagcgaccctctggccctaagagagttcaaagaatttgctgcaggtaggcggtcagtgagtggcgatctgatcctcgagattgggaagcttccgcagcacctgacccagcgagcccaaaatgctttagacaacttggtaatgctgcataatagcgaacagggaggcagagcctatcgccacgcaatggaggagctcccagatacaatcgaaactctgatgcttctggcgctcattgccgtgttgaccggtggggtcacactgttctttttatccggcaggggactaggcaagacctctatcgggctgctctgtgtgatggctagctccgcccttctgtggatggcatcagttgagccccattggatagctgcctctatcattttggaattctttctgatggtgctcctgatccctgagcccgaccggcagcgtactccacaggataaccaacttgcatacgtcgtaattggactcctgttcatgatcttgacggtggccgctaatgagatgggtctgttagaaaccacaaaaaaggacctaggcatagggcacgcggccgttgagaaccaccatcacgcaactatgctggatgtggacctccatcctgctagtgcctggaccctttacgccgtcgcaacaaccattatcactcccatgatgagacacacaattgaaaacacgaccgctaatatctcgctgactgccatagcgaaccaggctgccatcttgatgggactggataaaggctggccaattagcaagatggacatcggtgtgcctctcctggcacttgggtgctattcccaggtcaatccgttaacactgaccgccgctgtgctcatgttggttgcacattacgccattatcggccccggactgcaagcgaaagctaccagggaggcccagaagcgcacagcagccggcataatgaagaacccaactgtggatgggattgtagctatcgacctagatcctgtggtctatgacgccaaatttgaaaagcagctgggacagatcatgctccttattctgtgtacgtctcaaatcttgctgatgcggaccacatgggcactctgcgagtcaataactctggctaccggccccttaacaaccctttgggagggtagcccagggaaattctggaatactacgattgccgtttccatggcgaacatctttcgaggaagttacctggccggcgcaggtctcgctttctctctaatgaagagcctgggcgggggaagaaggggcacaggggcccagggagaaaccttgggcgagaaatggaagcgccagctgaatcagctctcaaagtccgaattcaacacttataaacggagtggtattatggaggtggacagaagcgaagcaaaggaggggcttcgtaggggagagaccacaaaacacgctgtctctcggggcactgccaagctgcgctggtttgtggaacgaaatttggtaaaacctgagggtaaggtgatcgatctgggctgtgggagaggaggctggtcctactattgcgccgggctcaagaaagttaccgaagtgaagggatacacaaaaggcggtcccgggcacgaggaaccgataccaatggcgacgtacggatggaacttagtcaagctgcattcaggcaaagacgtgttctttatccctcccgagaagtgtgatacccttctgtgcgacattggcgagagctcgccaaatcccactatcgaagaggggaggacactacgggtcctcaaaatggtggaaccttggctgcgcggaaaccaattctgtattaagatcttgaatccgtatatgccctctgttgtagagaccctggagcagatgcagagaaagcacggtggcatgctcgtgaggaacccacttagtcgaaattccactcatgaaatgtactgggtcagctgcgggacaggaaacattgtgtcagctgttaatatgacctcccggatgctgttaaaccgttttacgatggcacacagaaaacctacctatgagcgcgatgtggacctgggcgccggtacaaggcacgtcgctgtggaacccgaggtagccaacttggatatcatagggcagcggattgaaaatatcaagcatgagcacaaatctacttggcattacgacgaggataacccttataagacctgggcataccacggaagctatgaagtgaaaccaagtggctccgccagctctatggttaatggcgtcgtgaagctcctgacaaagccctgggacgtgatccctatggtcactcaaattgctatgaccgatacaaccccattcgggcagcagagagtttttaaagagaaggtggacactcgcacgcccaaagcgaagaggggaacagcccaaataatggaagtaaccgcacgatggctatggggtttcctttcacggaacaaaaagccgagaatctgtactagggaggaatttacccgcaaggtgcgtagtaatgctgccattggcgcagtcttcgtggacgagaaccagtggaattccgccaaagaggctgttgaagatgagcggttttgggacctggtgcatagagaaagggagctccacaagcaggggaaatgcgccacatgcgtctacaacatgatgggaaagcgcgaaaaaaagctgggcgagttcggtaaggcgaaagggagccgagcaatctggtacatgtggttgggagcccggtttctggagttcgaagctctcggcttcatgaatgaggatcactggttttctagagaaaactcgctttcaggcgtggagggggagggactgcataagttaggttatattctgagggacatcagcaaaatacctggcgggaatatgtacgccgatgacacggcaggatgggatacccgcatcactgaagacgatttgcagaacgaggctaagattacagacatcatggaaccagagcacgccctcctggctacctccattttcaaactaacttatcaaaataaggtagttagagtgcagcggcccgccaggaacggcacagtcatggatgtgatcagtcgtcgagaccagcgcggttctgggcaggtgggaacctacggccttaatacatttactaacatggaagcacaactgataagacagatggagagcgagggcattttctccccttcagaactcgagaccccaaacctggcggaacgggtcttggattggttagagaaacatggggttgaaaggctgaagcgcatggccatcagtggagacgactgtgtggtaaagcccatcgatgacagatttgctacggccctctctgcacttaatgatatgggtaaagtgcggaaggacattccgcagtgggagcctagcaaaggctggaacgattggcagcaagtccccttctgctcccaccactttcatcagctgataatgaaggacgggagggagatcgtggttccatgtcgaaatcaggatgaactagtgggacgtgctagagtctcacagggcgccggttggagcctgcgcgagaccgcatgcctcgggaaatcttatgcccaaatgtggcagttgatgtacttccaccggagggacctgagacttgcggctaacgccatttgttccgcagtgcctgtagattgggttcccacaagtcgcactacctggagcatccatgcccaccatcagtggatgacaactgaagacatgctgtcggtgtggaatcgggtctggattgaggaaaacccatggatggaggataagacccacatctcctcttggggagacgtgccctatctcggcaagagggaggaccaatggtgcggctcattaatagggctgacggctcgagccacatgggcaaccaatatccaggttgctattaaccaggtgagacggttgatcggaaatgaaaactacctggattacatgactagcatgaaaaggtttaagaatgagagtgaccctgaaggtgccctctggtga

SEQ ID NO: 13846 - RNA, 9879 nt, synthetic construct
  misc_feature 1..9879: note = derived and/or modified CDS sequence (opt3) from DENV-1__GQ199844__SS-prME
  source 1..9879: mol_type = other RNA
agcgtgaccatgctgctcatgcttatgcccacagcactggctttccacttgactacgagaggaggggagcctcatatgatcgtcaccaagcaggaaaggggaaaatccttactgtttaagacatctgccggtgttaatatgtgcactctaattgccatggacctcggcgagctgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccactatggcaaaggataaacccacactggacatcgaactactcaagaccgaggtgacgaaccctgccgtgctgaggaaactttgcattgaagctaagatctccaataccacaactgattctcggtgtccaacccaaggagaggccacactgatggaagaacaagacgcaaacttcgtctgccgccgaacttttgttgatagaggctggggtaatgggtgtggattgttcggcaaaggcagcctcataacctgcgctaagtttaagtgcgtgacaaaactggaggggaagattgtacagtacgaaaacttaaaatattccgtgatcgtcaccgtgcacactggagaccagcatcaagttggtaatgagtcaacggaacacggcacaattgccaccatcactccccaggcgcctaccagtgagatccagctgacagactacggggccctcacccttgattgtagcccaaggactggactggacttcaacgaaatggtgttgctaacaatgaaggagaaatcttggctggtccataagcagtggtttctcgatctgccgcttccctggacgtccggcgcatcaaccagccaagagacttggaatcggcaggacctgttggtgacattcaaaaccgctcacgccaagaagcaggaagtagttgtgctcggtagtcaagagggggctatgcacacagccctgactggcgcaaccgaaattcagacgtctggaaccacaactatatttgccggccatttaaaatgccgtctgaagatggataaactaaccctcaaggggatgtcctatgtcatgtgtacaggtagcttcaaactggagaaggaagtggctgagactcagcacggaaccgtccttgtgcagatcaagtacgagggcacggacgcgccttgcaaaattccattctcgacacaagatgaaaagggggttacccagaacggacgcttgatcactgcaaatcccatagtgacagacaaagagaagcctgtaaacattgaagccgagccaccctttggcgagtcttatatcgtcatcggtgctggggaaaaagccctgaagctctcctggttcaagaaaggctcaagtattggaaagatgtttgaggcaaccgccagaggcgctaggcggatggccatcctgggggatactgcatgggacttcggaagcgtgggtggcgtttttacctccgtggggaaacttgtccatcagattttcggaacagcgtacggcgtgctgttttctggtgtaagctggacgatgaagatagggatcggcgtgttgctcacctggctgggattaaattcacgaagtacttccctgagcatgacatgtattgctgttggcctagtcaccctctacctgggggtgatggtgcaggccgattctggatgcgtcatcaactggaaaggccgcgaacttaagtgtggttcagggatcttcgttacaaatgaggtgcacacttggaccgaacaatataagtttcaggcagacagtccgaaaagattgagcgccgctattggaaaggcctgggaggagggcgtgtgcggtataaggtccgcaacgcggctggaaaacatcatgtggaaacagatttctaacgagctcaatcatatcctgttagaaaacgacatgaagttcacagtagtcgtgggcgatgttgtggggattctggctcagggcaaaaagatgatccgccctcaacccatggagcacaaatactcgtggaaaagctggggcaaggccaagataatcggggcggacgtccagaataccacttttattatcgatggaccaaacacccctgaatgtcccgacgatcagagagcctggaatatttgggaggtggaggactatggcttcggtatctttacaactaacatatggcttaagttgagggattcctacacccaggtttgcgaccaccgtctcatgtcagctgcaattaaagatagtaaggccgtgcatgctgacatggggtattggatcgaatctgagaaaaatgaaacatggaagctggcccgggcatccttcattgaggtaaagacgtgtatctggccaaaatcccacaccctatggtcaaacggagtcctggaaagcgagatgataatccccaagatttacggcggtcctatctctcaacataattatcgaccaggctacttcactcagacagcggggccgtggcacctcggaaaactggagcttgattttgacttgtgcgaaggcaccactgtggtggtcgatgagcactgcgggaacagaggaccctccctgaggacaaccacggttactggcaagattatccatgaatggtgttgccgcagttgtaccttacctccactccggttcaaaggtgaggacgggtgctggtacggaatggagataagacccgtgaaggaaaaggaggaaaatctggtaaaaagcatggtgtctgccggctccggtgaggtcgactcatttagtcttggcctgttgtgtattagcatcatgatcgaagaggtgatgaggtcgcgctggtcccgaaagatgctcatgacagggaccctggctgttttcctactgctcattatgggacagctgacttggaacgatcttatccggttgtgcattatggtgggcgccaatgcatctgaccgtatggggatgggaacaacctatctggctttaatggccacatttaaaatgagacctatgttcgcagtcggcctcctgtttaggcgccttactagccgggaggtgctgctactcaccataggtctgtcattggttgccagtgtggaactgccaaactccttagaggaactcggggatggactggctatgggcatcatgattcttaagctgttgacggacttccaatctcaccagctctgggcgacactgctaagcctgacctttatcaaaactaccctttccctccattacgcctggaagacaatggcaatggtcctgtcaattgctagcttgttccccctgtgtttaagtactacctctcagaagacgacatggctcccggtactgcttggctccctggggtgcaaacctttgaccatgtttctcatcactgagacaaagatatggggaagaaaaagctggccactgaatgaaggtatcatggccgtgggcgttgtgtcgattctactgtcatctcttctcaagaacgatgtccccctggccgggcctttgatcgctggaggcatgttaattgcatgttatgtgatcagtggttccagcgccgacctgtctctcgagaaagcggctgaggtaagctgggaagaggaagccgagcactccggggcatcacataacatactggtggtcgttcaggatgacggaaccatgaagattaaagatgaagagagggacgatactcttacaatcctgttgaaggccaccctactggctgtgagtggcgtgtaccccctcagcatcccagcaacgctgttcgtctggtatttttggcaaaagaaaaagcagcgatctggcgtgctttgggacactccttcacccccagaggttgaacgcgccgtattagatgacgggatttaccggataatgcagagaggactgctcggtaggagccaggtgggcgtcggggtgttccaagagaatgttttccacaccatgtggcacgtgacacgtggagcggtcttgatgtatcagggcaaacgcctggaaccgagttgggctagcgtgaagaaagacctcatctcctacggtgggggatggcggctgcagggctcttggaacaccggcgaggaggtacaggtcattgccgtggaacctgggaagaatcccaagaacgttcaaacagcaccaggaacttttaaaacccccgagggtgaagtgggcgccatcgctcttgatttcaagcctgggacgtcgggaagcccaattgtcaatagagagggcaaaatcgtgggtctgtacgggaacggagttgtgacaacttcaggcacctatgtctccgccatagcacaggctaaggccagtcaggaaggccccttgcctgagatcgaggacgaagtgtttaggaaacgaaatctaacaattatggatctgcatccggggtctggaaagacccggcgctacctcccagcgatcgtaagagaggccattaagaggaaattacggactctgatccttgcacccacccgagtggttgctagcgaaatggccgaggctctgaagggtatgcctataagatatcaaacaacggcagtcaaatccgaacacactggcaaggagattgtggacctcatgtgccatgccaccttcacaatgcgcttgctgtcaccagtgagggtccccaactacaatatgatcatcatggatgaggcccactttaccgacccttctagcattgctgcgcgtgggtatatcagtactcgggtaggaatgggcgaagcagccgctatattcatgacagccaccccgcccggttccgtggaggcatttccacagagcaacgccgttattcaggatgaagagagagacatccctgaaaggtcttggaactcagggtacgagtggattacggatttccccggaaaaactgtgtggtttgtcccatccatcaagagtggcaacgacatagctaattgtctccgcaagaacggcaaacgagtgattcagctgagcagaaagacattcgataccgagtatcagaaaaccaagaataacgactgggactacgttgtgactacagatatctcggaaatgggggcgaactttcgggccgacagggtcatcgatcctcgccgttgccttaaacccgtgattctaaaggacggaccagagagagtaatcctggcaggtccgatgcctgtgaccgttgcttctgccgcacagcggaggggccgcattgggcgaaatcataacaaggaaggagatcagtacatatatatgggccagcccttgaataacgacgaggatcacgcccactggacagaggctaaaatgttactggacaatatcaacactccagaaggtattatccccgccctcttcgagcctgaaagagagaagtccgcggcaatcgatggggaataccggctgaggggcgaggcccgcaaaacgttcgtcgagcttatgagaaggggagacctgccagtgtggctcagctataaggtggcttcagaaggctttcaatacagtgatcggcgttggtgcttcgacggggagcgcaataaccaggtcttggaagagaatatggatgttgaaatttggaccaaagagggagagcgaaagaaactgagacccaggtggctagacgcccggacatattctgaccctctggctctccgcgaatttaaggagttcgcagccggtagaaggtccgtgagcggcgatcttatactggaaatcgggaagttaccgcagcatttgactcagcgggctcaaaacgccctggacaatctcgtaatgctgcacaactcagagcagggaggccgagcatacagacatgcgatggaggaacttccagataccattgagacactgatgctcttggccctgatcgctgtgttaaccggtggggtcactctatttttcctgagtggccgcggactcggcaaaacgagcattgggcttctgtgtgtgatggcctcctctgttttgctgtggatggcaagcgtggaaccccactggatcgctgcctccataatcctcgagtttttcctgatggtccttctcattcctgaacccgacaggcagcggaccccacaggataatcaactggcatatgtagtgatcggattgctgtttatgattttaacagttgccgctaacgagatgggtctactggagactaccaagaaagacctcggcatcgggcacgtggcggtcgaaaatcatcaccatgccacaatgcttgatgtggacctgcaccctgcatcagcttggaccttgtacgccgtcgccactacaataattacgcccatgatgcgtcataccatcgagaacactacagcaaacatttctctgaccgctatcgccaatcaggcggctatactcatgggactggataagggctggccaatcagtaaaatggacattggtgtgcctcttttagccctggggtgctactcgcaggttaacccgctcaccttgacagcagccgtgctgatgctagtagctcactatgcaatcattggccccggactgcaagccaaggcgactagagaagctcagaagaggacggccgcaggcatcatgaaaaatccaaccgtggatgggatagtcgccattgacctcgatcctgttgtgtacgacgctaagttcgagaaacagcttggacagatcatgctgttgatcctgtgtacaagccaaattctcctgatgcgcactacctgggccttatgcgaatccatcacacttgcaaccggccccctgactacgctctgggagggttctccagggaagttttggaacacaaccatagctgtctcaatggccaatattttccggggaagctatctagcgggcgccggtctggcattttccttgatgaaaagtctgggcgggggacgaagaggcactggggctcagggagagaccctcggcgaaaagtggaagaggcagcttaaccagctgtctaaaagcgagttcaatatctacaagcgctcaggtattatggaagtggaccggtccgaggccaaagaagggttgaagagaggagagacaactcgtcacgcagtaagtaggggcaccgctaaactgcggtggttcgtggagcgcaacctcgttaagcctgaaggtaaggtgatcgatttaggctgtgggcgaggaggctggagctattactgcgccgggctgaaaaaggtcacagaggtgaaaggatatacgaagggcggtcccgggcatgaggagccgataccaatggccacctacggatggaatcttgtcaaactgcactctggcaaggacgtgtttttcactcctcccgaaaaatgtgatacactactctgcgacatcggcgagtcctcaccaaaccccaccattgaggaagggagaactctgagggttttgaagatggtagagccttggctgcggggaaatcaattttgtatcaagattctcaacccgtacatgcccagcgtggtcgaaacacttgagcagatgcagcgcaaacatggtggcatgctggtgagaaatccattatcgaggaactctacccacgagatgtattgggttagttgcgggacgggaaatatcgtgtccgcggtcaacatgaccagccgaatgctgttgaatcggttcacaatggctcaccgtaagcctacttacgaaagagatgtggacctcggcgcaggtacccgccatgtagccgtggagcccgaagttgctaacctggatattatcgggcagaggatagagaacattaaacacgaacataagtcaacatggcactatgacgaggataatccttacaaaacttgggcctatcatggatcctacgaggtcaagccatctggcagcgcaagttccatggtgaacggcgtggtcaagctacttaccaaaccctgggacgttatccctatggtgacacaaatcgccatgaccgatactacgccatttgggcagcagcgggtattcaaggaaaaagtggacacaagaacccccaaggctaaacgcggaactgcgcaaattatggaggtcaccgccaggtggctgtggggttttctcagccgaaataagaagccgcggatatgtacaagagaagagttcacgaggaaagtgcgctctaacgcagctatcggcgccgtttttgtggacgaaaatcagtggaactcagcaaaggaggccgtcgaggatgaacgtttctgggacctggtgcagaaagagcgggaattgcacaagcaggggaaatgcgctacctgcgtatataatatgatgggaaagagagagaagaaactgggcgaatttggtaaggccaaagggagtagggcgatttggtacatgtggctcggagcacgcttccttgagtttgaggccctgggcttcatgaacgaagatcactggttctcccgagagaatagcttatctggcgttgaaggggagggactgcataagttgggttacatcctccgggacatttcgaaaatccctggcgggaacatgtatgctgatgacactgccggatgggatacaagaataaccgaggacgatctgcaaaatgaagcaaagatcactgacattatggagccagaacacgctctacttgccacatcaatctttaaactgacctaccagaacaaggtggtcagggtgcagcgccccgctaagaatggcacagtgatggatgtcattagcagacgggaccagaggggttccgggcaagttggaacttatggcctcaacaccttcacgaatatggaggcccagctgatccgtcagatggaaagtgagggcatatttttgccttctgagttagaaaccccaaacctggcagagcgagtgctcgattggcttgaaaaatacggggtagagcgcctgaagagaatggcgattagcggagacgactgtgtggtcaaacccatcgatgaccggttcgccacagctctaactgccctgaacgatatgggtaaggtgaggaaagacatcccgcagtgggaaccttccaagggctggaatgattggcaacaggttcccttttgctcacatcacttccaccagctcattatgaaggacgggcgcgagatagtggtcccatgtagaaaccaggatgagttggtgggacgggcaagggtaagtcaaggcgctggttggtctctgcgagaaaccgcctgccttgggaaaagctatgcacagatgtggcagctgatgtactttcatcgtagagacctccgcttagccgcgaatgctatctgttccgccgttcctgtggattgggtccccacatcacggactacctggagcattcacgcacatcaccaatggatgacgacagaggacatgctgtctgtgtggaacagggtttggatcgaagagaatccatggatggaagataagacccatgtgtccagttggggagacgtcccctatttgggcaaaagagaggaccagtggtgcggcagcctgattgggctcactgcccgcgctacatgggcctcgaacatccaggtggcaataaatcaggtacggaggcttatcggaaacgagaattacctggattacatgacctccatgaagcgattcaaaaacgaaggtgaccctgagggcgctctatggtga

SEQ ID NO: 13847 - RNA, 9879 nt, synthetic construct
  misc_feature 1..9879: note = derived and/or modified CDS sequence (opt3) from DENV-1__GQ199845__SS-prME
  source 1..9879: mol_type = other RNA
tccgtgaccatgctgctcatgcttatgcccacagcactggctttccacttgactacgagaggaggggaacctcatatgatcgtctccaagcaggaaagggggaaatctttactgtttaagacctcagccggtgttaacatgtgcacactaattgccatggacctcggcgagttctgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggccttggtctggagactagaaccgaaacatggatgtcctctgagggggcctggaaacagatccagagggtggaaacttgggctttgcggcaccctggatttaccgttattgcactcttcctggcccatgctatcggcacatcgattacccagaagggcatcatatttatcctgctcatgttagtgacgccatcaatggccatgcgctgcgtcgggattggaagcagagatttcgtggagggtctgagtggcgcgacttgggtagacgttgtgcttgagcacgggtcctgtgtcacaaccatggcaaaggataaacccactttggacatcgaactgctaaagacagaggtgaccaaccctgccgtgctcaggaaactgtgcattgaagctaagatctctaatacgaccacagatagccggtgtccaactcaaggagaggccacccttgtcgaagaacaagacgcaaactttgtttgccgccgaacattcgtggatagaggctggggtaatgggtgtggactgtttggcaaaggctccttgataacttgcgctaagttcaagtgcgtaaccaaactcgaggggaagattgtgcagtacgaaaacctgaaatattcagtcatcgtgacagttcacaccggagaccagcatcaagtgggtaatgagagtactgaacacggcacgacagccaccattactccccaggcgcctagcaccgagatccagttaacagactacggggccctgaccctcgattgttctccaaggactggacttgactttaacgaaatggtcctgttgacaatgaaggagaaatcctggctagtgcataagcagtggttcctggatctcccgctgccctggacgtcaggcgcaagcaccagtcaagagacttggaatcggcaggaccttctggtaacatttaaaaccgctcacgccaagaagcaggaagttgtggtcttgggttctcaagagggggctatgcacacagccctcactggcgcaaccgaaatccagacgtccggaaccacaactattttcgccggccatctgaaatgccgtttaaagatggataaactgaccctaaaggggatgagctatgtgatgtgtacaggatcgttcaaactcgagaaggaagtcgctgagactcagcacggtaccgtgctggttcagataaagtacgagggcacggacgcgccttgcaaaatcccattttctacacaagatgaaaagggggtgacccagaacggacgccttattactgcaaatcccatcgtaacagacaaagagaagcctgtcaacatagaagccgagccacccttcggcgagtcctatattgtgatcggtgctggggaaaaagccttgaagctgtcatggtttaagaaaggcagtagcatcggaaagatgttcgaggcaaccgccagaggcgctaggcggatggccattctcggggatactgcatgggactttggatccatcggtggcatgttcacctctgttgggaaactggtgcatcagatttttggaacagcgtacggcgtccttttcagcggtgtgtcatggacgatgaagatagggatcggcgtactgttgacctggctcggactgaatagtcgatccactagcttatctatgacatgtattgctgtgggcctggttaccctatacctcggggtcatggtgcaggccgattcaggatgcgtgatcaactggaaaggccgcgaactgaagtgtggtagtgggatctttgtcacaaatgaggttcacacttggaccgaacaatataagttccaggcagacagcccgaaaagactttccgccgctattggaaaggcctgggaggagggcgtgtgcggtataaggtctgcaacgcggttggaaaacatcatgtggaaacagatttcgaacgagctgaatcatatcctcctggaaaacgacatgaagttaacagtggtagtcggcgatgtggctgggattctggcccagggcaagaagatgatccgccctcaacccatggagtacaaatatagctggaagatatggggcaaggcgaaaatcattggggccgacgttcagaataccacttttatcattgatggaccaaacacccctgaatgtcccgacgatcagagagcttggaatatctgggaggtggaggactacggcttcggtatatttacaactaacatttggcttaagttgagggattcctatacccaggtctgcgaccaccgtctcatgtcagcagccatcaaagatagtaaggctgtgcacgccgacatggggtactggattgaatctgagaaaaatgaaacatggaagctggcacgggcgagcttcatcgaggttaagacgtgtatatggccaaaatcccataccctatggtcaaacggagtgctggaaagcgagatgatcattcccaagatctatggcggtcctatttctcaacacaattaccgaccaggctacttcactcagacagccgggccgtggcatctcggaaaactggagcttgattttgacttgtgcgaaggcaccactgtagtcgtggatgagcactgcgggaacagaggaccctccctgaggacaaccacggtgactggcaagatcatacacgaatggtgttgccgcagttgtaccttacctccactccggttcaaaggtgaggacgggtgctggtatggaatggagattagacccgtcaaggaaaaggaggaaaatctggttaaaagcatggtgtctgctggctccggtgaggtagactcatttagtcttggcctgttgtgtatcagcatcatgattgaagaggtgatgaggtcgcgctggtcccgaaagatgctcatgacagggaccctggccgtcttctttctactgatcatgggacagctcacttggaacgatctgattcggctttgcataatggtgggcgcaaatgcttctgaccgtatggggatgggaacaacctacttggccctgatggcaacattcaaaatgagacctatgtttgccgttggcttactcttcaggcgcctgactagccgggaggtgcttctgctaaccatcggtctctcactggtcgctagtgtggaattgccaaactccctggaggaattaggggatggactcgcgatgggcattatgatcctgaaacttctgacggactttcaatctcatcagttgtgggccacactcctgagcctaaccttcattagaactaccttttccctgcactatgcatggaaaacaatggctatggttctttcaatcgtgagcctcttccccctgtgtttgagtactacctctcagaagacgacatggctgccggtcttactcggctccctggggtgcaagcctcttaccatgtttctgatagccgagaataaaatctggggaagaaagagctggccattgaacgaaggtattatggccgtaggcatcgtgtcgattctcctgtcatctctactgaaaaacgatgttccccttgctgggcctctcatcgcaggaggcatgctgatagcctgttacgtgattagtggttccagcgcggacttgtctttagagaaggctgccgaggtcagctgggaagaggaagcagagcattccggggcctcacacaatatcctggtggaagtacaggatgacggaactatgaaaatcaaggatgaggagcgagacgatacactcaccattctgcttaaagctactctgttggcagtgagtggcgtctatcccctaagcataccagccacactgttcgtttggtacttctggcaaaagaagaaacagcgctctggcgtgctctgggacaccccttcacccccagaagtggagcgggcggtcctggatgacgggatctatagaattatgcagaggggacttttaggtcgtagccaggtgggcgttggggtatttcaagaaaacgtgttccatacgatgtggcacgtcactcgcggagctgtgctgatgtaccagggcaagcggctcgagccgagttgggccagcgttaaaaaggacttgatctcctacggtgggggatggagactgcagggctcttggaataccggcgaggaagtgcaggtcattgcagtggagcctgggaaaaaccccaagaatgtacaaacagccccaggaacctttaagacatcggaaggtgaggtcggcgctatcgccctcgatttcaaacccgggactagcggatcacctatagtgaacagggaaggcaagatcgttggtctgtatgggaatggagtggtcaccacgtccggcacatacgtgagtgcaattgctcaggccaaagcgtctcaggagggcccacttcccgagatcgaagacgaggtttttcgaaagcggaacctgactattatggatttgcaccctgggagcggaaaaacccgcagatatctaccggccatcgtgagggaagcaacaaagcggcgactgagaaccctcatattagctccaactcgcgtcgtggcctccgagatggctgaagcactgaagggtatgcccattaggtaccaaaccacagccgtaaaatcagagcatacgggcaaggagatcgtggaccttatgtgccacgccactttcaccatgcgtctgctctctcctgttcgggtcccaaattataacatgatcattatggatgaagctcattttacagaccccagcagtatcgcggcaagagggtacatatccaccagggtgggaatgggcgaggccgctgccattttcatgactgcaacacctccgggtagcgtggaagcctttccccagtctaatgctgtcatccaggatgaggaacgcgacattccagagcgatcatggaactccgggtatgagtggatcaccgatttccctggaaaaacggtatggtttgtgcccagtataaagagcggcaatgacattgcgaactgtttgaggaaaaatggcaagcgggttatccagctgtcgaggaagactttcgatacagaataccagaaaaccaagaacaacgactgggactacgtggtcaccactgatatctctgagatgggggccaatttccgcgcagaccgtgtgattgatccaagacggtgcctcaaacctgttatcctgaaggacggacccgaaagggtgattcttgctggtccaatgccggtcacagtggcctccgcagcccagcgccgaggcagaatagggcggaaccacaataaagagggagatcagtatatctacatgggccagcctctaaacaatgacgaggatcatgctcactggaccgaagccaagatgctgttggacaacattaatacacccgagggtatcatcccagcgttatttgaacccgagagggaaaagagcgcagccattgatggggagtatcgcctgagaggcgaggctaggaaaactttcgtagaactcatgcggcgtggagacctgcctgtgtggctttcatacaaggttgccagtgagggctttcaatattctgatcgccgatggtgcttcgacggggaaagaaacaatcaggtcctggaggaaaacatggatgtggagatatggacgaaagagggagaaaggaagaaactccggccacgctggttggacgctagaacctactccgaccccctggcactaagggagtttaaggagttcgccgctggtcggcgaagcgtgtcaggcgatctgatcctcgagattgggaaacttcctcagcacctgacacagagagcccaaaatgcattagacaacttggtcatgctgcataatagtgaacagggaggccgcgcgtataggcacgccatggaggagctcccggatactatcgaaaccctgatgcttctggctctcattgccgttttgacaggtggggtgaccctgtttttcttaagcggccggggactaggcaagacttccatcgggctgctctgtgtaatggcatctagcgtgcttctgtggatggcttccgtcgagccacattggatagccgcatcaatcattttggaatttttcctgatggtgctcctgatccccgagcctgaccgtcagagaacgccccaggataaccaacttgcctacgttgtgattggactcctgtttatgatcttgaccgtcgctgcgaatgagatgggtctgttagaaacaactaagaaagacctaggcatagggcacgtagccgtggagaaccaccatcacgcagctatgctggatgttgacctccatccagcctctgcctggaccctttacgcagtggctacaaccattatcactcctatgatgaggcacacaattgaaaacacgaccgccaatatcagtctgactgcgatagctaaccaggccgcaatcttgatgggactggataagggctggcccatttcgaaaatggacatcggtgtcccactcctggcccttgggtgctatagccaggtgaatcctttaacactgaccgctgcagtcctcatgttggtggcccattacgcgattatcggcccgggactgcaagctaaggccacccgcgaggcacagaaacggacagccgctggcataatgaagaaccccactgttgatgggattgtggccatcgacctagatccagtagtgtatgacgcaaagttcgaaaaacagctgggacagatcatgctccttattctgtgtacgtcccaaatcttgctgatgcgaaccacatgggctctctgcgagtctataactctggccaccggccctttaacaaccctttgggagggttcacccgggaagttttggaatactacgattgcggtcagcatggccaacatcttcagaggatcctacctggcaggcgctggtctcgccttcagtctaatgaaatctctgggcgggggaaggcgcggcacaggggcacagggagaaaccttgggcgagaagtggaaacggcagctgaatcagctcagcaagtcagaatttaacacttataagagatccggtattatggaggttgaccgtagtgaagctaaagaggggcttaagaggggagagaccacaaaacacgccgtgagccggggcactgccaagctgcgctggttcgtcgaacgaaatttggtgaaaccagagggtaaggtaatcgatctgggctgtgggagaggaggctggtcttactattgcgcggggctcaagaaagtgaccgaagttaagggatacacaaaaggcggtcctgggcacgaggaacccataccgatggctacgtacggatggaacttagtgaagctgcattccggcaaagacgtctttttcatcccacctgagaagtgtgatacccttctgtgcgacattggcgagtcaagccccaatccaactatcgaagaggggaggacactacgggtgctcaaaatggtcgaaccctggctgcgcggaaaccaattttgtattaagatcttgaatccttatatgccgtcggtggttgagaccctggagcagatgcagagaaagcacggtggcatgctcgtaaggaaccccctttctcgaaatagtactcatgaaatgtactgggtgtcctgcgggacaggaaacattgtcagcgcagtgaatatgacctcacggatgctgttaaaccgtttcacgatggcccacagaaaaccaacctatgagcgcgatgttgacctgggcgctggtacaaggcacgtggccgtcgaacctgaggtggcaaacttggatatcatagggcagcggattgaaaatatcaagcatgagcacaaatccacttggcattacgacgaggataacccctataagacctgggcctaccacggatcttatgaagtaaaacctagcggcagtgcttccagcatggtgaatggcgttgtcaagctcctgacaaagccatgggacgtgatccccatggtgactcaaattgcgatgaccgatacaaccccttttgggcagcagagagtcttcaaagagaaggttgacactcgcacgccaaaagccaagaggggaacagcacaaataatggaagtgaccgctaaatggctatggggttttctttctcgaaacaagaagccccggatctgtactagagaggagttcaccaggaaagtacgctcaaatgccgcaattggcgccgtgtttgtcgacgagaaccagtggaatagtgctaaggaggccgtggaagatgagcgtttctgggacctggttcatcgggaaagagagctccacaaacaggggaagtgcgcgacatgcgtgtacaacatgatgggaaaaagggaaaagaagctgggcgagtttggtaaagcaaaggggtcccgcgccatctggtacatgtggttgggagctcgattcctggagttcgaagccctcggctttatgaatgaggatcactggttcagccgggaaaactctctttcgggcgtcgagggggagggactgcataaattaggttatattctgagagacatctcaaagataccgggcgggaatatgtacgcagatgacacggctggatgggataccaggatcactgaagacgatttgcagaacgaggccaaaattacagacatcatggaacctgagcacgctctcctggccaagagcatttttaaactaacctatcaaaataaggtggtacgcgttcagagaccagcaaagaacggcactgtgatggatgtcatctcccggagggaccagcgtggtagtggacaggtgggaacatacggccttaataccttcacaaacatggaagcgcaactgatacgacagatggagtctgagggcatttttagcccctccgaactcgagactcctaacctggccgggcgcgtgttggattggttagaaaaacatggagtcgagagactgaagcggatggctatctcaggtgacgactgtgttgtgaaaccaatcgatgacaggttcgccaccgcactcacggctcttaatgatatgggcaaggtacgcaaagacattccccagtgggaaccgagtaaggggtggaacgattggcagcaagtgcctttttgctctcaccacttccatcagctgataatgaaggacggaagagagatcgtcgtgccctgtcggaatcaggatgagctagttggcagggcccgagtgagccagggtgcagggtggtccctgcgtgaaaccgcctgcctcggaaaatcatatgcgcaaatgtggcagttgatgtactttcacagacgcgacctgcggcttgctgccaacgcaatttgtagcgccgtcccagtggattgggtacctacatctaggactacctggtccatccatgctcaccatcagtggatgacaactgaggacatgctgagtgtttggaatagagtgtggattgaagagaacccctggatggaagataagacccacgtcagctcgtggggcgacgtgccatatctcggcaaacgcgaggaccaatggtgcgggtccttaatcggactgacggcccgggcaacatgggctaccaatatacaggttgccatcaaccaggtgaggcgattgctgggtaatgagaactacctcgattacatgacttctatgaagagattcaaaaatgaatcagaccccgagggcgcgctttggtga

SEQ ID NO: 13848 - RNA, 9879 nt, synthetic construct
  misc_feature 1..9879: note = derived and/or modified CDS sequence (opt3) from DENV-1__GQ199846__SS-prME
  source 1..9879: mol_type = other RNA
agcgtgaccatgctgctcatgcttatgcccacagcactggctttccacttgactacgagaggcggggagcctcatatgatcgtcaccaagcaggaaaggggaaagtccttactgtttaagacatctgccggtgttaatatgtgcactctaattgccatggacctcggcgagctgtgtgaagataccatgacatacaaatgcccacggataaccgaggcggaaccggacgatgtggactgttggtgcaatgctactgatacatgggtaacctatgggacgtgttcacaaactggagagcaccgccgagacaagcgtagtgtggcccttgcaccccatgtcggcctgggtttggagaccagaacagaaacttggatgagctccgagggggcctggaaacagatccagagggtggaaacctgggctctccggcaccctggattcacagttattgcactgtttctggcccatgctatcggcacctctattacgcagaagggcatcatattcatcctcttaatgctggtgactccatcgatggccatgcgctgcgtcgggattggatcaagagattttgtggagggtcttagcggcgcgacatgggtagacgttgtgttggagcacgggagttgtgtcaccatcatggcaagggataagcccactctggacattgaactactcaaaacagaggtgaccaaccctgccgtgctgcggaaactttgcatcgaagctaaaatatccaatacgaccacagattctcgctgtccaactcaaggagaggccaccctgatggaggaacaggacgcaaacttcgtctgccgaagaacatttgttgataggggctggggtaatgggtgtggattgttcggcaagggcagcctcattacttgcgctaaatttaagtgcgtgaccaagctggaggggaaaatcgtacagtacgaaaacttaaagtattccgtgattgtcacagtgcacaccggagaccagcatcaagttggtaatgagtcaactgaacacggcacgacagccaccatcactccccaggcgcctaccagtgagatccagctgacagactacggggccctcacccttgattgtagcccacggactggactggacttcaacgaaatggtgttgctaacaatgaaagagaagtcttggctggtccataaacagtggtttctcgatctgccgcttccctggacgtccggcgcatcaaccagccaagagacttggaatcgtcaggacctgttggtgacattcaagaccgctcacgccaaaaagcaggaagtagttgtgctcggtagtcaagagggggctatgcacacagccctgactggcgcaaccgaaattcagacgtctggaaccacaactatatttgccggccatttaaagtgccgcctgaaaatggataagctaaccctcaaagggatgtcctatgtcatgtgtacagggagcttcaagctggagaaagaagtggctgagactcagcacggtaccgtccttgtgcagatcaagtacgagggcacggacgcgccttgcaagattccattctcgacacaagatgaaaaaggggttacccagaacggaagattgatcactgcaaatcccatagtgacagacaaggagaaacctgtaaacattgaagccgagccaccctttggcgagtcttatatcgtcatcggtgctggggaaaaggccctgaaactctcctggttcaagaagggctcaagtattggaaaaatgtttgaggcaaccgccaggggcgctcggcgaatggccatcctgggggatactgcatgggacttcggaagcgtgggtggcgtttttacctccgtggggaaacttgtccatcagattttcggaacagcgtacggcgtgctgttttctggtgtaagctggacgatgaaaatagggatcggcgtgttgctcacctggctgggattaaattcacgcagtacttccctgagcatgacatgtattgctgttggcctagtcaccctctacctgggggtgatggtgcaggccgattctggatgcgtcatcaactggaagggcagagaacttaaatgtggttcagggatcttcgttacaaatgaggtgcacacttggaccgaacaatataagtttcaggcagacagtccgaagaggttgagcgccgctattggaaaagcctgggaggagggcgtgtgcggtatacggtccgcaacgcgcctggaaaacatcatgtggaagcagatttctaacgagctcaatcatatcctgttagaaaacgacatgaaattcacagtagtcgtgggcgatgttgtggggattctggctcagggaaagaaaatgatcagacctcaacccatggagcacaagtactcgtggaaaagctggggcaaggccaagataatcggggcggacgtccagaataccacttttattatcgatggaccaaacacccctgaatgtcccgacgatcagagggcctggaatatttgggaggtggaggactatggcttcggtatctttacaactaacatatggcttaaattgcgtgattcctacacccaggtttgcgaccaccggctcatgtcagctgcaattaaggatagtaaagccgtgcatgctgacatggggtattggatcgaatctgagaagaatgaaacatggaaactggcccgagcatccttcattgaggtaaagacgtgtatctggccaaagtcccacaccctatggtcaaacggagtcctggaaagcgagatgataatccccaaaatttacggcggtcctatctctcaacataattatagaccaggctacttcactcagacagcggggccgtggcacctcggaaagctggagcttgattttgacttgtgcgaaggcaccactgtggtggtcgatgagcactgcgggaacaggggaccctccctgcgcacaaccacggttactggcaaaattatccatgaatggtgttgccggagttgtaccttacctccactcagattcaagggtgaggacgggtgctggtacggaatggagataaggcccgtgaaagaaaaggaggaaaatctggtaaagagcatggtgtctgccggctccggtgaggtcgactcatttagtcttggcctgttgtgtattagcatcatgatcgaagaggtgatgcgctcgcgatggtcccggaaaatgctcatgacagggaccctggctgttttcctactgctcattatgggacagctgacttggaacgatcttatccgtttgtgcattatggtgggcgccaatgcatctgacagaatggggatgggaacaacctatctggctttaatggccacatttaagatgaggcctatgttcgcagtcggcctcctgtttcgccggcttactagcagagaggtgctgctactcaccataggtctgtcattggttgccagtgtggaactgccaaactccttagaggaactcggggatggactggctatgggcatcatgattcttaaactgttgacggacttccaatctcaccagctctgggcgacactgctaagcctgacctttatcaagactaccctttccctccattacgcctggaaaacaatggcaatggtcctgtcaattgctagcttgttccccctgtgtttaagtactacctctcagaagacgacatggctcccggtactgcttggctccctggggtgcaagcctttgaccatgtttctcatcactgagacaaaaatatggggaagaaagagctggccactgaatgaaggtatcatggccgtgggcgttgtgtcgattctactgtcatctcttctcaaaaacgatgtccccctggccgggcctttgatcgctggaggcatgttaattgcatgttatgtgatcagtggttccagcgccgacctgtctctcgagaaggcggctgaggtaagctgggaagaggaagccgagcactccggggcatcacataacatactggtggtcgttcaggatgacggaaccatgaaaattaaggatgaggaacgagacgatactcttacaatcctgttgaaagccaccctactggctgtgagtggcgtgtaccccctcagcatcccagcaacgctgttcgtctggtatttttggcaaaagaagaaacagcgctctggcgtgctttgggacactccttcacccccagaggttgaacgggccgtattagatgacgggatttacagaataatgcagaggggactgctcggtcgtagccaggtgggcgtcggggtgttccaagagaatgttttccacaccatgtggcacgtgacacgcggagcggtcttgatgtatcagggcaagcggctggaaccgagttgggctagcgtgaaaaaggacctcatctcctacggtgggggatggagactgcagggctcttggaacaccggcgaggaggtacaggtcattgccgtggaacctgggaaaaatcccaagaacgttcaaacagcaccaggaacttttaagacccccgagggtgaagtgggcgccatcgctcttgatttcaaacctgggacgtcgggaagcccaattgtcaatagggagggcaagatcgtgggtctgtacgggaacggagttgtgacaacttcaggcacctatgtctccgccatagcacaggctaaagccagtcaggaaggccccttgcctgagatcgaggacgaagtgtttcgaaagcggaatctaacaattatggatctgcatccggggtctggaaaaacccgcagatacctcccagcgatcgtaagggaggccattaagcggaagttacgaactctgatccttgcacccaccagagtggttgctagcgaaatggccgaggctctgaaaggtatgcctatacgctatcaaacaacggcagtcaagtccgaacacactggcaaagagattgtggacctcatgtgccatgccaccttcacaatgaggttgctgtcaccagtgcgtgtccccaactacaatatgatcatcatggatgaggcccactttaccgacccttctagcattgctgcgcgggggtatatcagtactagagtaggaatgggcgaagcagccgctatattcatgacagccaccccgcccggttccgtggaggcatttccacagagcaacgccgttattcaggatgaagagagggacatccctgaacgctcttggaactcagggtacgagtggattacggatttccccggaaagactgtgtggtttgtcccatccatcaaaagtggcaacgacatagctaattgtctccgaaagaacggcaagagagtgattcagctgagccggaaaacattcgataccgagtatcaaaagaccaaaaataacgactgggactacgttgtgactacagatatctcggaaatgggggcgaactttagggccgaccgcgtcatcgatcctcgtagatgccttaagcccgtgattctaaaagacggaccagagcgggtaatcctggcaggtccgatgcctgtgaccgttgcttctgccgcacagaggcgcggccgaattgggagaaatcataacaaggaaggagatcagtacatatatatgggccagcccttgaataacgacgaggatcacgcccactggacagaggctaagatgttactggacaatatcaacactccagaaggtattatccccgccctcttcgagcctgaacgggagaaatccgcggcaatcgatggggaatacaggctgcgcggcgaggccagaaagacgttcgtcgagcttatgaggcggggagacctgccagtgtggctcagctataaagtggcttcagaaggctttcaatacagtgatcgtcgctggtgcttcgacggggagcgaaataaccaggtcttggaagagaatatggatgttgaaatttggaccaaggagggagagaggaagaagctgaggccccggtggctagacgcccgcacatattctgaccctctggctctcagagaatttaaagagttcgcagccggtaggcggtccgtgagcggcgatcttatactggaaatcgggaagttaccgcagcatttgactcagcgagctcaaaacgccctggacaatctcgtaatgctgcacaactcagagcagggaggcagagcataccgccatgcgatggaggaacttccagataccattgagacactgatgctcttggccctgatcgctgtgttaaccggtggggtcactctatttttcctgagtggcaggggactcggcaagacgagcattgggcttctgtgtgtgatggcctcctctgttttgctgtggatggcaagcgtggaaccccactggatcgctgcctccataatcctcgagtttttcctgatggtccttctcattcctgaacccgaccggcagcgtaccccacaggataatcaactggcatatgtagtgatcggattgctgtttatgattttaacagttgccgctaacgagatgggtctactggagactaccaaaaaggacctcggcatcgggcacgtggcggtcgaaaatcatcaccatgccacaatgcttgatgtggacctgcaccctgcatcagcttggaccttgtacgccgtcgccactacaataattacgcccatgatgagacataccatcgagaacactacagcaaacatttctctgaccgctatcgccaatcaggcggctatactcatgggactggataaaggctggccaatcagtaagatggacattggtgtgcctcttttagccctggggtgctactcgcaggttaacccgctcaccttgacagcagccgtgctgatgctagtagctcactatgcaatcattggccccggactgcaagccaaagcgactagggaagctcagaagcgcacggccgcaggcatcatgaagaatccaaccgtggatgggatagtcgccattgacctcgatcctgttgtgtacgacgctaaattcgagaagcagcttggacagatcatgctgttgatcctgtgtacaagccaaattctcctgatgcggactacctgggccttatgcgaatccatcacacttgcaaccggccccctgactacgctctgggagggttctccagggaaattttggaacacaaccatagctgtctcaatggccaatattttccgaggaagctatctagcgggcgccggtctggcattttccttgatgaagagtctgggcgggggaagaaggggcactggggctcagggagagaccctcggcgaaaaatggaagcgccagcttaaccagctgtctaagagcgagttcaatatctacaaacggtcaggtattatggaagtggacagatccgaggccaaggaagggttgaaacgtggagagacaactaggcacgcagtaagtcggggcaccgctaagctgcgctggttcgtggagcgaaacctcgttaaacctgaaggtaaggtgatcgatttaggctgtgggagaggaggctggagctattactgcgccgggctgaagaaagtcacagaggtgaagggatatacgaaaggcggtcccgggcatgaggaaccgataccaatggccacctacggatggaatcttgtcaagctgcactctggcaaagacgtgtttttcactcctcccgaaaagtgtgatacactactctgcgacatcggcgagtcctcaccaaaccccaccattgaggaagggaggactctgcgggttttgaaaatggtagagccttggctgcgcggaaatcaattttgtatcaagattctcaacccgtacatgcccagcgtggtcgaaacacttgagcagatgcagagaaagcatggtggcatgctggtgaggaatccattatcgcgaaactctacccacgagatgtattgggttagttgcgggacgggaaatatcgtgtccgcggtcaacatgaccagccggatgctgttgaatcgtttcacaatggctcacagaaaacctacttacgaacgcgatgtggacctcggcgcaggtaccaggcatgtagccgtggagcccgaagttgctaacctggatattatcgggcagcggatagagaacattaagcacgaacataaatcaacatggcactatgacgaggataatccttacaagacttgggcctatcatggatcctacgaggtcaaaccatctggcagcgcaagttccatggtgaacggcgtggtcaagctacttaccaagccctgggacgttatccctatggtgacacaaatcgccatgaccgatactacgccatttgggcagcagagagtattcaaagaaaaggtggacacacgcacccccaaagctaagaggggaactgcgcaaattatggaggtcaccgcccgatggctgtggggttttctcagccggaataaaaagccgagaatatgtacaagggaagagttcacgcgcaaggtgcgttctaacgcagctatcggcgccgtttttgtggacgaaaatcagtggaactcagcaaaagaggccgtcgaggatgaacggttctgggacctggtgcagaaggagagagaattgcacaaacaggggaagtgcgctacctgcgtatataatatgatgggaaaaagggagaagaagctgggcgaatttggtaaagccaaggggagtcgcgcgatttggtacatgtggctcggagcacgattccttgagtttgaggccctgggcttcatgaacgaagatcactggttctcccgggagaatagcttatctggcgttgaaggggagggactgcataaattgggttacatcctcagagacatttcgaagatccctggcgggaacatgtatgctgatgacactgccggatgggatacaaggataaccgaggacgatctgcaaaatgaagcaaaaatcactgacattatggagccagaacacgctctacttgccacatcaatctttaagctgacctaccagaacaaagtggtccgcgtgcagagacccgctaagaatggcacagtgatggatgtcattagccggagggaccagcgtggttccgggcaagttggaacttatggcctcaacaccttcacgaatatggaggcccagctgatccgacagatggaaagtgagggcatatttttgccttctgagttagaaaccccaaacctggcagagcgcgtgctcgattggcttgaaaagtacggggtagagagactgaaacggatggcgattagcggagacgactgtgtggtcaagcccatcgatgacaggttcgccacagctctaactgccctgaacgatatgggtaaagtgcgcaaggacatcccgcagtgggaaccttccaaaggctggaatgattggcaacaggttcccttttgctcacatcacttccaccagctcattatgaaggacgggagagagatagtggtcccatgtcggaaccaggatgagttggtgggaagggcacgagtaagtcaaggcgctggttggtctctgcgtgaaaccgcctgccttggaaagagctatgcacagatgtggcagctgatgtactttcatagacgcgacctccggttagccgcgaatgctatctgttccgccgttcctgtggattgggtccccacatcaaggactacctggagcattcacgcacatcaccaatggatgacgacagaggacatgctgtctgtgtggaacagagtttggatcgaagagaatccatggatggaagataaaacccatgtgtccagttggggagacgtcccctatttgggcaagcgcgaggaccagtggtgcggcagcctgattgggctcactgcccgggctacatgggcctcgaacatccaggtggcaataaatcaggtaaggcgacttatcggaaacgagaattacctggattacatgacctccatgaaaagattcaagaacgaaggtgaccctgagggcgctctatggtga
